United States Patent 6,812,339 (POLYMORPHISMS IN KNOWN GENES ASSOCIATED WITH HUMAN DISEASE, METHODS OF DETECTION AND USES THEREOF) - sequence listing, part 91

SEQ ID NO: 63668 - DNA, 601 bp, Human
accagtgaagattttgaatttatcctattaaacagcagaaaccctcagagctgtttaaggaagatgtatgggaagttatcacataaaattgcactggattcaaattctggctacaaccctgatgacctatatgacgctggataagtggcttattttcccaagactcagttttcttacctgtaaaacagggataatcctgtaaataggaataaatattagtatagtatctggcatataatattcacatcataattcagctatcataatgattactgtgttatatattattactgttatatgrtatattattgtacattgttatatatatacacattattgttaaattttataatgattagtgacatgatcatatctgtggtttagaaagattagtgattctcttgaagatgagctgtattggagaaaagacaatgtaaagaacaattattgaagcctgtgctcctcaaactggcactgcacaggataaattgaaatacttttcacattttgtgtaagtattccaaagaaaatattcttattttaagataaacattgatatattataaagtggactaaaacaagaggttccaaagatatttta

SEQ ID NO: 63669 - DNA, 601 bp, Human
agtgagctaatttaaagatgaaggccacacaacttcaaggagggccaaccagcccctgcattgagcctgcaactccctcaactatccacaggccttcattgtcaggaagcaataaagtgattctcactttaaattagttcaattagcactttttttttaaggcagaaaatgcttttattaaaaaaaagtgattttctcctttttggcaacctgtatatgaaaaagaattctgtgggcttttgttttaccatttagcagctgttcttgcttaagaagtgccacttttctccttttgagggakgtcaagctgttgggggttaatttcagtcagttctgtgccctcttccccagatgccttttaaaaatgttacatgcatttacatggggatagaatggaaagaacatgataacttatttttaacttatggctgcagaagctctgcataattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtag

SEQ ID NO: 63670 - DNA, 601 bp, Human
tagcactttttttttaaggcagaaaatgcttttattaaaaaaaagtgattttctcctttttggcaacctgtatatgaaaaagaattctgtgggcttttgttttaccatttagcagctgttcttgcttaagaagtgccacttttctccttttgagggatgtcaagctgttgggggttaatttcagtcagttctgtgccctcttccccagatgccttttaaaaatgttacatgcatttacatggggatagaatggaaagaacatgataacttatttttaacttatggctgcagaagctctgcrtaattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtagtgaaaaatgaataacttgaattgattgccaagagggaggggtcaggcccagtgcctggaacctggtaggaagaaagaccaagttgtagcagctgccacgtgttgggcgctgtgctgagtgctgtctttgtgtggtctcatctc

SEQ ID NO: 63671 - DNA, 601 bp, Human
aatggaaagaacatgataacttatttttaacttatggctgcagaagctctgcataattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtagtgaaaaatgaataacttgaattgattgccaagagggaggggtcaggcccagtgcctggaacctggtaggaagaaagaccaagttgtagcasctgccacgtgttgggcgctgtgctgagtgctgtctttgtgtggtctcatctcttccctactctcaccctgtgaagtcagtatcaccctcttcactttcacggaagaagctgatcgaaatcacccagctgatattcaattgaccgaggattcaaaaccaagatggggctgggcgcggtggctcatgcctgtaatcccagcactttgggaggctgaggcaggcagatcatgaggtcgggagttagagaccagcctggccaatatgatgaaaccccatctctactaaaaatacaaaaattagc

SEQ ID NO: 63672 - DNA, 601 bp, Human
gcgtataagtgagtttctaggtaagtacttggcaaaacttgagaagaaccagcagaaggaagagaagaataagtagagtacaatgtaaaaacaggattagggttcttcccatcgagcactcctttgcttcaaatgggtgaggtgtctaaagtgtactaggaaagttatctgcattcctcatgctgttttttcaaattcagtcaattccttagccattttttgcccaacccaggaactttaagagtcagtgaatggaactagttgttatatagccttttaaatgaaagaacttaaatgtctsctcttgatgtgctgactctataactgatgggagtgtaggaattttaacatgtcactgcgattacattggaatggtgaacaaaatgtcactgaatgcccccttcccccaaagagcaataaccataacaggtggtgtctgatgacttggaaagatacatgacataaaatttttataggcctagagttttcaacacgaatatgaagcagagaagtaggcaataattatgtgtacgtgtattttgtccactcaaaagatccacccaaacttcttattcagtctgaacctcaaataccaccactg

SEQ ID NO: 63673 - DNA, 601 bp, Human
tttttgatacttgctacatgtttgaggaatgcttctaggtatggaccacaaatatgcagcaaatatcaaatcactgaattttatcatggaaccttctgcttttaaaatataattaaattactactgtctgaattccaagtgtggaattcagaatttcaacttcctgttgaaggtaaaaggaattctcctggaggtaatttgtagtatagctggatacaagttaaaatcctgatctgttcccgcaaccttcacttccttcattatggaaactcaaggtacaaatagtgtgtccattaaaatscttatttacatattgtgtcacctttccctttcctctgtccatgccaaagtcatgccattctttcttccccatcacatctgtctctccccaaagcaactaagctaccattgctaaacaagtccaatggaagacagtataatatgatgtcatagaaggagcattaagcaaggagcctatttttgacaagagtcaactgtgggatcctagggaactcactctttctttttggatcttagttgccccatttactaatcatggtttgttggatcacatgatttattaaatctttctcctaattcc

SEQ ID NO: 63674 - DNA, 601 bp, Human
ataagaggttaatatgtgaaaatatattttggcagagtttgaagtctagagttgtagaacctaggaacttttcataacctcagtattgaagcagaagtttttttttcagagttttacaaaatataagtactcatttctattgtaaagaaatatatttctggctgggtgcagtggctcatgcctgtaatcccagcactttgggaggccgaggcgggcggatcacgaggtcaggagtttgagaccagcctggccaatgtggtgaaaccccgtctctaccaaaattacaaaaattagctgggcrtggtggcgtgcacctgtagttccagctactcgggaggctgaggcagaagaatcccttgaacctgggaggtgcagattgtagtgagctgagaccgcaccacttactccagcctgggcaacacagcgaaactccaactccaaaaacaaaacaaacaaacaaacaaaaaaaccaaatatatttctttgcaagtaaatcctcttcctgctagaggcttctgtatggagaacagcacttcagtaagattacttccaaatatttctatttattgatatgttccatgtctcctatcttcttaagcat

SEQ ID NO: 63675 - DNA, 601 bp, Human
ccacaataaagaatatttggcccaaaatgtcagtagcaacaaggttgagagatcctattctaggtttaagctttatcattattattattattattatttttggattatgaagttaactgattttttttattgttttttgcttttaatttttttgtttttctttaacaaatttaagtctcctgaagattctttagagtagaaatgcaattttctggaacttgtctgatgaaaatggatgtggacactttaccacatcatgatgtctgcccaagcaaatgcattataatcataagtgatccaktatttcttctctgcctagttgagtgtagatttagttctgcacatgccccaaatgtctgggtggcagtttaaatgagctgcttgccttccttcccaaaccaaattcagaaccttttaactgacaaccacatcttaaaatgtgcttctaatggtagctgatggcttcaaaacagcctgcaggtaaggtttctgaatgatcttctcagcaagccaagtctttctgtttcagttctttgagaatgccacagcacctccaagagagcccattcactatttgtcagtggatcgtgtgcttcccagg

SEQ ID NO: 63676 - DNA, 601 bp, Human
tttttttattgttttttgcttttaatttttttgtttttctttaacaaatttaagtctcctgaagattctttagagtagaaatgcaattttctggaacttgtctgatgaaaatggatgtggacactttaccacatcatgatgtctgcccaagcaaatgcattataatcataagtgatccagtatttcttctctgcctagttgagtgtagatttagttctgcacatgccccaaatgtctgggtggcagtttaaatgagctgcttgccttccttcccaaaccaaattcagaaccttttaactgrcaaccacatcttaaaatgtgcttctaatggtagctgatggcttcaaaacagcctgcaggtaaggtttctgaatgatcttctcagcaagccaagtctttctgtttcagttctttgagaatgccacagcacctccaagagagcccattcactatttgtcagtggatcgtgtgcttcccaggaggttatccattccatgataaattctttccaacttgcagtgctgggtagagaacatgtcctccccttgtagttcagatgtttttgtggacttccgtctgcttcattgtggtgttagtggca

SEQ ID NO: 63677 - DNA, 601 bp, Human
ttcatcatgaatgatctaaaggggttaggataggataggactactaagtagtggattcagagaaacaggtttcacttcaacatctgatggacctttctcacagtaagagtcctccaaagaaggggttggctgcccttaagtgttccccatcattggaaaattcaaacatggcttggctagctgcttggtaaggatgttgcagaaggaagtcaggcagcagattttgattgtcttgatgacttttaaggccacttacattagggagtctttattttctacctttttcaggcagaatctcctsttgagtttacacaatatttatcaagtcttctctggaatggaaggagagaagtcaaagttaaccctgttaaacatattctagacaatcattttactttcttggaaggatttttaggacagagagattcttcccatcttgtgcttgttctaactacattaactattagtactgcattgatggctgacttactgggaagactgcttggaaaaatacaagaagccattgtgggaaagtgtattctccaaaagaattccaaatgaatgaagttgtttggattttgtctgagtgcaggtttataca

SEQ ID NO: 63678 - DNA, 601 bp, Human
gtttggattttgtctgagtgcaggtttatacacacatgcatttatgtatttcctgaatctttttgggatataagtttttccagagaaagctttgctctgtgcataagcagaagagaagaacatgaggaaagcacaagagtgtagggacaagaacctggccatactcaaaaggaactgaaggaagtccacatgactgggcaggaaatggggctgacactgctgttatttggcgtctttctttcctaattgggcagcatagaagagagagagcagcagtcagactctggggggtggggggggsggtcaacactgacccctctgacatcatctggtgggctgggaataatttctgaaatagtgtaaccaaacatgtgcagacaattatgtctgatgacataagcccaccacaaaaactgggcctgaaaatgccacttgaaagagtctctcactttgcattaatttttttttccatgaactgtggttattttatttctgggtctttaatatgcagggtaaatgaatcaaaggctgatcgtgatatgttcttttgatatcagttttaaattgtgccacctgcaggaggctaagcttgttatagtga

SEQ ID NO: 63679 - DNA, 601 bp, Human
cctctgacatcatctggtgggctgggaataatttctgaaatagtgtaaccaaacatgtgcagacaattatgtctgatgacataagcccaccacaaaaactgggcctgaaaatgccacttgaaagagtctctcactttgcattaatttttttttccatgaactgtggttattttatttctgggtctttaatatgcagggtaaatgaatcaaaggctgatcgtgatatgttcttttgatatcagttttaaattgtgccacctgcaggaggctaagcttgttatagtgagatgtatttttagayggtggtattcgatgctaagacatgtgtgtatagagcaggacaatgactgccagcaggagagagagaggaggggagacaagaagagacaaggacaggaatgaaagctttgagccaagaaatgaaaataaacagttcctaaccccaaagctgcagtggaattcccagctgggctctggattgtgtttgattcggtggaggacattttctgggcagcgtttatctgctcccctggctgggctttcacagcacccatatcttatccaagcagcatctattttaagccctgtaaagttcagacca

SEQ ID NO: 63680 - DNA, 601 bp, Human
ggtggtattcgatgctaagacatgtgtgtatagagcaggacaatgactgccagcaggagagagagaggaggggagacaagaagagacaaggacaggaatgaaagctttgagccaagaaatgaaaataaacagttcctaaccccaaagctgcagtggaattcccagctgggctctggattgtgtttgattcggtggaggacattttctgggcagcgtttatctgctcccctggctgggctttcacagcacccatatcttatccaagcagcatctattttaagccctgtaaagttcagaccayttgcctttaactgaccacacagcagtagaattgcaaggtgcggtggtaggagtattataaagggagttgggagctgctagtcctagtaactcatgtgcccgtgggcaaatattgaatctctcttctagaaaatggggacagtaattcccaccctttatacttacttcaaggactggcttagggcaaatgagaaaataagtcggaaagggattggcaaagcataaattattccacatgaatgcagtatgaaattttgtaagtgataactttctgatttgaccttttttctcctctgatgtg

SEQ ID NO: 63681 - DNA, 601 bp, Human
tgggcccagccttcctgtccttctacctcatcctcctgtcatcaaaataaactctggatgccattcagtatggccagctcatctttacctcattacccatttttccccttacatttactcatgtatgccatctacacaaatgtcctttcattcccacatcacctctccatcccaccccactatccaaatcacactgagtctcaagcccagctcctccttcgtgtctttcttcttcttagtccttctccccctcttctctctactttatcacagacacacattttctttgcactgtacatayatgcgcagaaattacctctgtgtctttcacttctgcccatgtgtatggtcctaaaaatgcatgttctagttgctcaaaacatgttcgttgaatgaataaatcagggaggggaagaaaagatgctactaaattaaaaattcattttaatgaccaatagccacatctagtgtaccagctataaagtatctgatgagaattactactttaaatgcttatccacaattatactgtctttaagatccaaaaatatccttaagtctttctttttggaaaaagtttttcaaactttccggctgatgt

SEQ ID NO: 63682 - DNA, 601 bp, Human
tggaaaaagtttttcaaactttccggctgatgtatattctctgagaataagattcaaatcagcagtaagtgtgtgaatttatatggtgatgatattgcagacataattatcctcagcagtaggatcattcttattatgaattttgtaaaatttctttcactcctcctatccttaaagagtccctgtgtttctatactaaaagaatccctgtttaaaaaaagtatatatacctgtttgtaggatagccatgcatgtagcaacatagtattgtttgtgggatagctgtgcatgtagcaacataacattgttgtaactggattctcattgttgtaattgccctccctactagatgtggtattggaacctccaaggacaacctggaggaaggtggaagcaacttgaaattgggaaacttaggtccttcttgtgacttttcttttaaggagtcacttcacctctgtgttgttgcttcatctgtaaagtttattagataagcaaactgaaagctctctttcagctcaacagctctagaattctacatttatgatctttgattcattgttagctcaagggacaccagactaaattgtagatcatccct

SEQ ID NO: 63683 - DNA, 601 bp, Human
tgtgtatgcgtgtgtgtgtgtgtgtgtacatgtacattccacttttgcctgtgtgactatgaacaagtcagtttctcatgataggactcagttttctgaattccaaagaggacagttgagctggattttgtttagggcatcttccaatgccagttccatttataaacaattattgtttttccattcccaagaaaatgcaagattgtgttttggggaagattctcaactgtgagatgacagcgtatgctatgttcctttcattgcaattggtgttttatagcatcctgcccagcctggcccrcatttggccccgtagccatgctgtcctcaggctaggatctggttagttgttccagactcaagttggtccctccttctgctctgtggagaaaaatcacaacctcaaagggataggtttttttttttatggttgctcctgaaagtggcatggtccctctagatgtcagcaaatattaaggcaattaaataaggcaaattaattatgggaaacattagcattgatttctgaagacagtcttcttcttgctgagtctagcctcaccccttcttgccttttaggaagagttccatgttcttagac

SEQ ID NO: 63684 - DNA, 601 bp, Human
gcaggatttttctcttctggaacaaaattgtacacaactaaatgtgcaaatcataagtatccattctcttgaaggttttttttttgtttattttgttttttgagatggagtctcgctctgtcacccaggttggagtgcagtggcgcgatcttggctcactgcaagctccgcctcctaggttcatgccattcttctgcctcagcctcccaagtaggtgggactacaggcgcccgccaccatgcccagctaattttttgtattttttagtagagacggggtttcagcgtgttagccaggatgktctcgatctcctgacctcgtgattcgcccacctcagcctcccaaagtgctgagtctcttaagttttaacaaatgtaatacacttgtatataaatttcctaccctttgttttcttgtgtctacctcatttgtatagtttacaaaacaaaataagaaggaaatggaaggacagggcacatagttgtccacagaatagtctgttcttttcccagcagccaggggctccctcccttgcacctcctatcctcagtccctcattctatcttatagccaagcattgctagaaaggccaatttaaatc

SEQ ID NO: 63685 - DNA, 601 bp, Human
tacacaactaaatgtgcaaatcataagtatccattctcttgaaggttttttttttgtttattttgttttttgagatggagtctcgctctgtcacccaggttggagtgcagtggcgcgatcttggctcactgcaagctccgcctcctaggttcatgccattcttctgcctcagcctcccaagtaggtgggactacaggcgcccgccaccatgcccagctaattttttgtattttttagtagagacggggtttcagcgtgttagccaggatggtctcgatctcctgacctcgtgattcgcccrcctcagcctcccaaagtgctgagtctcttaagttttaacaaatgtaatacacttgtatataaatttcctaccctttgttttcttgtgtctacctcatttgtatagtttacaaaacaaaataagaaggaaatggaaggacagggcacatagttgtccacagaatagtctgttcttttcccagcagccaggggctccctcccttgcacctcctatcctcagtccctcattctatcttatagccaagcattgctagaaaggccaatttaaatcaaatgagatggtttagttttattctacact

SEQ ID NO: 63686 - DNA, 601 bp, Human
ccaccatgcccagctaattttttgtattttttagtagagacggggtttcagcgtgttagccaggatggtctcgatctcctgacctcgtgattcgcccacctcagcctcccaaagtgctgagtctcttaagttttaacaaatgtaatacacttgtatataaatttcctaccctttgttttcttgtgtctacctcatttgtatagtttacaaaacaaaataagaaggaaatggaaggacagggcacatagttgtccacagaatagtctgttcttttcccagcagccaggggctccctcccttscacctcctatcctcagtccctcattctatcttatagccaagcattgctagaaaggccaatttaaatcaaatgagatggtttagttttattctacacttgtctcatgttctgatatggtgagcctgcttttaaaggcttgtattcaacttatattcacatttcaatgagaaaagtttttgagatatataaaaatagaaactttctaatagatatcagaaagttgaattatagtgtgattacctcactattacatttttcctcttttgccttttgccgtttctcccctttcttctttccctt

SEQ ID NO: 63687 - DNA, 601 bp, Human
caccgttaagatgtgtatacaatctctgtgtgtacccttagtaaataatagccttgtcaacaaagccaaagcaaaatcaaaggttataaaaatgaaatgacgaattcagggctgtataggttcagccaatcagataatttatattgagagtttaaaaaagaaaaagaatacccttacttgaattatctaggtttagctttatgaggaagctttatgcttcctcttttctagtgtagctactcttttctagtgtaagtagcatctgtgtgtctgtctatattctttaggtagtatgagtacrttcgaaatgtatatcagctctacgtgaatataataaatgtggaaattatgcatgttgtcgaatgctgtttgttgatgtttagaagtgtgtttttattttggtttgtgcagctgtgcaggcagaggttatttattcagatataagtagaattctctgcactaaggcacctttgtttagctaaaatcaagctgagcttatttttctttgccaggagatcaggatagcctttggaaaaagtaagaaaatcaaacttgaagctttagcctcttgtatgtccatttagcctaaggaccttaagtc

SEQ ID NO: 63688 - DNA, 601 bp, Human
tgcagctgtgcaggcagaggttatttattcagatataagtagaattctctgcactaaggcacctttgtttagctaaaatcaagctgagcttatttttctttgccaggagatcaggatagcctttggaaaaagtaagaaaatcaaacttgaagctttagcctcttgtatgtccatttagcctaaggaccttaagtctgtaagacatgaacacgttatgtgtaactgtcctatttgtacttttaacagaaatggaaaagcaactcaacccaaaacctggaaatgcacaccatctcctatactrtgtgagttatggagaggctcagctaaaaccaccccgtgtctcagatcccttatatggcattattaatcctggatcttcgcaacagattcattagaaaagaataaagctaagaaggagccagagtagatcttgatctcagagttgatgtattatacaagcgcactttaataatgtggcattaggatgttggcaggagggcacactatgatggtgctacagttgatggaatcttccagttggtgactgagcaccccttagcagttagggtgcatgcaagataaaattcaaggtagtaacttc

SEQ ID NO: 63689 - DNA, 601 bp, Human
gaacacgttatgtgtaactgtcctatttgtacttttaacagaaatggaaaagcaactcaacccaaaacctggaaatgcacaccatctcctatactatgtgagttatggagaggctcagctaaaaccaccccgtgtctcagatcccttatatggcattattaatcctggatcttcgcaacagattcattagaaaagaataaagctaagaaggagccagagtagatcttgatctcagagttgatgtattatacaagcgcactttaataatgtggcattaggatgttggcaggagggcacactwtgatggtgctacagttgatggaatcttccagttggtgactgagcaccccttagcagttagggtgcatgcaagataaaattcaaggtagtaacttctaacaagagagtttgttttcataccgtgtgaacatggatcagatataccatcttactcttaggtcttagaccagaactctgccttgccagtgtaagttaagccatattcactggcaaggtggtgccgcccatggtcaagcctcagaagcatagccctgcaggagcagagcttgtcttgttcaaaaccaagtttgatgaggtggat

SEQ ID NO: 63690 - DNA, 601 bp, Human
tttgatgaggtggattgttgcttagtagcaggagatattagaatcctcggacttttctgaggccagtcttgtgattcatatgttctagcatcttaataaacaacatagggattcccaaaggtgaactgaagagcacaagtcacctgcctttagctgtgagcatccaaagtagctgtgctctgcatgtggagcgcacacattgtcccacagccccgtcttttgaaaattgaaatgtccaaaaagcagtagcaggcagtgggtactaagtctggcaaatcctgggttctgagatctagttttstctcctgagaagcaggagtaagagttcacactagatttgtgtaccactgtgtatttgtgatccagagcaagagatggacctataactgtgcagttatgctgggcacctgcagccaagccatccagtattcacaggaacgagacaccaagggaaggcttcaaagccatcatttctccttccattcaatcaagtgcttaattgagcagctgctgtgtcaaacatgagcctagtcctgtaatggcttgttgttgaatgatttaccatctcattgaggataaatatcaaagcgcttcatgtagc

SEQ ID NO: 63691 - DNA, 601 bp, Human
attgttgcttagtagcaggagatattagaatcctcggacttttctgaggccagtcttgtgattcatatgttctagcatcttaataaacaacatagggattcccaaaggtgaactgaagagcacaagtcacctgcctttagctgtgagcatccaaagtagctgtgctctgcatgtggagcgcacacattgtcccacagccccgtcttttgaaaattgaaatgtccaaaaagcagtagcaggcagtgggtactaagtctggcaaatcctgggttctgagatctagttttctctcctgagaagyaggagtaagagttcacactagatttgtgtaccactgtgtatttgtgatccagagcaagagatggacctataactgtgcagttatgctgggcacctgcagccaagccatccagtattcacaggaacgagacaccaagggaaggcttcaaagccatcatttctccttccattcaatcaagtgcttaattgagcagctgctgtgtcaaacatgagcctagtcctgtaatggcttgttgttgaatgatttaccatctcattgaggataaatatcaaagcgcttcatgtagcctgcaagtctggg

SEQ ID NO: 63692 - DNA, 601 bp, Human
taaattccacacccttgcttttatggtcgggtaggtgaaaccgacgtgtgaaggaacacacgcaatacagcagcacatgtgctgtgacagaggcacatacatagaactgggggcctgcaggaggaagaaacaaaaagcatggccaggggacagatggatgtgcaaagatattcaaattcagtcttacaaagcagccaaggtgtgagtgagatgtaattggaggagtgagggcacggcattcaaggggaaagaagcaggcatgagacggctgctctgtcctgggaaattcatgggaatgtamataattgtgttgataggggaagtaagcaagatcaaggctgcggcagagctgctgaggacattgaacctcatcttgaggccaatgggtagccattgaagatttcaacagggagatgacatgcacagaatgacacttttgaaagatagctctggtggcagctagagataggactggaggaatacccagaccgggcctggatctcttttccactgtaaaattccccaggaaattttgaatcttttgacgtccctaagggggctttccaatagcatcttttcaaagtgctgtctgtgtaatctt

SEQ ID NO: 63693 - DNA, 601 bp, Human
agcactggatccacaacagggagggagaagcaactatctgtggtccccgttctggttcaaggagggtggtagagaaaaggcagggttttggttgcaattctgtgtcacgtgtcctgtcaggagaaaccacgtgggttttcccatctgccattgccccatccttggctcaagagctagctccctctacctcctcagacaggcatgttttgcattaccttttaggtgaagttctagcaaaatttggtgtatatcaaattatatgccaaattctttaggatagaccatagagtaaatagtcatytttattcccgaaacactttgtttccaaatatctttgtgttttggaaatccagattttcttatcttgggaacctgctgtattttatcttagttttatattctatgagcttctctcttggtgagctccaggttgagctgctctgctggcttaggcttcatctggtagaattaaaagttacattgggtcacacgtcccaggtgttgcatcacaggccacagaattacctatataaaactgagtgcaaatgtagacactcttccactaaattgtttttagcaattaaaagtgtacctttggttt

SEQ ID NO: 63694 - DNA, 601 bp, Human
tagaatgatacagctgaagcagccgaagtgatttacaggaaacccagttaacttgagtttgcttgcagtttctatcttatgatggttttagcagtaacagcagcaaataatataccgtcctataaagcacctctagagaaaagaattcttccacattccccagcatgacatgcttcttctaaaaagtatttgtgtttctctaacttaaaccctataggctacaatgtcctaaatttggtgagaagtgggaggtcatagctggcatatcctggaatagggtggccaaaagtctcattttgcycaggctgttggggtctactcggatctgagactttaggtactaacatgggaaagtcctgggcaaactgggatggatggtcaccaaatctgagggggtgtgtgtgtgtgtatctgtgtgcatatttatggttggagggggagtggaaaaaaggggagtgaaagaggttttgtttaatgtatttcttttagctagaaggttttatatattcttcactaggccaactagaataatataatgctggttttgagattagcttgaaataattcctatttctcccatctgtgggttctctataccccc

SEQ ID NO: 63695 - DNA, 601 bp, Human; identical to SEQ ID NO: 24056

SEQ ID NO: 63696 - DNA, 601 bp, Human; identical to SEQ ID NO: 24057

SEQ ID NO: 63697 - DNA, 601 bp, Human; identical to SEQ ID NO: 24058

SEQ ID NO: 63698 - DNA, 601 bp, Human; identical to SEQ ID NO: 24059

SEQ ID NO: 63699 - DNA, 601 bp, Human; identical to SEQ ID NO: 24060

SEQ ID NO: 63700 - DNA, 601 bp, Human; identical to SEQ ID NO: 24061

SEQ ID NO: 63701 - DNA, 601 bp, Human; identical to SEQ ID NO: 24062

SEQ ID NO: 63702 - DNA, 601 bp, Human
gttggttaagacatcctaggagttttgaacctaggcctcaaggttctcaccagttaactgggaatatcaaaattcccctcttcccttctcctgggatttgtgtcttaattgtggccagcccataatccacactgacttcgttctaggggtgacaaggaacagaggctcaggtgtcagggagggttcccaggtcatctccaagagctttcagacacttcctcctgccagtggccccagctcagaaaaccagaaagtgtgtttttttttagccccgttttcctgggatgctgaagagttcaaytttcccctatctcccccactctcaaaatccttttatcaatttattgaataaatttgagcaaagcgatcacttcaagggatatgaaatcctcatttgaccaaaacagaagactctctggatggctgggcactgtgacttatgcctgtaatcccagcattttgggaggccgaggcgggcagatcacttgaactcaggagttcgagacagactggctgacatggtcaaactccatctctactaaaaatacaaaaattagctgggtgtggtggtgcacacttataatcccagctactcgggagg

SEQ ID NO: 63703 - DNA, 601 bp, Human
aggggccagtcacaggggctgttcaggctccaggttccccaggtcttgggctgccggggaatcagcctcatgttaacatggctgtctggagatgggggcaagaatggaggacatggcgtgcaagttgctcccaactttcaattcaaacggacagagcaggcttctgcctgccccccacatcacaatgagaggccctgtggggacttactggacagattctggggctcctgtcaaggacacactgcgctcgggtaggccaccgctgtctggaaagaggagatagagtcagtgccctccctgscccacaggcagagaaaggcctgccttggacacgaggaaactttcagaacaaccaagggccacttctgtcccattcagtgcctgacagatcagtttacttcccctaaacacctgggaggctgctcgatgcaaggccaaggttgggaagagatcccagaagggaggtaggactttaagggaaaaggatgaggtggagggagttgcagattccagaaggtccaggagccggccacccccactaccaatgatgaccagagccgcttctatagacaacacgtgctacacgcccaaggaagcctca

SEQ ID NO: 63704 - DNA, 601 bp, Human
gaccccagagtgtgcaaggatgacagggaagaggggccagtcacaggggctgttcaggctccaggttccccaggtcttgggctgccggggaatcagcctcatgttaacatggctgtctggagatgggggcaagaatggaggacatggcgtgcaagttgctcccaactttcaattcaaacggacagagcaggcttctgcctgccccccacatcacaatgagaggccctgtggggacttactggacagattctggggctcctgtcaaggacacactgcgctcgggtaggccaccgctgtctgraaagaggagatagagtcagtgccctccctggcccacaggcagagaaaggcctgccttggacacgaggaaactttcagaacaaccaagggccacttctgtcccattcagtgcctgacagatcagtttacttcccctaaacacctgggaggctgctcgatgcaaggccaaggttgggaagagatcccagaagggaggtaggactttaagggaaaaggatgaggtggagggagttgcagattccagaaggtccaggagccggccacccccactaccaatgatgaccagagccgcttctataga

SEQ ID NO: 63705 - DNA, 601 bp, Human
cccctggatgtggaaagccctcatgtgtctgtcccagagaagagaagggactggccatgttctgacggctggactaagagccgtgaggtgctatggaggccacctggctgaccacggtgcccagctccctcagagcctgcctcccaaagagggtgggggtgcactggccaggggcagggtgggccaggccctgaccttgcttgaactgtatccgcacgccagcatcattctggatcttcttgatcatctctccactccggccaatgaccacgccaacagaatgcctgggcactggcacctrgggagggaggcagcagcgtcagctcggcccgcagctctgctgccctctgctgcccactggccacaaggagccactcaccccggcccctccctccactggcgggggagaggggggtgaaggcagggcccacactcacatcgatgcctccgccaatccgagatccgtactcattccggtccccaaagccgccttggtcacgttcccggaggatgtccatcaccatctcacaggcttgctgcaaacacacaggaagcagcccccatgggtgagccctgctgccccacacccccccacctcctc

SEQ ID NO: 63706 - DNA, 601 bp, Human
tctgggggccccattatatgagcaatcttctcgggccctgtcccgtcatctgaggccagcaccgagagagcagagacacaagtttaaaagaagagcccaccccagagccctgcaacgccgcctccagcgcagacaccacgccggcctgagatctcagacgcgctgcgccgctcccagcctccactcgctcagggattgagggggaggcggcccacattcccagagaaggaaacccacggccaagccaggaggtggctcaagcttcttccagcacacagcacccccagcactgagagatttwacagaacaataaatctctgaaaagccagaggggcccttctccccacggcaggcagctcagagactgcctgaggactggcaagagcccagagctgaggtggagtgccctgatccagcctgcggggcacccagggctgtcctgtcaggataggctccatcgtagggggaggaagaggagatctgatagggataggaacacacgttccccctggatgtggaaagccctcatgtgtctgtcccagagaagagaagggactggccatgttctgacggctggactaagagccgtgaggtgctatgg

SEQ ID NO: 63707 - DNA, 601 bp, Human
gtcatgaggagcaggcggctgccactgggggtaggtattgccccagccctggggtgggtactggtgaggagggggccccccggcactgcaggagagaagaaagggatgcttgagcagtggtgcgggggtggccgcagccggaccacctggggtggggatgtttttcagtggggaggcgccagagacccagaccaccaggctcaacggggcgcctgggaaaggcctagacaagaagcaactcgaaggacgcgcagcgtcagcttgaggacatgaaagaagccgcgaaacttgcacgtgcacrgagggatgctgaaaggcacatgctctaccagtagacaggagagggcctgttgatggtatccacaaaaatgggctggatgaggccccccgcctgcacttctagggaaagggaaatggggtctgctattcttcttgccagctcagtaagcccccggcctcaaaacccaggaggcagaggatactcactgtgggggagccccgggtggcccctggttgaagggcccaggattgaagggccccattgggccagcagggcctgggccacctgggcctggtccaactgggcagagaggaccctaga

SEQ ID NO: 63708 - DNA, 601 bp, Human
aaccactcccccggcagggctggagcccccccgccaccctgcagactcaccgatctttttgtaatactcttcccaggccttagtgtagtccgactggccggtgggtgggggctgagggggctcaccctgagccggtggggccgcaggggccggtgcggggccggggacggggcccgggggctgctggtagtagtgtgagtagtaggcggcccacgcggcgttggggtccgcggccgctgcagctgctttgcctgcaggagatacctcgggtgagacggggggacagaacagggcctgcccyccgccaggtggcccatcacttacttgggtcatgaggagcaggcggctgccactgggggtaggtattgccccagccctggggtgggtactggtgaggagggggccccccggcactgcaggagagaagaaagggatgcttgagcagtggtgcgggggtggccgcagccggaccacctggggtggggatgtttttcagtggggaggcgccagagacccagaccaccaggctcaacggggcgcctgggaaaggcctagacaagaagcaactcgaaggacgcgcagcgtcagcttgaggacatga

SEQ ID NO: 63709 - DNA, 601 bp, Human
aggaattggtcactacggggagggaagggtgggagactagggggcggaagagaggaggggctggaacaccgtggggggggccaggaagccccctcccaaacctgcgctggctcaggctggaaggacgtgcttgttaactgtctagccaggtgctcgcgggactcgctgaagtcacgctgctccctgatggagaaggagggacagagcaggaagagaggagaggggccgcggagggcggaggcgctagggtcgtaggggagctgccctgtctccggagggcggtggctcccggcgcagcacracgacatgaacaatccagagatcatggtgtccccacaacacccctgtgaggtaggttggaaggtggcaacgatcttcacgcccacttcacagacaagcccgggacacaggcaagcgcgagcgcatgggaggctgagcccggcggggcaggggcctgggccgctccccgcgtccccaccagtccctgccagagccgggccgcctgcaacacagtcacttggacacaggaaaaaagatcatgggtttaaaaaataaaagaataaaaagaacaaaaaccaaaaaagtgatgcagagaagggga

SEQ ID NO: 63710 - DNA, 601 bp, Human
gaagagggggcttggctgctgggggaaggggtcctgcaatacaacacctggtccaaggaatgttccacctctaactaaaaaaaagaaatagcaagagtgacttttttttttcctttttaaaagtttattttaaaaacaagagggccgagggtgggagaaaatgaattgctttatcctcagagaggcaggttcaggaaggctggggggtgaagaatagagactttttaatatatatatatataattttataagttctgctttgctctttgtgtttttaatttttaagtttttttttttttttggcagagatttagatctcgctatcttctctggctggctcaacatggaaggatcccaattttgaaagaaaaagcatgtgagacacagaacaggcgagagagtgagggcccggcatgcccccaagtcccccccaccctgcttgccgcgagggctccccagtactccccacggcagccatcgctctctcgccaaacaaaacagaagcccccaaacagaacaaaatggaaaaaaaaaagatttttcacagatgaagaagttcacattcattcgattcattgagcctgcggagagggaagagata

SEQ ID NO: 63711 - DNA, 601 bp, Human
tggcagacctaggaacagaaggcggccttcccagtgcccgtggacccctgcctgcccccaggcgcttcagagactgacccctggcatcccatttcatgccccttgcaggctagactttgcagggaagcacttttttaaaaacttgaggtctttttttaacagctggccaggagatctggctactgttatttttacatgtgattacatgaaactcccagtgaccgacgcctgtgaattaatccagttagcacagtaacgtggcggggcgccggcagactcaacagtcaagtggagactgtgrgaggagagcagtgcattcacaggcagctacctggaggctcaggactcggtgtggggtcacgtacaggcacattttgcacctgtttttcaaaacagccatgctgaggaagtccctctgccaaaggcagatgggacaaggacccttgcatgtgccctgccctgtgcagcatccccggcagcctcactagcagccggctcactagcagcgcgccgctggaatgcagccaccctgctaactggggcgaacactgtggtatgtgggggccagaacatgaaggacagacaggctgaaccaagtgcg

SEQ ID NO: 63712 - DNA, 601 bp, Human
aaacattgcaagacacccatcagtgacagccgttcctcgggccctagtgactcctcagagtgcagtggttcaggtcctccctcaaggatcactcccgtgagacatgtggcggtcagccttgggtaacaggcccttccggcagaactctgggcaacaggtccttccggcagagcttgcttgggagacactcttcttctgcctgaccagcaagaccacccttgggaatctagatctggtttgtcaggtactgttatttagagcctactgagcaaatccagagagccttacaataggcccacgyggaaactgcttggaacaggtgacagcgtgtggactccacagcatgctgggaaggctgccctcccgctcccaaggggcctagcatgcagcgcttccctgcctcaggacccactgacctcaagtgcacacacctcatcggcagcttcggaaggacttctccatgcagcagtgtcaggggatgctgcgggcactgcccccgtgcagtctgctgggaggctgaccccgttggtgccactgctggggactgtgggagggaaggagagtggggaatcacaggtgcttggcggccctcccaccccca

SEQ ID NO: 63713 - DNA, 601 bp, Human
agccattttcaccctttgagccagaacatctactggggatggagggtataaaactgcaggccatggacacagagcggaaaataaacacaaagatccaatctggcttttacacagaagataccacatggtgttaccctaattctgacttcaaacccatctctgccaacttcaaaggaggctcttcatcaaaggcccttatttcacagtggctgtgaaacacaaagcttttggcccatataatccaaaccatacccccgcttaaatggaactatttctttttttaaggcagggtctggctctrtcgtccaggctggaatgcagtggtgtgacctcggctcacagcagcctccccttcccgggctcaagcaatcctccagcctcagcatcctgagtagctgggactacaggtacatgctaccatgcctggctaatctgtgtattttttgtagagacagagtcttgctatgttgcccagggtggttttgaactcctggcctcaagcaatccacctgccgcggcctcccaaagtgctgagattgcaggtgtgagctaccgtgtccggcctaaacaaactatttctgagatgactcccaaagaaaaa

SEQ ID NO: 63714 - DNA, 601 bp, Human
cctcccctgttaaaaggaaaatctacctacttgcctgctgttgaacctggggaaggcataaaaagtcaatgtgctggttcaacagctcacataccttaactctgtccctcaagttctgcccaaatacaaaggcttgctgtgtggcggggtcttttttctcacaggcttcctcttcagaggcattgctggactcatttttctggggctctttctcctatcaaaaaccaaaacaaaacagagtaatcaaaaccagtgccacacttggcccagacggatgcccagcaatcccacaccagatcaygtactccacacgtctcctctgcatgtgcctgcactcccagctactcagaaggctgagacaggaggactgcttgagcctgggagttgtagtgagctgagatcacaccactgcactccagcctgggtgacagagcaaaaacctgtctccaaacaacaagaaacacctgtgccctgcagaagccttagtgccggcagaggacaggaaataacctggttgctcatcattggccaaggaatgaaataatttacaatagaaaatatgggggaaaaaaagtacagcacagctattaccaccgagagg

SEQ ID NO: 63715 - DNA, 601 bp, Human
taagaatggtccagccgtaatgctgctagtgctgaaacagagaaaccctgaaatacgggaacagaaacctctgggcagagctgagaacactggaccgtgctgtctttcttctctgctatgaaagcctgaggcctcaggttcagtcaccttccctgtccccgctaccatgagaaccagggaccctgacttgagaagtcactgcaggtgagggctccgaagcctgggctgctggtggggaagtgccagggcccagcacacgcacaccagcagcagactgtgccgtgagccatggggctgcctsgctaacaccttctttgtcccacgctcccctcccctgttaaaaggaaaatctacctacttgcctgctgttgaacctggggaaggcataaaaagtcaatgtgctggttcaacagctcacataccttaactctgtccctcaagttctgcccaaatacaaaggcttgctgtgtggcggggtcttttttctcacaggcttcctcttcagaggcattgctggactcatttttctggggctctttctcctatcaaaaaccaaaacaaaacagagtaatcaaaaccagtgccacacttggcccagacg

SEQ ID NO: 63716 - DNA, 601 bp, Human
gagggggtttggggggcggctctcatgggagaccgactctgtgccttgactctcacaagggtagggtcaggatctcccccgcttcattccctttggaattgcatagtccccagccctccccatggggacccggccacagcccccgccgtcggcagctcacctagtcgggactgtagtgtgccgtcatcggtggacgccatgtcattgagtctgagcagcccccggcctctctccacccaggactgtgaggtcttgtcaaagacaaacagcttgcactgcatctggaacacagtggccgccrgtaagcagggaccccagctggtgtcctgctgcagccacaccctgagagtcgccctttagcctgtggggactgccagggccagccaacgacggcctgggggccaccttggtcagttttttgtcctgccctcaagctagaacaggctttacattgtataaggggtatctgaaattaaaagaatcactaaggaaatgaaaagcaaaacaacggtgagaagcctctctgcgcactctaggacggctatacccatgtggggaagctggaaccctcacacactgctggcgggaaggccgcatggtg

SEQ ID NO: 63717 - DNA, 601 bp, Human; identical to SEQ ID NO: 63711

SEQ ID NO: 63718 - DNA, 601 bp, Human; identical to SEQ ID NO: 63712

SEQ ID NO: 63719 - DNA, 601 bp, Human; identical to SEQ ID NO: 63713

SEQ ID NO: 63720 - DNA, 601 bp, Human; identical to SEQ ID NO: 63714

SEQ ID NO: 63721 - DNA, 601 bp, Human; identical to SEQ ID NO: 63715

SEQ ID NO: 63722 - DNA, 601 bp, Human; identical to SEQ ID NO: 63716

SEQ ID NO: 63723 - DNA, 601 bp, Human; identical to SEQ ID NO: 63711

SEQ ID NO: 63724 - DNA, 601 bp, Human; identical to SEQ ID NO: 63712

SEQ ID NO: 63725 - DNA, 601 bp, Human; identical to SEQ ID NO: 63713

SEQ ID NO: 63726 - DNA, 601 bp, Human; identical to SEQ ID NO: 63714

SEQ ID NO: 63727 - DNA, 601 bp, Human; identical to SEQ ID NO: 63715

SEQ ID NO: 63728 - DNA, 601 bp, Human; identical to SEQ ID NO: 63716

SEQ ID NO: 63729 - DNA, 601 bp, Human; identical to SEQ ID NO: 63711

SEQ ID NO: 63730 - DNA, 601 bp, Human; identical to SEQ ID NO: 63712

SEQ ID NO: 63731 - DNA, 601 bp, Human; identical to SEQ ID NO: 63713

SEQ ID NO: 63732 - DNA, 601 bp, Human; identical to SEQ ID NO: 63714

SEQ ID NO: 63733 - DNA, 601 bp, Human; identical to SEQ ID NO: 63715

SEQ ID NO: 63734 - DNA, 601 bp, Human; identical to SEQ ID NO: 63716

SEQ ID NO: 63735 - DNA, 601 bp, Human
aagaggcgcctgctggggcatacagccccagtgctctgcacagcgtcttgggggtttgggtgtgctacccaccacccccagtcaccacctcctgtcccagccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggaygggcaggtgggtggctgcgcggggggccccctccccaggcagttcctcggccgtgccccctcacggccctctgttcccaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggt

SEQ ID NO: 63736 - DNA, 601 bp, Human
atgaggccgaccactcagtcaagcaagatgtatgtactaaacgcctccttagcatttggtcctggtcaggaaaccacagtaaaaaactgatcatcccaggccacttactacttatttgcttcatcctaataataataataataacaacagttacttttttctgagcacctattagatgccagcccctgtgctaaatagcttatagaaattatttctaatatagcaaccacacgagctattattatcgatttcacagatgtcaaaccttgccccagagccactaagctaataaacggtggcrccacaatttaactccttctctgctgtgccccaaagccctggtctgcaacacccagcactatgacctgcaacttttcctttcctctttcccctgccccattcatccagattcatccaatttgggctctactgactcagagatggcaatatgaacttaaggtacctatgagcaattcttaatttaaaaaaaatttttttggccgggtgcggtggttcacgcctgtaatcccagcactttgggaggctgaggtgggcggatcatgaggtcaggagatcgagaccatcctggctaacacggtga

SEQ ID NO: 63737 - DNA, 601 bp, Human
agggataagaaagtacaagacccgtttaaagtatggcaagctcatttggagtagtgaaagggaggcaacgaaaagggagatggggctggactgaaggaagccttgaatgtgtggttacaacaaaggggaggggacagtttgtccgtttggctaacaaaagtagtaagaaagtgcccttccgttcctcctgacatagctcaaagagacatgacaaggcggttgggagaagaggaagagatcagtaagaatccagagacgacagagcccaaggtctgtgcaaagagccgcagggagacaatayaggaagtgattaggcaggaggctttggcggcgaccggaaggctggagaattattgcctctgtaacaggagaggagggctacttccagtaagaaggaccaagactccagaggccactggcactagaataagaagagaagtaggctcatgcaggcccacgtaaatcggaggaaggtggaagtttcctgaccggaagtctaggtgggaggcgccatgttgcggcccagccgctgctactgactccaccatccggcagttcgtgaaattaaataactgcaaattgatgagtcttttcttttgca

SEQ ID NO: 63738 - DNA, 601 bp, Human
aagagtaggattttcttcagtagaaatgacattccagagaagggataagaaagtacaagacccgtttaaagtatggcaagctcatttggagtagtgaaagggaggcaacgaaaagggagatggggctggactgaaggaagccttgaatgtgtggttacaacaaaggggaggggacagtttgtccgtttggctaacaaaagtagtaagaaagtgcccttccgttcctcctgacatagctcaaagagacatgacaaggcggttgggagaagaggaagagatcagtaagaatccagagacgacrgagcccaaggtctgtgcaaagagccgcagggagacaatacaggaagtgattaggcaggaggctttggcggcgaccggaaggctggagaattattgcctctgtaacaggagaggagggctacttccagtaagaaggaccaagactccagaggccactggcactagaataagaagagaagtaggctcatgcaggcccacgtaaatcggaggaaggtggaagtttcctgaccggaagtctaggtgggaggcgccatgttgcggcccagccgctgctactgactccaccatccggcagttcgtg

SEQ ID NO: 63739 - DNA, 601 bp, Human
acttccttggaatactaaaacatcctgtgggcttcctttgctcaaataaaataaaggcactgctcaaataaaataatggcacttgcgccaatctgcagaaatatttattgaataggttcctcgaatttaaaacattttccctaccaatatttcttaaacccttggtagatatttcctcttatttgctaatgaagagtagccaacaacaaaacaaaaactaatgtgataccctgcaggtttcacattattgggaagccctgtaccagtctgtctcacccaatcaacagcagttttaaagaaygtatgctcatagttgacactgcgcacactctcgtttttgttttttgttttgttttgttttgttttgttttgttttgagatggagtcttgctctgtctcccaggctggagtgcagtggcgcgatctcggctcactgcaagctccgccccccgggttcatgccattctcctgcctcagcctcccgagtagctgggactacaggcgcccaccaccatgcccgactaattttttatatttttagtagagacggggtttcaccgtgttagccaggatggtctcgatctcctgacctcgtgatccg

SEQ ID NO: 63740 - DNA, 601 bp, Human
tgtattattaaattactttcacttgtctctttttactttttaaaatgcagctactaggccaggtgcagtggctcatgcctgtaatcctagccctttgggaggctgaggcgggtggatcacgaggtcaggagattgagaccatcctggctaacatggtgaaaccccgtctctactaaaaatacaaaaaattagccaggcatggtcccagttactcgggaggctgaggcaggagaatggtgtgaacccaggaggcagagcttgcagtgagccgagatcgcgccaccgcactccagcctgggcracagagcaagactccatctcaaataaataaataaataaaaacaaataaataaaatgcggctactagaaaattgcaaatttcacacgtggcttgtgttatgtttctttattggccggtaatgatctagaagacacttagaataaatcatctcaggataagtttaagaattcacaaatattttaagagattctattttactagaaagtaagcaaaatgatttttagatgtagatgtgatctctatctagtaagaactcatgtaattttgacaaataattactctatttggtgtcccacaaat

SEQ ID NO: 63741 - DNA, 601 bp, Human
tttttttaaaggcacagttctcataggtataagaaggcaacgaaattcatcctgcaagatggatgtagccaaagactcttctttaattacaacaaactggagaagataacaaagtaaatattattcctctctctcttagagaaagcaaaaatatgttaaacaccattgaagagcctaaggggttttataaacctcaaaatcagcatcacattcatatacacatgagtactagtcacatatagccaagtaatgtgcgttagaccagggggtggcaagctttttttgtaaaatgtggaatagyaaatattttaggttttgcaggtcaagcgctcgctgtcaagatgactcaaccccatccattgtagggtgaaatgactgtggctgtgtgccaataaaactttatttatggttccagttttagtatatttgctgctgaagcaagcacaatttatggacactgaaatgtgaatttcagataattttgtatgtcctaaaatattcttcttttgatttttccaactacttaaaaatgtaggaaaaaagcattcttagttcatgggctgtacaaaaacaggcagtgagttggatttagcccatgggc

SEQ ID NO: 63742 - DNA, 601 bp, Human
ccagcatttttttttaaaggcacagttctcataggtataagaaggcaacgaaattcatcctgcaagatggatgtagccaaagactcttctttaattacaacaaactggagaagataacaaagtaaatattattcctctctctcttagagaaagcaaaaatatgttaaacaccattgaagagcctaaggggttttataaacctcaaaatcagcatcacattcatatacacatgagtactagtcacatatagccaagtaatgtgcgttagaccagggggtggcaagctttttttgtaaaatgyggaatagtaaatattttaggttttgcaggtcaagcgctcgctgtcaagatgactcaaccccatccattgtagggtgaaatgactgtggctgtgtgccaataaaactttatttatggttccagttttagtatatttgctgctgaagcaagcacaatttatggacactgaaatgtgaatttcagataattttgtatgtcctaaaatattcttcttttgatttttccaactacttaaaaatgtaggaaaaaagcattcttagttcatgggctgtacaaaaacaggcagtgagttggatttagc

SEQ ID NO: 63743 - DNA, 601 bp, Human
ccccgctaattctgtatttttagtagagatggggtttctccctgttggtcagactggtctcgaactctcgacctcaggtgatccacccgcctcagcctcccaaagtgctgggattccaggcttgagtcaccatgccagcccagcatttttttttaaaggcacagttctcataggtataagaaggcaacgaaattcatcctgcaagatggatgtagccaaagactcttctttaattacaacaaactggagaagataacaaagtaaatattattcctctctctcttagagaaagcaaaaatakgttaaacaccattgaagagcctaaggggttttataaacctcaaaatcagcatcacattcatatacacatgagtactagtcacatatagccaagtaatgtgcgttagaccagggggtggcaagctttttttgtaaaatgtggaatagtaaatattttaggttttgcaggtcaagcgctcgctgtcaagatgactcaaccccatccattgtagggtgaaatgactgtggctgtgtgccaataaaactttatttatggttccagttttagtatatttgctgctgaagcaagcacaatttatgg

SEQ ID NO: 63744 - DNA, 601 bp, Human
ttttttttttttttgagacggagtttcacttttgttgcccaggctggacagcagtggcgtgatctcggctcactgcaacctccgcctcccgcgattctcctgcctcagcctcctgagtggctagtattacaggcatgtgccaccatgccccgctaattctgtatttttagtagagatggggtttctccctgttggtcagactggtctcgaactctcgacctcaggtgatccacccgcctcagcctcccaaagtgctgggattccaggcttgagtcaccatgccagcccagcatttttttttaaaggcacagttctcataggtataagaaggcaacgaaattcatcctgcaagatggatgtagccaaagactcttctttaattacaacaaactggagaagataacaaagtaaatattattcctctctctcttagagaaagcaaaaatatgttaaacaccattgaagagcctaaggggttttataaacctcaaaatcagcatcacattcatatacacatgagtactagtcacatatagccaagtaatgtgcgttagaccagggggtggcaagctttttttgtaaaatgtggaatagtaaatat

SEQ ID NO: 63745 - DNA, 601 bp, Human
caaaaaatattctcaactcgtggaaactaaaaacaaaaataaaaacccacagtagtgtgctagatgtagtctgctgacccgtttttttttttttaatttttattcatttatttatttattctgaggccgggtcttgctctgtcatccaggctggagtgcagtggtgcaaacatggctcactgcagcctccacttccagagctcaagtgatcctcctgctcagcttccccagaagctgagaccacaggtatgtgccaccatgcccgggtaattttttaattttttgtacagatggggtctcmccatcttgcccaggctgtgacccctatcttggatggcctttgggggaacatgtcttactcataattataggcagcggaaaatgcctgctagcgagtaggcactcaaacgtgtctgaataatttagtcccattttctccattcttaaattactgtttaggttgctttacattctcttcccagccccagatctccaaatacaggagatgagcacacgtgtccagggcaccccagacctcttgggcagggagaattctcggcagagaagaccggatatgggagtgtggtgtgggaatcgtctg

SEQ ID NO: 63746 - DNA, 601 bp, Human
tcttgtttccaatcatttaaaaacgcaaaaaatattctcaactcgtggaaactaaaaacaaaaataaaaacccacagtagtgtgctagatgtagtctgctgacccgtttttttttttttaatttttattcatttatttatttattctgaggccgggtcttgctctgtcatccaggctggagtgcagtggtgcaaacatggctcactgcagcctccacttccagagctcaagtgatcctcctgctcagcttccccagaagctgagaccacaggtatgtgccaccatgcccgggtaatttttwaattttttgtacagatggggtctcaccatcttgcccaggctgtgacccctatcttggatggcctttgggggaacatgtcttactcataattataggcagcggaaaatgcctgctagcgagtaggcactcaaacgtgtctgaataatttagtcccattttctccattcttaaattactgtttaggttgctttacattctcttcccagccccagatctccaaatacaggagatgagcacacgtgtccagggcaccccagacctcttgggcagggagaattctcggcagagaagaccggatat

SEQ ID NO: 63747 - DNA, 601 bp, Human
ggaggcggagcttgcagtgagctgagatcatgccactgcactccagcactctagcctaggcgacagagtgagactccgtctcaaaaacaaaacaaaataaaacaaaaacaaaaacaaaaattatctgggtgtggtggtgcacacctgtaatcccagctactagggaggctactagggaggctgaggcaggagaatcatttgaaccaaggaggcagaggttgcagtgagctgagatcgttccattgcattccagcctgggcaacagagtaagaccctgtctcaaaaaaaaaaaaaaaaaaaatggtagacaggggaaatggaccagatgttgaatctagtttggttatagtcattgctggggattaatatagtaagaggagggtccttctctcctgaattgatgtctatcaggggttggaaagttttctttttttctttgagacagagcctttctctgtcacacaggctggagtgcagtggcgcgatcacagctcacttcatcctctaactcctgggctcaagccatcctcccaccacagcctcccgtgtagctaggaccacaggcgtgcaccaccactctcagctagtttttgtatttttt

SEQ ID NO: 63748 - DNA, 601 bp, Human
gtagctgggaccacaggcacatgcctggttaatgtgtgtgtgtgtgtgtgtgtgtgtgtgtgtgtgtgtatgtgagagagagacagagagagagagagagagaaggtgaggtcttgctttgttgcccaggctggtttcgaactttcagcttcaagcaatcctcccactttggcctcccaaaatgctgggattaaaacgtgagccacgacacccagcctgaggattctaaggtgagcaggtcagatgaaagtgctgctctcagggtgccagtatccttgtcaggcaagaatacacaaggttscagatacacaaggttgttcagtagagatccgggctgtggtgcaaggtgattgcagagggatagagccaggggtggtggtggagagggctcccctcttgatagccagttatgggtggcactaaggatggcactgagctgggacctgacagctgcaaagaaggggccaaccttgggaggatgtgggagagagcagcctgggcaagaggaatagctgtgcaaaggtcttgcagcagcagaggccctggacaaggtcagatgtctggagttttaaaattccaattgctgtcggggctcagtggc

SEQ ID NO: 63749 - DNA, 601 bp, Human
gccgggcgcggtggctcacacctgtaatcccagcactttgggaggctgaggcgggtggatcacctgaggtcaggagtttgagaccagcctgaccaacatggagaaaccctgtctctattaaaatacaaaattagccgggcgtggtggcacatgcctgtaatcccagctacttgggaggctgaggcaggagaatcgcttgaacccgggaggcggaggttgcagtgagccaagatcgcgccattgcactccagcctgggcaacaagagcaaaattccatctcaaaaaaaaaaaaaaaaaaaaaggaacgaggcactggcacatgctgtaaacggatggacagtggaccctgaaaacattatgttacgtggaagaagccagtcacaaaaggccacatagtgtgtgattctgtttatatgaaaggttcaaaacaggcaaatccacagagacagaaagtggattcacagttgcccggggctgggaggaggaagggcaagtggctgttcatggcaggttcagggtttcttcttcttttcggagtgatgaaaatgttctgtgaagatagtatactaagacccactgaaccatacacttcaaatgggtg

SEQ ID NO: 63750 - DNA, 601 bp, Human
taaaagcagttatgctgtttgctatttgtgatttcaaaaactcttcgctatttgtgatgttgctaagccctttagggagtgcctcctgctatgagctatattcattccagggcatatttgtggggtttgtcattttaaccaagtacttaatacttgtttctctcccagcatcttgccaaatgtggcagctctccttctagatgaacactactgcattactgttatagaaatgatattttaacatcaactcccttttcccttttcttccctagaaatccagtccttccatgagacctcggtrcacacagaactcctcctaccacgtgcaaccttattctcggctgagcaactcataaatcgcataacaaaaacagtgattgatgcggactgtgtttagtgccatccttgccggtgagagggagtgagccagcaagcttccttaaatctctttagttctccaaaaggagaggccatttgccttctcatctatgccgcaagtttctggggcttgcatcattaacctggtggctttgccaattccttcgccagtgctgggtcaaagacaggcaagggcaccagggttagccatgagtgtgtgcca

SEQ ID NO: 63751 - DNA, 601 bp, Human
ttcatcaactggaataccattaactaccttacggtgcatcctagctctaaaacaggaggctaggcgagggtgcctgggtccggtgcctgggtccagttcctgggtcctccagtttctagctgggtgacctcagccagggacttaaatctttctgcacttccatttctttgtccataaacggagaaaatacttctatctgtgttgggtggttgtgttaaatgagaggagtcctacaaagtgtggagtttaatggccagcccagcacacggaaaatgcccataaatgttcattagcgtcatcrttgtaattcacaccattataacgtaacccacataatttactgattttttgcagatttaaatatctgaaactaaaagcagttatgctgtttgctatttgtgatttcaaaaactcttcgctatttgtgatgttgctaagccctttagggagtgcctcctgctatgagctatattcattccagggcatatttgtggggtttgtcattttaaccaagtacttaatacttgtttctctcccagcatcttgccaaatgtggcagctctccttctagatgaacactactgcattactgttatagaaa

SEQ ID NO: 63752 - DNA, 601 bp, Human
catctcctcaccccacacagtgccctgggtacaggggctggggcttgaagggtgcccataacacactccctcagagcctggacactcagccatcgttcattcattcaacaaacacagtctgagcatctgccatgtgccggcttcaagtgctgaggacacagcagggaatgaaacagattgagtccctgaccatgtggggctgacccctcagggagagacagacgacaccatggacacagaacagcaggaggtgacaaatgctctgaagaaaaatacactcaaatgcacaagtggagtgcgrcatgggccaggggcaacaaggtgacctggggcagtgacaggacagaggcagagtgaggtgaggaaagtgtcgccgctgagaaggctctgccagggatggtgctcggcaaggctgaggcacacgggacatgtggggtcacacgggtcacgtgaggaggccaccagagggagctgggggaatgctgggggttgaatgttgtgtccccttaaattcctatgctgaactcctcaccccaaggcagtagctttaggaggtggggcctttgggaggtgattaggtcatgagggtgggatcatgccc

SEQ ID NO: 63753 - DNA, 601 bp, Human
tcaagacgtgttttgcaatgaacaagagaatgagcagcccgcctgctccgggctgctcacctgttctagccaccttcaccatgttggcctccagctcccgtcttcagctgagcacaggggcctgtcccaggattcttggaagcggcttcctaaggcatcatgcttttgtgttctccttctcttaccagcctttctttccctctcacgtttctctccctttctgaccatgagcagggctgcagtgcagctgctgatggtcaagatgaagatggggaatgtgccagtgaaaacctggcatgcrgaggcctcacctcactcaccctctcctgtcccagcttcaaaatctttcagagcgactcatgctgccagagggtggaggagtggaccttgaaatgacaagtgacagttcctcagcagtagcatctcctgctttctcagcctggtgacctgacccggcagcacgcccactgggcacctgtgcccacctggggatggggtctcgtcctgcctgtgtgacccttcctcctgacagccatctctagagacagccagtgagggcagggcaacaggcagtgcatgttctttccacatctccatgact

SEQ ID NO: 63754 - DNA, 601 bp, Human
gaggccagaggattattgaggtcaggaatttgaggttgaagtaagctgactgcactactgcactccagcctgggagacagaggaagaccctgtctctaaaaagaataaacaagtaacaaaacaaaacaatgaaaaacaaccaaaaaaccaaactagccgaaagaaagagggacacaaccccaaggacaacagcagcggcagtagctggtggccagaccgagccccagactgcgggcaaagctggtatacgtgggggctgactgactctgaggaagccgtgaccacatcacctctgctctatacacaacacacacgcaactgaggctcagaaagggcgagccatgagctgaaggtcacaaagcaggaagaggcaggctagactggaactggctttggcttgggtttggctaagtcactcctttaggaggaggaagcacatgtttttatgactagagcctccggagccacagcttcccgacctacgtggagcttccgtctcttttctgtatataaatcgcttccccaaccccatgccaaagagaactccaaataacaacacaagcttagcttttgctttagaagtttctagaatttagttgat

SEQ ID NO: 63755 - DNA, 601 bp, Human
acaaacacacacacaagacaccagcgatgagcaggagtggctcatgatcctggcggtgcttccaggtaagcgcagtagctcacatggtcctcccagaaggggtgatgctggatcctgagtaactcctccacctggcagaggagagcgcagcagagagtgggcagagggcagggccccgagggcgtgggtgtactcaaggtaaagtccacagggcacagggacgcacactgtggagcacctttgcagcacccagtttgggaacccctcaatccagtgcaagacagtagatgtgagtgagtggaggccatgcttcttctctgaacctgaatctgctgtgggaacttggacccattcagtgactgccctgccgtccttgctttctcgcgttcctttgtcctctcttctgtttttcttcctgtggcgaggacctgggcagtcttactttgactgccttcccctgtgtcctcttagactgggttacaggagcctcggaacagccaatataaaggggaggggccgcaacacgacctgtcacccagcctggccctgcctggccaacgggcttggctggcccaaagctccctccctcgtgcctcagaaa

SEQ ID NO: 63756 - DNA, 601 bp, Human
taacaacttgtataagcatgttcatagcagctttttgtttgttggtttttgttttttgtttttgagacagggtctccctcaggataaagtacagtggcacaatcacagctcactgcatcctcaacctcccaggctcaagcgattctcccacttcagcctcctaagtagctgggactacaggcacgcagcaccatacccggctaatttttgtattttgggtagagacagggtttcaccatgttgcccaggctggtctcaaactcctgggctcaaatgatctgcccacctcagccttattcayagcagtttgattcagtcaccaaaaagtaaaaataacccaaatgttcctcatcaggagagtggacgagaaattgcagattatgatgatttaaagattcatattgaaaaccctaaaacaaccactaaaaatggaaaagaagagcatagctaaaaagctaatagaggaatactactggaatactcttcatgaatagaaaggaattaattactgaaattcacaatgcatggatgaatctcaaaatcattacgctgagtgaaagaagttgagtccaaaagagtagatgagtagagtggattaaaa

SEQ ID NO: 63757 - DNA, 601 bp, Human
acttagattatcaattgatttttttttctaatggagcctcagctcttttcttcctcaactggattttcacaaaggtgtcaaggcaattcaacagagaaagaagtcttttaaacaaatggtgatggatcaacagaatatccatattggggaaaataaatgaaccttgacccctacctcacaccatacataaaaatgatttcaagttagaacatgaacttacttacacacaaaagctaaaactataagacttctcagagagaacataggaggttagacaaaggtttcttagaatgcacaaatmagcataaaagaaaaacttgagaaattagatttcaccaaaatttaaaacctctgctcattaaaagattttgctaagaatatgaataggtaagccacagcctgggagaaatatttgcaaaacatgtatctcataaagggctttgatcctaatatatctacatctatatctatatatataaactcctacaattcaatataagatgacaaataacttaaaaaaatggtacttcacaaagcaagatatacagatgcccaaaagtacatgaatagtggtcagcctcattagtcactagggaaatgc

SEQ ID NO: 63758 - DNA, 601 bp, Human
ttcttgaatgaaaaggcagaaatgatcagcctggataacaatcaagatcccattatatggtccctaaaagaaaccctccttaaaaataaaggcacacataggttgaaagtaatagaataaaaagagatccactgtgcaaactctgatcttttatttttatttatttatttttttgagatggagtctcgctctgttgcccaggctggagtgcagtgccacagtctcagctcactgcaagctccacctcccaggttcacgccattctcctgcctcagcctcccgagtagctgggactacaggygcccgccatcacaccaggctaatatttgtatttttagtagagacggggtttcaccttgttagccaggatggtctccatctcctgacctcttgatccacccacctcggcctcccaaagtgctgggattacaggtgtgagcgccacactcagcctgcaaactctgatcttaagaaagctggagcggctgtaataatcagacaaaatagactctgagatgagaaatattactagcaatactagagacattgacaagacaaggaatattactgcagataaaatttcatcataagatgatcaatt

SEQ ID NO: 63759 - DNA, 601 bp, Human; identical to SEQ ID NO: 19794

SEQ ID NO: 63760 - DNA, 601 bp, Human; identical to SEQ ID NO: 19795

SEQ ID NO: 63761 - DNA, 601 bp, Human; identical to SEQ ID NO: 19796

SEQ ID NO: 63762 - DNA, 601 bp, Human; identical to SEQ ID NO: 19797

SEQ ID NO: 63763 - DNA, 601 bp, Human; identical to SEQ ID NO: 19798

SEQ ID NO: 63764 - DNA, 601 bp, Human; identical to SEQ ID NO: 19799

SEQ ID NO: 63765 - DNA, 601 bp, Human; identical to SEQ ID NO: 19800

SEQ ID NO: 63766 - DNA, 601 bp, Human; identical to SEQ ID NO: 19801

SEQ ID NO: 63767 - DNA, 601 bp, Human; identical to SEQ ID NO: 19802

SEQ ID NO: 63768 - DNA, 601 bp, Human
catcggggcatggcagcgagaactcggcagaggctgcagggaaacttcccctgcttgattcagtccaggtgtctcatggatggattgatccacgcctctaaaagcttgatagtaacaacgataacaataataagagcaaaggaggctgcagcatccaccagtggagagatgcttgactcattcccttttcacaacagcccatgacgcatggcttgtcctcctctttataccaatggccaactgaagttcaaagaactctgcaggcctgcctatggttgcgtggcccgtctgaggctggccygactccatcgtggggccgcctgggcccagagcagacgacagcccctccgggcctccggctgcctcttactcaccatccctgctgccgctgcttcgagaatactcatggcctaccctgctggtcccaagagcctcctacataccgtggcgggcgatgagcgggaggtgtgggccagggagtgtctggtgctgtccatccccccgtggatgagataggctcccgcgctggagacgatggggctccccccgacatccatggtgatgcccaccatgctgtgggaggggaccgctggcggggacg

SEQ ID NO: 63769 - DNA, 601 bp, Human
cgcggtggctcacgcctgtaatcccagcactttgggaggccgaggtgagcagatcacttgaggtcaggcattcgagaccagcctggccaacatggtaaaaccctgtctgtactgaaaacacaaaaactagccgggtgtggtggtacacacctgtaattccagctactcgggaggctgaggcaggagaatcgcttgaacccgggaggtggaggttgcagtgagccaagatggtgccactgcactccagcctgagtcacagagcaagactccgtctcagaaaaaaaaaaaaaaaaaaaaaaaaacccaaaacaaaagtaaaactataaaacttttcaaagaaaacaggagaaaatcttcataatgtgcaaataggcaaagagttcttagacatgacattgaaagcatgagccacagaagaaaaattgataagttggatttcatcaaaattaaaattttttttttctctgcaaaggacactttttagagaatgaaaagacacactaaagactggggaaaatatttgcaagtcacatatctgacaggagacttgtatccagaatacataaagaattctcaaaactcaaccataagaaaacaacca

SEQ ID NO: 63770 - DNA, 601 bp, Human
atggccaactgatttttgacaaaggtgttaaagcaatccaatggagaaagggtagtctttttaacaaatgaggctagaacaacacattgtttcataagcaaaaaaaaatgaacctcaacttaaaccttacattatacaaatgttaacttgataggaagcagatctaaatgtaaaatgtaaaactatggtcaggcgcggtggctcacgcctgtaatcccagcactttgggaggccgaggtgagcagatcacttgaggtcaggcattcgagaccagcctggccaacatggtaaaaccctgtcwgtactgaaaacacaaaaactagccgggtgtggtggtacacacctgtaattccagctactcgggaggctgaggcaggagaatcgcttgaacccgggaggtggaggttgcagtgagccaagatggtgccactgcactccagcctgagtcacagagcaagactccgtctcagaaaaaaaaaaaaaaaaaaaaaaaaacccaaaacaaaagtaaaactataaaacttttcaaagaaaacaggagaaaatcttcataatgtgcaaataggcaaagagttcttagacatgacattgaaagcatgag

SEQ ID NO: 63771 - DNA, 601 bp, Human
acacccagctaatttttgtattttttagcagagacgggatttctctacgttggccaagctggtcttgaactcctggcctcaagtgatccgcccacctcggcctcccaaagttctgggattacaggcataagctaccacaccctgcctgcttttgtttttaaaagttaaatgtattatttcccttattagaaatcaaaatagataatttttaaaaagatgtattaattcattaaaaaataataaacccattataggttaacacttgaagaataggtacactttccaaattaaaaaaaaaaamaacaaaaccaaaagaagagtggaatgattccgcatcttcacaaatctgtagagtgcgtgacttacagaagacaactctacacatctacttctgtatctccatctgttattgtatactgttttagttgaagtacattgaaaaaacttggcctcacacagatatatagttggaaaaggagcactgttttaatagccttttcagataactggggatatttttacttgatactatagcaacacttgacagctggtaatttcttaaaggttagctgcaatgtggaatctgaaaccatatcaacga

SEQ ID NO: 63772 - DNA, 601 bp, Human
gccaggtcagacgcacacttacatggctgttgagtaaaccgcttttgtgtgatgtgattccttcgcttttttggaggttttcaatcgccatttcaagctaaagaaaatgtgtgcagaaacaaaacaaaacaaaatggaaaaaaaaaaaaaggaaatcagatggttagcatcagccaagatttgtttttattaatatccaaataatgattcgagctcctacaaaataaaaatgaggctccacgcaggcagggcgggggtgagttaaattgtgcatgaaagctgcggtagggagtgttgcttygcacacgtaggtaagcccgagagcccgtccaacagaagcagcagaaatcatgttgtaaaaacttgctactgaactttaacctggcatatgtgtgtgcacgccgtagcattaatatgcagccactgcatccattccagtgtcagccaagccagcatcatagtcacctgctcctttccccacgccacatcgatggggaaccagaatgaaagcaaggagagatggcagccttgactccccagccaggctgtcctgtcgcaaatcccagggtctccccgctgctggaggctttgggaaaatagc

SEQ ID NO: 63773 - DNA, 601 bp, Human; identical to SEQ ID NO: 19803

SEQ ID NO: 63774 - DNA, 601 bp, Human; identical to SEQ ID NO: 19804

SEQ ID NO: 63775 - DNA, 601 bp, Human; identical to SEQ ID NO: 19805

SEQ ID NO: 63776 - DNA, 601 bp, Human; identical to SEQ ID NO: 19806

SEQ ID NO: 63777 - DNA, 601 bp, Human; identical to SEQ ID NO: 19807

SEQ ID NO: 63778 - DNA, 601 bp, Human; identical to SEQ ID NO: 19808

SEQ ID NO: 63779 - DNA, 601 bp, Human; identical to SEQ ID NO: 19809

SEQ ID NO: 63780 - DNA, 601 bp, Human; identical to SEQ ID NO: 19810

SEQ ID NO: 63781 - DNA, 601 bp, Human; identical to SEQ ID NO: 19811

SEQ ID NO: 63782 - DNA, 601 bp, Human; identical to SEQ ID NO: 19812

SEQ ID NO: 63783 - DNA, 601 bp, Human; identical to SEQ ID NO: 19813

SEQ ID NO: 63784 - DNA, 601 bp, Human; identical to SEQ ID NO: 19814

SEQ ID NO: 63785 - DNA, 601 bp, Human; identical to SEQ ID NO: 19815

SEQ ID NO: 63786 - DNA, 601 bp, Human; identical to SEQ ID NO: 19816

SEQ ID NO: 63787 - DNA, 601 bp, Human; identical to SEQ ID NO: 29546

SEQ ID NO: 63788 - DNA, 601 bp, Human; identical to SEQ ID NO: 29547

SEQ ID NO: 63789 - DNA, 601 bp, Human; identical to SEQ ID NO: 29548

SEQ ID NO: 63790 - DNA, 601 bp, Human; identical to SEQ ID NO: 29549

SEQ ID NO: 63791 - DNA, 601 bp, Human; identical to SEQ ID NO: 29550

SEQ ID NO: 63792 - DNA, 601 bp, Human; identical to SEQ ID NO: 29551

SEQ ID NO: 63793 - DNA, 601 bp, Human; identical to SEQ ID NO: 29552

SEQ ID NO: 63794 - DNA, 601 bp, Human; identical to SEQ ID NO: 29553

SEQ ID NO: 63795 - DNA, 601 bp, Human; identical to SEQ ID NO: 29554

SEQ ID NO: 63796 - DNA, 601 bp, Human; identical to SEQ ID NO: 29555

SEQ ID NO: 63797 - DNA, 601 bp, Human; identical to SEQ ID NO: 29556

SEQ ID NO: 63798 - DNA, 601 bp, Human; identical to SEQ ID NO: 29557

SEQ ID NO: 63799 - DNA, 601 bp, Human; identical to SEQ ID NO: 29558

SEQ ID NO: 63800 - DNA, 601 bp, Human; identical to SEQ ID NO: 29559

SEQ ID NO: 63801 - DNA, 601 bp, Human; identical to SEQ ID NO: 29560

SEQ ID NO: 63802 - DNA, 601 bp, Human; identical to SEQ ID NO: 29561

SEQ ID NO: 63803 - DNA, 601 bp, Human; identical to SEQ ID NO: 29562

SEQ ID NO: 63804 - DNA, 601 bp, Human; identical to SEQ ID NO: 29563

SEQ ID NO: 63805 - DNA, 601 bp, Human
tgctgatcacctgaggtcaggagttcgagaccagcctgaataacatggagaaaccccatctctactaaaaatacaaaaaattagccggacgtggtggcacatgcctgtaatcccagctacttgggaggctgaggcaggagaattgcttgaacccgggaggcggaggttgtggtgagctgagatgacgccattgcactccagcctgggcaacaagagcaaaacactgcctcaaaaaaaaaaaaaaagaaagaaaaagaaaagaaaagaaaaaagaaaagtctatgcattcttctggcacagrtggtctgcattttgcaaataaaaaacaaacacatgggccaggagcggtggttcatgcctgtaatcccagcacttagggaggcccaggtgggcggatcacgaggtcaagagttctagaccagcctggccaacatggtgaaaccccgtctctactaggaatacaaaaattagctgggcgtggtggcacatgcctgtaatcccagctactcaggaggctaaggcaggtgaactgcttgaaccccgggaggcggaggttgcagtgagctgagatcgcgccactgcactccagcctgggcaacag

SEQ ID NO: 63806 - DNA, 601 bp, Human
tggatatcgtctgatctttgtatttccaatgccacgtataatacttgtgtgtccttcaaatatttcgtttaaaaaaaaaaaaagaggccgggcctggtggctcaagcctttaatcccagcactttgggaggccgaggtgtgctgatcacctgaggtcaggagttcgagaccagcctgaataacatggagaaaccccatctctactaaaaatacaaaaaattagccggacgtggtggcacatgcctgtaatcccagctacttgggaggctgaggcaggagaattgcttgaacccgggaggcrgaggttgtggtgagctgagatgacgccattgcactccagcctgggcaacaagagcaaaacactgcctcaaaaaaaaaaaaaaagaaagaaaaagaaaagaaaagaaaaaagaaaagtctatgcattcttctggcacaggtggtctgcattttgcaaataaaaaacaaacacatgggccaggagcggtggttcatgcctgtaatcccagcacttagggaggcccaggtgggcggatcacgaggtcaagagttctagaccagcctggccaacatggtgaaaccccgtctctactaggaatac

SEQ ID NO: 63807 - DNA, 601 bp, Human
ctctactaaaaatacaaaaaaaaaaaaaaaaaaaattagccaggcgtggtgggggacacctgtaatcccagctattcgtgaggctgaggcacgagaatcacttgaacctgggaagtggaggttgcagtaagccaagattgcgccactgcgctccagcctgggtgacagtgagactctgtctcaaaaaaaaaaaaaaggtaactaattttggacatgttatatttgaagtgccaaatgggcagctgaatatgaactccagagaacaagtccaggtcagagatacacgtctagtcattagcaraacactgtcaaatgaagtgaaaccagtacaactcatgtaacaacaaagaaaaaaaaaaaaggaagggggggaacggagagatgcccatttccttggctgattttaggagtaaataaagagatacagattgagcatcccttatccaaaatgcttgagaccagaagtgtttcattcatcagaattttttaaattttgaaatatttgcatatacataatgaggtatcttggggatgggacccaagtctaaatataaaattcatttatgtttcatttattcacttactttgagatggagtcttg

SEQ ID NO: 63808 - DNA, 601 bp, Human
aaaaagaaagaacatggaaaaatacatatgttataatgttaaatatagatttcagaaatattcatattgtataatcttaactatgtataaaaataggtctagaaaaaataagcacaagacagtaacatcattggttattttgggtatattttctataataagcactttttaaatgtagcttgctaaagcactttaaaatacttaactaatgcatttcaactgcaattgattctcttttaataactggatatctcaaattgaagattctgaagccattacaaactatagtaaaaacagttcytcctttggagccaaactgtagctacgtactactgctattgtgttttcactaacaagtaacctctcaggtactcaatatttcactgcacttcacttccaaaattctaaccactagtaatctcaattttttacaggctttacaacagaatttatatttctccccatttcccaagagtttatctcttatccatatccaattctctcaataaacttaagtataaaccacctgcttctgacagtagagtttattacagttaataccagacactgccgcactgtctatctcagctcagtgtctggc

SEQ ID NO: 63809 - DNA, 601 bp, Human
tcacttgagcccaggaggtcaaggctgcagtaagccaagatagcaccactgcactccagcctgggtgacaggatgagacccagtctcaaaaaaaaaaaaaaagaaagaacatggaaaaatacatatgttataatgttaaatatagatttcagaaatattcatattgtataatcttaactatgtataaaaataggtctagaaaaaataagcacaagacagtaacatcattggttattttgggtatattttctataataagcactttttaaatgtagcttgctaaagcactttaaaatacttractaatgcatttcaactgcaattgattctcttttaataactggatatctcaaattgaagattctgaagccattacaaactatagtaaaaacagttcttcctttggagccaaactgtagctacgtactactgctattgtgttttcactaacaagtaacctctcaggtactcaatatttcactgcacttcacttccaaaattctaaccactagtaatctcaattttttacaggctttacaacagaatttatatttctccccatttcccaagagtttatctcttatccatatccaattctctc

SEQ ID NO: 63810 - DNA, 601 bp, Human
gctgagggcggtggctcgctcctgtaatcccagcactttgggaggtcaaggtgagagaattgcttgacccaaggagttcgagaccagcctgggcaaaatagtgagaccctcatctctccaaaaagtaaaaataaaattagccaggcatggtggcatgtgcttgtagtctcagctactcagaaggttcaggcgggaggatcacttgagcccaggaggtcaaggctgcagtaagccaagatagcaccactgcactccagcctgggtgacaggatgagacccagtctcaaaaaaaaaaaaaaaaaaagaacatggaaaaatacatatgttataatgttaaatatagatttcagaaatattcatattgtataatcttaactatgtataaaaataggtctagaaaaaataagcacaagacagtaacatcattggttattttgggtatattttctataataagcactttttaaatgtagcttgctaaagcactttaaaatacttaactaatgcatttcaactgcaattgattctcttttaataactggatatctcaaattgaagattctgaagccattacaaactatagtaaaaacagttcttcctt

SEQ ID NO: 63811 - DNA, 601 bp, Human
tgaacctgggaggcggaggttgcagtgagccgagatcacaccactactctccagcctgggcaacaaggcaagactccatctcaaaaaagaaaaagaaaaaaccactgaactaagctaaaggaaggtaacaactcaaagtaaagaaaaaaactttagccacaaagatgttcattattcagccttgccttattttcaaggacaaaaaccagaatgatggtaaattagtaactgtgaaatggttggatgttgtaacacttccaaagacaggggaaaaaatctgcaactattttaaatgtcgttyacaaaaggtttttaagaacatggggctgagggcggtggctcgctcctgtaatcccagcactttgggaggtcaaggtgagagaattgcttgacccaaggagttcgagaccagcctgggcaaaatagtgagaccctcatctctccaaaaagtaaaaataaaattagccaggcatggtggcatgtgcttgtagtctcagctactcagaaggttcaggcgggaggatcacttgagcccaggaggtcaaggctgcagtaagccaagatagcaccactgcactccagcctgggtgacaggatgaga

SEQ ID NO: 63812 - DNA, 601 bp, Human
agtctgtgtttaacaaggcttccaggcaaggctgacacactcaaatatgaaaatcactgaactggctgggcatggtggctcacacttgtaatcccagcacttggagaggcagaggcgggtggatcacctgaggtcaggagttcaagaccagcctggccaacatggcaaaaccctgtctctactaaaaatacaaaaaattagctgggcatggcagcagacgcctataatcccagctactcggtaggctgaggcaagagaactgcttgaacctgggaggcggaggttgcagtgagccgagataacaccactactctccagcctgggcaacaaggcaagactccatctcaaaaaagaaaaagaaaaaaccactgaactaagctaaaggaaggtaacaactcaaagtaaagaaaaaaactttagccacaaagatgttcattattcagccttgccttattttcaaggacaaaaaccagaatgatggtaaattagtaactgtgaaatggttggatgttgtaacacttccaaagacaggggaaaaaatctgcaactattttaaatgtcgttcacaaaaggtttttaagaacatggggctgagggcggt

SEQ ID NO: 63813 - DNA, 601 bp, Human
ataatatagcccagtagttctcaaagtgtagttcccaaaccagcagcatcatcatcaactgggaatttgttaaaaatgcaaatgctcaggtctcccctcagacctgctcaaacagaaatccgcccagtgggatccaatagtctgtgtttaacaaggcttccaggcaaggctgacacactcaaatatgaaaatcactgaactggctgggcatggtggctcacacttgtaatcccagcacttggagaggcagaggcgggtggatcacctgaggtcaggagttcaagaccagcctggccaacayggcaaaaccctgtctctactaaaaatacaaaaaattagctgggcatggcagcagacgcctataatcccagctactcggtaggctgaggcaagagaactgcttgaacctgggaggcggaggttgcagtgagccgagatcacaccactactctccagcctgggcaacaaggcaagactccatctcaaaaaagaaaaagaaaaaaccactgaactaagctaaaggaaggtaacaactcaaagtaaagaaaaaaactttagccacaaagatgttcattattcagccttgccttattttcaagga

SEQ ID NO: 63814 - DNA, 601 bp, Human
gtggttaccagaggctgagaagggaagtgggagtggtggagatgaacagaaagtggttagtgttacaaaaatacagtttgattagtaagttctaatatttgatagtacagtacagaaattatagttaacaatttattgtatacttcaaaacagctagaagacttgtaatattcctaacacagaaaagatgtttcaaatgatgggtatcccaatcaccctgatttgatcactacatattatacacaggtatcaaaatatcacatgtacccaaaaaacacatatcactaaataaaacaaaaaytcaatttaaccatacaactgccaagagacaccccccacctttcccaaaccccttctttatcctctacccaataccctaccctcctaccctcctaccctaactggcttccagaatgctagcaattaggcctttaccttccagaggaatatggaaatctgacaatctctaatgaaaaacctaagattctgatatcaaaagtttcccaaatgaggccatgcatggtggctcacacctgtaatcccagcactttgggaggccaaggatcacctgaagccaggagttccagaccagcctgattaa

SEQ ID NO: 63815 - DNA, 601 bp, Human; identical to SEQ ID NO: 40481

SEQ ID NO: 63816 - DNA, 601 bp, Human; identical to SEQ ID NO: 40482

SEQ ID NO: 63817 - DNA, 601 bp, Human; identical to SEQ ID NO: 40483

SEQ ID NO: 63818 - DNA, 601 bp, Human; identical to SEQ ID NO: 40484

SEQ ID NO: 63819 - DNA, 601 bp, Human; identical to SEQ ID NO: 40485

SEQ ID NO: 63820 - DNA, 601 bp, Human; identical to SEQ ID NO: 40486

SEQ ID NO: 63821 - DNA, 601 bp, Human; identical to SEQ ID NO: 40487

SEQ ID NO: 63822 - DNA, 601 bp, Human; identical to SEQ ID NO: 40488

SEQ ID NO: 63823 - DNA, 601 bp, Human; identical to SEQ ID NO: 40489

SEQ ID NO: 63824 - DNA, 601 bp, Human; identical to SEQ ID NO: 40490

SEQ ID NO: 63825 - DNA, 601 bp, Human; identical to SEQ ID NO: 40491

SEQ ID NO: 63826 - DNA, 601 bp, Human; identical to SEQ ID NO: 40492

SEQ ID NO: 63827 - DNA, 601 bp, Human; identical to SEQ ID NO: 40493

SEQ ID NO: 63828 - DNA, 601 bp, Human; identical to SEQ ID NO: 40494

SEQ ID NO: 63829 - DNA, 601 bp, Human; identical to SEQ ID NO: 40495

SEQ ID NO: 63830 - DNA, 601 bp, Human; identical to SEQ ID NO: 40496

SEQ ID NO: 63831 - DNA, 601 bp, Human; identical to SEQ ID NO: 40497

SEQ ID NO: 63832 - DNA, 601 bp, Human; identical to SEQ ID NO: 40498

SEQ ID NO: 63833 - DNA, 601 bp, Human; identical to SEQ ID NO: 40499

SEQ ID NO: 63834 - DNA, 601 bp, Human; identical to SEQ ID NO: 40500

SEQ ID NO: 63835 - DNA, 601 bp, Human; identical to SEQ ID NO: 40501

SEQ ID NO: 63836 - DNA, 601 bp, Human; identical to SEQ ID NO: 40502

SEQ ID NO: 63837 - DNA, 601 bp, Human; identical to SEQ ID NO: 40503

SEQ ID NO: 63838 - DNA, 601 bp, Human; identical to SEQ ID NO: 40504

SEQ ID NO: 63839 - DNA, 601 bp, Human; identical to SEQ ID NO: 40505

SEQ ID NO: 63840 - DNA, 601 bp, Human; identical to SEQ ID NO: 40506

SEQ ID NO: 63841 - DNA, 601 bp, Human
accaaaatgatggcactgagaaagagggagaccatggggttctgaaaataagagggtgtgggatgccttgaatgacagctgcactgcaggactaggagacagggagctctaagagttgctgcaggtcagaggggtccaggacagagggttcgagaaaagcagtggtcctcacatgtttcaaaagaaggctgacaggccatttttattttcttctttatgctttaattttcatatatcccacaaaaatacataaattttatttaggcagaaatttaaaaaacagtatatattacattttttwaaaaaatacctacataaatatataactgaggttctactacaataaactctaacactattcttttagaaataaaagaacatacctttgtaaggatggttttaccataattctttgtgctcgtcaaaccactattcaaatagatatttttcttcccaactgggctataataagctaaagtcaaaaggaaacagagataaattgcttattaaatacagaattataatataatccaatcatcttaataatcccagcagcatattcacacaagaaatggaaaaacttaccctttggacaaacacc

SEQ ID NO: 63842 - DNA, 601 bp, Human
actcagccaaaattatcaatcaggcttaagagtggaataaagacattttcagatatatgaaatcccaacaatatgcaggtcatctacgttttcttaggaagctcctgcaagatacactacaccaaaatgatggcactgagaaagagggagaccatggggttctgaaaataagagggtgtgggatgccttgaatgacagctgcactgcaggactaggagacagggagctctaagagttgctgcaggtcagaggggtccaggacagagggttcgagaaaagcagtggtcctcacatgtttcaraagaaggctgacaggccatttttattttcttctttatgctttaattttcatatatcccacaaaaatacataaattttatttaggcagaaatttaaaaaacagtatatattacattttttaaaaaaatacctacataaatatataactgaggttctactacaataaactctaacactattcttttagaaataaaagaacatacctttgtaaggatggttttaccataattctttgtgctcgtcaaaccactattcaaatagatatttttcttcccaactgggctataataagctaaagtca

SEQ ID NO: 63843 - DNA, 601 bp, Human
gaccatagagaacatgagaactaagaatatactcagccaaaattatcaatcaggcttaagagtggaataaagacattttcagatatatgaaatcccaacaatatgcaggtcatctacgttttcttaggaagctcctgcaagatacactacaccaaaatgatggcactgagaaagagggagaccatggggttctgaaaataagagggtgtgggatgccttgaatgacagctgcactgcaggactaggagacagggagctctaagagttgctgcaggtcagaggggtccaggacagagggttygagaaaagcagtggtcctcacatgtttcaaaagaaggctgacaggccatttttattttcttctttatgctttaattttcatatatcccacaaaaatacataaattttatttaggcagaaatttaaaaaacagtatatattacattttttaaaaaaatacctacataaatatataactgaggttctactacaataaactctaacactattcttttagaaataaaagaacatacctttgtaaggatggttttaccataattctttgtgctcgtcaaaccactattcaaatagatatttttct

SEQ ID NO: 63844 - DNA, 601 bp, Human
gtgccgaagattataggaatgagccaccatgcccggcctctttgtatatttcagatagcagtcttttctcagatgtgtcttttgcaaatgttttcccataccctacaccaagtataacatcatagtcaaaaaatcagtataccaaccagccctttaggaagccaaggtgagtggatcacttgaggtcaggggttcatgagaccagcctggccaacatggtgaaaccctgtctctaaaacaaaaatacaaaaattagccaggcgtggtgacaggtgcttgtaatcccaactactcaggaggytgaagcaggagaactgcttgaacccagaaggcagaggttacagtgagccaagatggtgccactgccctccagactgggccacagagcaagactctgtctcaaaaaaaataaaaattaaataaaaattaaaaatcagtatatcagatactaatatgtcctaccaacatctctctccccttcttccttacttaatgagccctaattttgcccaggacagcaatatactcagctaaaatagccagctttccacattccgttgaggctaagggcagccacgggacccagtgctgtccagtaaca

SEQ ID NO: 63845 - DNA, 601 bp, Human
ctctacaaaaataataaaaaatattaaccaggtgggctaggcatggtggctcacgcctgtaatcccagcactttgggaggctgaggcaggtggatcacgaggtcaggagttcgagaccagcctggccaacatggtgaaaccctgtctctactaaaaatacaaaaattagctgggcatggaggcacgcgcctgtaatctcaactactcgggaggctgaggcaggagaactgcttgaacccagggggcggaggttgcagtgagctgagatcacgccattgcactccagcctgggagacagggygagacttcgtctcaaaaaaaaaaaaaaaaaaattagccaggcatggtggtgcacacctgtggtcccagctacttgggaggctgaggtgagagtatcacctgaacccaggaggctgaggctacagtgatctatgatcacaccactgcactccagcctgggtgacagagtaagactttgtctcaaaaaagagtaataaccggactatgattcttctaccaattatatgaatttaacagaataagtaggattttatttaatactatcaaacattattgtaagtagtaacaaatcaatttaaga

SEQ ID NO: 63846 - DNA, 601 bp, Human; identical to SEQ ID NO: 40507

SEQ ID NO: 63847 - DNA, 601 bp, Human; identical to SEQ ID NO: 40508

SEQ ID NO: 63848 - DNA, 601 bp, Human; identical to SEQ ID NO: 40509

SEQ ID NO: 63849 - DNA, 601 bp, Human; identical to SEQ ID NO: 40510

SEQ ID NO: 63850 - DNA, 601 bp, Human; identical to SEQ ID NO: 40511

SEQ ID NO: 63851 - DNA, 601 bp, Human; identical to SEQ ID NO: 40512

SEQ ID NO: 63852 - DNA, 601 bp, Human; identical to SEQ ID NO: 40513

SEQ ID NO: 63853 - DNA, 601 bp, Human; identical to SEQ ID NO: 40514

SEQ ID NO: 63854 - DNA, 601 bp, Human; identical to SEQ ID NO: 40515

SEQ ID NO: 63855 - DNA, 601 bp, Human; identical to SEQ ID NO: 40516

SEQ ID NO: 63856 - DNA, 601 bp, Human; identical to SEQ ID NO: 40517

SEQ ID NO: 63857 - DNA, 601 bp, Human; identical to SEQ ID NO: 40518

SEQ ID NO: 63858 - DNA, 601 bp, Human; identical to SEQ ID NO: 40519

SEQ ID NO: 63859 - DNA, 601 bp, Human; identical to SEQ ID NO: 40520

SEQ ID NO: 63860 - DNA, 601 bp, Human; identical to SEQ ID NO: 40521

SEQ ID NO: 63861 - DNA, 601 bp, Human; identical to SEQ ID NO: 40522

SEQ ID NO: 63862 - DNA, 601 bp, Human; identical to SEQ ID NO: 40523

SEQ ID NO: 63863 - DNA, 601 bp, Human; identical to SEQ ID NO: 40524

SEQ ID NO: 63864 - DNA, 601 bp, Human; identical to SEQ ID NO: 40525

SEQ ID NO: 63865 - DNA, 601 bp, Human; identical to SEQ ID NO: 40526

SEQ ID NO: 63866 - DNA, 601 bp, Human; identical to SEQ ID NO: 40527

SEQ ID NO: 63867 - DNA, 601 bp, Human; identical to SEQ ID NO: 40528

SEQ ID NO: 63868 - DNA, 601 bp, Human; identical to SEQ ID NO: 40529

SEQ ID NO: 63869 - DNA, 601 bp, Human; identical to SEQ ID NO: 40530

SEQ ID NO: 63870 - DNA, 601 bp, Human; identical to SEQ ID NO: 40531

SEQ ID NO: 63871 - DNA, 601 bp, Human; identical to SEQ ID NO: 40532

SEQ ID NO: 63872 - DNA, 601 bp, Human; identical to SEQ ID NO: 40533

SEQ ID NO: 63873 - DNA, 601 bp, Human; identical to SEQ ID NO: 40534

SEQ ID NO: 63874 - DNA, 601 bp, Human; identical to SEQ ID NO: 40535

SEQ ID NO: 63875 - DNA, 601 bp, Human; identical to SEQ ID NO: 40536

SEQ ID NO: 63876 - DNA, 601 bp, Human; identical to SEQ ID NO: 40537

SEQ ID NO: 63877 - DNA, 601 bp, Human; identical to SEQ ID NO: 40538

SEQ ID NO: 63878 - DNA, 601 bp, Human; identical to SEQ ID NO: 40539

SEQ ID NO: 63879 - DNA, 601 bp, Human; identical to SEQ ID NO: 40540

SEQ ID NO: 63880 - DNA, 601 bp, Human; identical to SEQ ID NO: 63805

SEQ ID NO: 63881 - DNA, 601 bp, Human; identical to SEQ ID NO: 63806

SEQ ID NO: 63882 - DNA, 601 bp, Human; identical to SEQ ID NO: 63807

SEQ ID NO: 63883 - DNA, 601 bp, Human; identical to SEQ ID NO: 63808

SEQ ID NO: 63884 - DNA, 601 bp, Human; identical to SEQ ID NO: 63809

SEQ ID NO: 63885 - DNA, 601 bp, Human; identical to SEQ ID NO: 63810

SEQ ID NO: 63886 - DNA, 601 bp, Human; identical to SEQ ID NO: 63811

SEQ ID NO: 63887 - DNA, 601 bp, Human; identical to SEQ ID NO: 63812

SEQ ID NO: 63888 - DNA, 601 bp, Human; identical to SEQ ID NO: 63813

SEQ ID NO: 63889 - DNA, 601 bp, Human; identical to SEQ ID NO: 63814

SEQ ID NO: 63890 - DNA, 601 bp, Human; identical to SEQ ID NO: 40481

SEQ ID NO: 63891 - DNA, 601 bp, Human; identical to SEQ ID NO: 40482

SEQ ID NO: 63892 - DNA, 601 bp, Human; identical to SEQ ID NO: 40483

SEQ ID NO: 63893 - DNA, 601 bp, Human; identical to SEQ ID NO: 40484

SEQ ID NO: 63894 - DNA, 601 bp, Human; identical to SEQ ID NO: 40485

SEQ ID NO: 63895 - DNA, 601 bp, Human; identical to SEQ ID NO: 40486

SEQ ID NO: 63896 - DNA, 601 bp, Human; identical to SEQ ID NO: 40487

SEQ ID NO: 63897 - DNA, 601 bp, Human; identical to SEQ ID NO: 40488

SEQ ID NO: 63898 - DNA, 601 bp, Human; identical to SEQ ID NO: 40489

SEQ ID NO: 63899 - DNA, 601 bp, Human; identical to SEQ ID NO: 40490

SEQ ID NO: 63900 - DNA, 601 bp, Human; identical to SEQ ID NO: 40491

SEQ ID NO: 63901 - DNA, 601 bp, Human; identical to SEQ ID NO: 40492

SEQ ID NO: 63902 - DNA, 601 bp, Human; identical to SEQ ID NO: 40493

SEQ ID NO: 63903 - DNA, 601 bp, Human; identical to SEQ ID NO: 40494

SEQ ID NO: 63904 - DNA, 601 bp, Human; identical to SEQ ID NO: 40495

SEQ ID NO: 63905 - DNA, 601 bp, Human; identical to SEQ ID NO: 40496

SEQ ID NO: 63906 - DNA, 601 bp, Human; identical to SEQ ID NO: 40497

SEQ ID NO: 63907 - DNA, 601 bp, Human; identical to SEQ ID NO: 40498

SEQ ID NO: 63908 - DNA, 601 bp, Human; identical to SEQ ID NO: 40499

SEQ ID NO: 63909 - DNA, 601 bp, Human; identical to SEQ ID NO: 40500

SEQ ID NO: 63910 - DNA, 601 bp, Human; identical to SEQ ID NO: 40501

SEQ ID NO: 63911 - DNA, 601 bp, Human; identical to SEQ ID NO: 40502

SEQ ID NO: 63912 - DNA, 601 bp, Human; identical to SEQ ID NO: 40503

SEQ ID NO: 63913 - DNA, 601 bp, Human; identical to SEQ ID NO: 40504

SEQ ID NO: 63914 - DNA, 601 bp, Human; identical to SEQ ID NO: 40505

SEQ ID NO: 63915 - DNA, 601 bp, Human; identical to SEQ ID NO: 40506

SEQ ID NO: 63916 - DNA, 601 bp, Human; identical to SEQ ID NO: 63841

SEQ ID NO: 63917 - DNA, 601 bp, Human; identical to SEQ ID NO: 63842

SEQ ID NO: 63918 - DNA, 601 bp, Human; identical to SEQ ID NO: 63843

SEQ ID NO: 63919 - DNA, 601 bp, Human; identical to SEQ ID NO: 63844

SEQ ID NO: 63920 - DNA, 601 bp, Human; identical to SEQ ID NO: 63845

SEQ ID NO: 63921 - DNA, 601 bp, Human; identical to SEQ ID NO: 40507

SEQ ID NO: 63922 - DNA, 601 bp, Human; identical to SEQ ID NO: 40508

SEQ ID NO: 63923 - DNA, 601 bp, Human; identical to SEQ ID NO: 40509

SEQ ID NO: 63924 - DNA, 601 bp, Human; identical to SEQ ID NO: 40510

SEQ ID NO: 63925 - DNA, 601 bp, Human; identical to SEQ ID NO: 40511

SEQ ID NO: 63926 - DNA, 601 bp, Human; identical to SEQ ID NO: 40512

SEQ ID NO: 63927 - DNA, 601 bp, Human; identical to SEQ ID NO: 40513

SEQ ID NO: 63928 - DNA, 601 bp, Human; identical to SEQ ID NO: 40514

SEQ ID NO: 63929 - DNA, 601 bp, Human; identical to SEQ ID NO: 40515

SEQ ID NO: 63930 - DNA, 601 bp, Human; identical to SEQ ID NO: 40516

SEQ ID NO: 63931 - DNA, 601 bp, Human; identical to SEQ ID NO: 40517

SEQ ID NO: 63932 - DNA, 601 bp, Human; identical to SEQ ID NO: 40518

SEQ ID NO: 63933 - DNA, 601 bp, Human; identical to SEQ ID NO: 40519

SEQ ID NO: 63934 - DNA, 601 bp, Human; identical to SEQ ID NO: 40520

SEQ ID NO: 63935 - DNA, 601 bp, Human; identical to SEQ ID NO: 40521

SEQ ID NO: 63936 - DNA, 601 bp, Human; identical to SEQ ID NO: 40522

SEQ ID NO: 63937 - DNA, 601 bp, Human; identical to SEQ ID NO: 40523

SEQ ID NO: 63938 - DNA, 601 bp, Human; identical to SEQ ID NO: 40524

SEQ ID NO: 63939 - DNA, 601 bp, Human; identical to SEQ ID NO: 40525

SEQ ID NO: 63940 - DNA, 601 bp, Human; identical to SEQ ID NO: 40526

SEQ ID NO: 63941 - DNA, 601 bp, Human; identical to SEQ ID NO: 40527

SEQ ID NO: 63942 - DNA, 601 bp, Human; identical to SEQ ID NO: 40528

SEQ ID NO: 63943 - DNA, 601 bp, Human; identical to SEQ ID NO: 40529

SEQ ID NO: 63944 - DNA, 601 bp, Human; identical to SEQ ID NO: 40530

SEQ ID NO: 63945 - DNA, 601 bp, Human; identical to SEQ ID NO: 40531

SEQ ID NO: 63946 - DNA, 601 bp, Human; identical to SEQ ID NO: 40532

SEQ ID NO: 63947 - DNA, 601 bp, Human; identical to SEQ ID NO: 40533

SEQ ID NO: 63948 - DNA, 601 bp, Human; identical to SEQ ID NO: 40534

SEQ ID NO: 63949 - DNA, 601 bp, Human; identical to SEQ ID NO: 40535

SEQ ID NO: 63950 - DNA, 601 bp, Human; identical to SEQ ID NO: 40536

SEQ ID NO: 63951 - DNA, 601 bp, Human; identical to SEQ ID NO: 40537

SEQ ID NO: 63952 - DNA, 601 bp, Human; identical to SEQ ID NO: 40538

SEQ ID NO: 63953 - DNA, 601 bp, Human; identical to SEQ ID NO: 40539

SEQ ID NO: 63954 - DNA, 601 bp, Human; identical to SEQ ID NO: 40540

SEQ ID NO: 63955 - DNA, 601 bp, Human
tgtgcaactatgggactcttttactatccttttcattcctaagtgggaagttgaacaggtatgagcatctcagcagtgttgtaggagggcaaatggaggctagtgaccatgtaatatgcttgccccctctctctctgcaccacattaaaatttgcaaagattctcactcttgtccaagggctggtacccatgtcaccttccctaagtccctgtgtaccaataaggtaaattcaagtaggtaacagatttgcagcttacatgtagaactcactgtgtgtgggtggggagtggggggaatgcrggagatgccctttatgaaaaaaaaattgtggtttgccacaaggtgtcagtatatgtcacctcacagtgaatcaggactggctgttaaacctatatatataatatattagaatcaaaggctgcgtacatcttatatcctgataaaagcaggaaaacacattcctgttccttctctctgtaaagagagcaacgtaaattttaggatatatttgattaaagacagaaatagaagtgtggtgatgacctcaaatctcacctagaactcaactcccctttctcattctgtgccaatctccactac

SEQ ID NO: 63956 - DNA, 601 bp, Human
caccccgccgtcctgaattgagactgtttggcaacttaaaaataaccataagattttttattgactaagagtaataaaaagttcatgaaactgccagaatttgtcctttgaataaagtttaaaggaaagtagatgaaattaattttcttatgtgattacaccccatgagtccagcttattcaatatcctggttacaaatcatagaagtaatcataaatgcacaaaatagcaatctttatcacctttcttgtagacaacattaagagcctcttagcttaccaccacattgttcatttctccygtactgcagttctgcttttatcacatcacatcagttccctgctcagtgcttttcatgaccacccacatattcaaggtaacatccaagttccttaggctgtctttcaaggcccttttcaatatattcccaatcttcattttcagcctttctcccttctacttccctgccaagctggtcatcttagtgcactaaaaatacattttatatcttctaattcctgtgcctttgactatgccattcctcttccacctgcattttgacttatcagaagacttcaaacaatttcttcataaaggcttt

SEQ ID NO: 63957 - DNA, 601 bp, Human
ggagagctttcttgctatcctcaccccgccgtcctgaattgagactgtttggcaacttaaaaataaccataagattttttattgactaagagtaataaaaagttcatgaaactgccagaatttgtcctttgaataaagtttaaaggaaagtagatgaaattaattttcttatgtgattacaccccatgagtccagcttattcaatatcctggttacaaatcatagaagtaatcataaatgcacaaaatagcaatctttatcacctttcttgtagacaacattaagagcctcttagcttacyaccacattgttcatttctcctgtactgcagttctgcttttatcacatcacatcagttccctgctcagtgcttttcatgaccacccacatattcaaggtaacatccaagttccttaggctgtctttcaaggcccttttcaatatattcccaatcttcattttcagcctttctcccttctacttccctgccaagctggtcatcttagtgcactaaaaatacattttatatcttctaattcctgtgcctttgactatgccattcctcttccacctgcattttgacttatcagaagacttcaaa

SEQ ID NO: 63958 - DNA, 601 bp, Human
attgccccccttctccgtcactcccactccaaagtcaggatacactttcttctcaggtaggccaaaagggttgtctctggatctgcatttttctccaccacctattaaaataaatgaaagaaaaatatatcataggtatacttagtcatctttctgcaattaatttcttccttcagtgtctcactcaataatttgtagagttagtaggaagtgtgatatagtttggactctgcccctctaaatctcatgtttaattgtaatccccagtgttgaaggtggggcctagtgggaagcaatatgmtcatgggggcagatttctcatgaatggcttagtgccatccccttagttgtgaattagttgtcacgagatatttaaaagtatgtggcatcacccccttctctctctctcttgctcttactggccatgtgatgtgcctgctcccactttgccttctgccatgagtaaaaactcctggaggcctccccagaagccaagcacatgctggtgtcatgcttgtacagcctgcagaactgtgagccaactaaatctcttttcttataattacccagcctcaggtgtttctttatagcaatgcatgaa

SEQ ID NO: 63959 - DNA, 601 bp, Human
tgctctttcctccacacctcaaggccaccccaccagtcactaggaaacaatgtaaggcctacagaatcagtcaccattgccccccttctccgtcactcccactccaaagtcaggatacactttcttctcaggtaggccaaaagggttgtctctggatctgcatttttctccaccacctattaaaataaatgaaagaaaaatatatcataggtatacttagtcatctttctgcaattaatttcttccttcagtgtctcactcaataatttgtagagttagtaggaagtgtgatatagtttgsactctgcccctctaaatctcatgtttaattgtaatccccagtgttgaaggtggggcctagtgggaagcaatatgatcatgggggcagatttctcatgaatggcttagtgccatccccttagttgtgaattagttgtcacgagatatttaaaagtatgtggcatcacccccttctctctctctcttgctcttactggccatgtgatgtgcctgctcccactttgccttctgccatgagtaaaaactcctggaggcctccccagaagccaagcacatgctggtgtcatgcttgtacagcctg

SEQ ID NO: 63960 - DNA, 601 bp, Human
caggaactccatttatgtattaagcaaatgtcacctaaggaaggcccccctcttcccacagaggaatgaccatgaagctcaccaaggctaatgaggacctttctacaggccctggattaaaccttggcattactagagtcttagcggggagacacctcgaagatcaccacaaacaatcctctcattcagtagctgagaatttcagattacaggtgcaactaaaatgcaagtgtcccaagtcctaatccagtgctctttcctccacacctcaaggccaccccaccagtcactaggaaacaakgtaaggcctacagaatcagtcaccattgccccccttctccgtcactcccactccaaagtcaggatacactttcttctcaggtaggccaaaagggttgtctctggatctgcatttttctccaccacctattaaaataaatgaaagaaaaatatatcataggtatacttagtcatctttctgcaattaatttcttccttcagtgtctcactcaataatttgtagagttagtaggaagtgtgatatagtttggactctgcccctctaaatctcatgtttaattgtaatccccagtgttgaagg

SEQ ID NO: 63961 - DNA, 601 bp, Human
gatacacccacttaaggtaaaaaatccagaacaaagtacaccaaagccaaccactgtactgtctgataggaggggagcaaaccagagtgaaagcatgggctccagtctcacttctgtgcgtgttataataatctttgctgtccccaaatatgtcactggaaagacccactagacacccccgctaggagaaggagggttttgttgacagaggtcaggatgagcacagtcctgctcacaggccccctggagagttgccagtgcgggtgagaggttgggaacacagctctaggctttggtgcartctccatcactatttccccagaacacactagcaaaaggcaggtcacttcacatatcaaggcctcagttcctcctctgtgaaaagggagtgttacgcttccatgggattcctgtggagattgaggtgagctgcacaaatcactttgaatcctgcctgtatataggaagtgctcattaaatattaactccaattattattatcgttttagttccagggtcccagaatacttccgatactcagaactaaaggtaaaggggcttttccagaagccccacccacactgagtgaagagcagcaccc

SEQ ID NO: 63962 - DNA, 601 bp, Human
tggtcacttctctcattttcaagacaaaatttaaaaacaatgatataacatcttatttttgaaaagcactttcacctagatacctgtttgacctccagaatgatttggttagcaggtaggaaagaaacttcctcacagatttaaaaaaaacaacaaactgagacccaagaggtaacgtgggccacacaagatgacacaggaacacgttaccctgccggtgtggccccatcacagccatcggactccagactgggtgagctcccttcatcacgctccttcctccccagcacacctgggaagsttttctgtgtcctagtcaggatatatgcagctctcagcaggtcaaacaactttgggggcacctgaagacgaatggtggcacctgaagatgaatggtggcagtacaaagtctagcaaggtcttcttccagcctggagacctttctggaagctagtgtaaaagtcaaggctggagttttctcccccatctggaactcccataaattgactctcagcacagatagccataagctgcaaggtcatcctacttatgtgccaactttcagttttgcatttcatttaagatgtgacacagccaattg

SEQ ID NO: 63963 - DNA, 601 bp, Human
tgtgagcaggtaaatcatacacctgagcatacggggcagttctcacatcactcccagctgggcacaccatgaagccacttgggccagaatgagacattgatctgttctgggacctctgagtccttgcttttcactctgaactttttgggctgataagtccccaagaatcaaaattagggctagaccagaggcttttgaatatttggtccaaaagatatgtgaatggaaattaaaatagagtggtttttttaggtctgggtccaatattgggcctcactcttacatatacttgcagaaagaycatctgctactttgagttttaaaagtgcctaactggtaagctattctagagaacagctattgtggaggtcactttccctgagtcacatggctgcttctccctcagacctgcaggcctctaagccacccactacctactgaagatggagggaactgaggatataatcgcctggtcacttctctcattttcaagacaaaatttaaaaacaatgatataacatcttatttttgaaaagcactttcacctagatacctgtttgacctccagaatgatttggttagcaggtaggaaagaaacttc

SEQ ID NO: 63964 - DNA, 601 bp, Human
agctgtgggcagagccattcattcccacacgtgctcaggcccctcaaccaaggaaggcagcaggcccactggcctccttattcagaggggctgcactgcaccctagggaggcagggaacacggccatctccactgcacagaagagcaaaggcatcagaaccccatggacagcacccaagtagcatctcttgggacatgagttctaggactggtcagtcctagagccttctcttgggttgaggtcttctatgtgtgagcaggtaaatcatacacctgagcatacggggcagttctcacatcrctcccagctgggcacaccatgaagccacttgggccagaatgagacattgatctgttctgggacctctgagtccttgcttttcactctgaactttttgggctgataagtccccaagaatcaaaattagggctagaccagaggcttttgaatatttggtccaaaagatatgtgaatggaaattaaaatagagtggtttttttaggtctgggtccaatattgggcctcactcttacatatacttgcagaaagaccatctgctactttgagttttaaaagtgcctaactggtaagctattctag

SEQ ID NO: 63965 - DNA, 601 bp, Human
taaaaacaggggctcacacatgcgcacatgcacatacacacatacactcatgcactccctcacaagctggtcctgcatcgcagcccccatgtgggtggtcagccagcaggcaaaggatacacgatcttgttctgcagacgatcatacttggagagcatcactgtgcaagccccgcagcccccctctccacagccgagcttggttccactcagccccactgggtggtcaagagttaaggagaatgaactcagggagaggagtctgctgggttgctaggaaatgcctgggcagagctgtgggmagagccattcattcccacacgtgctcaggcccctcaaccaaggaaggcagcaggcccactggcctccttattcagaggggctgcactgcaccctagggaggcagggaacacggccatctccactgcacagaagagcaaaggcatcagaaccccatggacagcacccaagtagcatctcttgggacatgagttctaggactggtcagtcctagagccttctcttgggttgaggtcttctatgtgtgagcaggtaaatcatacacctgagcatacggggcagttctcacatcactcccagct

SEQ ID NO: 63966 - DNA, 601 bp, Human
gaatgctgtgcacagggcactatgggaccagcacagtcaaggggcacctaacccagtcttgagagatccaggatggcttcctggagggggtgatatttttgcccagttgtaaagagctagtaagagttagtcagatagagaaatcctaggagaacttcccagcttaaacaaagaccaagcaattagtgggcctgtgtcattggtatttcacaattatctctgcttgaatggagtgctgggcccatggtgagaaagaaaactggagaagaaacctggggcatactgtgcagggccttgccckctaagcaaagagattttgtcctgggggcaatgaagagctattgaagggctttatggaatgtgatataaatgtggattttagaaaagtcattttatcagcagttcggagcctggtcaatattataagcctagaagatacttgctaagagatcattctacagttttcctgtgcacagattctccataaaaacaggggctcacacatgcgcacatgcacatacacacatacactcatgcactccctcacaagctggtcctgcatcgcagcccccatgtgggtggtcagccagcaggcaaagga

SEQ ID NO: 63967 - DNA, 601 bp, Human
cccttagctagaacttccttgcattcttctgttattcatcactcattcacttacattcagcatcagttattgagtgccagacataagtcaggcactctgctgagggctgggaaaataaagatgaataagatgaaagctctgcccttcaatagactgcagtcaactgagaaaaccaaagtccatatgaaggtgcaatttaaatcttgttaaagtaaattaaaaaggagaccaggcctgaagactcagcagaggaaaccagttaggcctcacaagtgacctaaactgtgcttgatttgcagcggtcttaacttgagctacttcttacgaatatctttatattaaaaaaaagccttacgatcaaccaatcagaagtagtcaacaaacttataactatagtactagggactttccagtgggatagaccaagtaaggcaattgtataattgtaaccaatcaaataatttctttgctttttgcctgtgtccatcctacaaaaacctcctgcttgcatttccctggtggagctcctgaactgcttctaatgtggagctgcttgagctcatgaactgttgttttctcaaataaactgtaaaaattgtat

SEQ ID NO: 63968 - DNA, 601 bp, Human
tggcaggctgcagccttaaagcatgctcctgcctgcagggctgttccttagcttccaatcactttgcttccctgcatttcctcgcctctattgctttcatttctctgtggggaaagggggaggaaacccccaggcaacatgagacagcaagcccttagctagaacttccttgcattcttctgttattcatcactcattcacttacattcagcatcagttattgagtgccagacataagtcaggcactctgctgagggctgggaaaataaagatgaataagatgaaagctctgcccttcaayagactgcagtcaactgagaaaaccaaagtccatatgaaggtgcaatttaaatcttgttaaagtaaattaaaaaggagaccaggcctgaagactcagcagaggaaaccagttaggcctcacaagtgacctaaactgtgcttgatttgcagcagtcttaacttgagctacttcttacgaatatctttatattaaaaaaaagccttacgatcaaccaatcagaagtagtcaacaaacttataactatagtactagggactttccagtgggatagaccaagtaaggcaattgtataattgtaac

SEQ ID NO: 63969 - DNA, 601 bp, Human
agcaatcccaccccgacctggctggcctcacatgactggcccaagatgccactccaaggaatagtaccagcctctccgcaggaggctccagctccatcgcctgaatgacatgtctcctcaaataatcaagggaggattaagacctgggccaagctctggtaacttcttttttttttttttttttttgagatggagtctcactctgtcgcccaggctggagtccagtggcacgatctcggctcactgcaagctccatctcccaggttcacgccattctcctgcctcagcctcctgagtatcygggactacaggcgcccgccactccgcctggctaattttttggtatttttagtagagatggggtttcaccatgttagccaggatagtctcgatctcccaaagaccccaagtttcctcaaacaaaatgctttggggacaatggccgttccttccaacagggctctactcccctttctttccactcagcctaacagcatcctgattgtctccccaaaccagtctaagattattactgcccatttgccccagaaatgtttcggatttcaatgcattttcaggtggtctgataccatcaaggaga

SEQ ID NO: 63970 - DNA, 601 bp, Human
gttgcgagagggaccctgtgggagataactgaatcatgggggtggttcccccatcctgttctcatggtagtgaataaatctgacgaaatctgaagggtttctgttttcacttagctctcatttctcttgtctgccaccatgtaagatgtgcttttcaccttctgccatgattgtgaggcctccccagccatgtggaactgaatccattaaacttctctttctttgtaaattacccagtcttggttatgtctttatcagcagtgtgagaatagactaatacttgactcctatgtttaaactrtttattctttctttcatctgtttgtttcaaagaaaataacaagccttaattaaccctctcacgtctccttcaggttggacaagtttagtaatttcccctcttcctgcctaagaaacaaatctatagatgggaagcaatcccaccccgacctggctggcctcacatgactggcccaagatgccactccaaggaatagtaccagcctctccgcaggaggctccagctccatcgcctgaatgacatgtctcctcaaataatcaagggaggattaagacctgggccaagctctggtaacttctt

SEQ ID NO: 63971 - DNA, 601 bp, Human
aggaaacagtgagtaacttgggaagattatatagaggctactggaagaaatataccagcttcataatttatagttcccatttattgaataacagaaatgtgccaggcattgttctaaaagcttttcaagaagtacttaatttttataaacacagtaaggtagatattctaatgaaatcacctaataaaatcaccattttattaggttggtgcaaaaataattacagtttttcccatacttttaatggcaaaaccacagttacttttgcaccaacctaatagaaacaaggagacttgcccarggtcgtgcatcaattaagtgcctcaaattgaacccaggtctgcagaatctgaatttgtgcttttaggcattttcatttaattccacacttgttaattcttcatcagcagcagcattaatcagagtgtggtgttttccatccttataaggtcctgtctccttgtttacccaccccttcttggattatacgattatacagacacagcactctttttcatgatgctccaaccctaaaggtgagtggaaagcacaggagtctgtaactcccctggacccagaatcaaactgaaatgagatggtt

SEQ ID NO: 63972 - DNA, 601 bp, Human
cttgtcaccagatagctgtggtcacttctcgccgtgagcagtgtgcccacctctagttgaccctccacacgctttctagtgtgtgctgtggacaggaaagctagtaaccgagtttgttagagctgtgtgtaaaataaaagtaaaaaggctctgaagaaacatctcggagacctccgatgagtaacatgcattagcttctgagcaccttttgtgtgtcaggcattttggctgctcagagctctcagtcttgctctgctctgcactgcagggtagctgaattgagggaggtaagttctgcatrgtgaaatcaagagcgatttcaacttccaggagggaaggcaactgctatactcaaaaatccttctcttttgaaaaattaagaggactgattacattatatcactttgagcaggttcttatgaagtaaatagaggcaagattaacaatctctgggtctcaggaaacagtgagtaacttgggaagattatatagaggctactggaagaaatataccagcttcataatttatagttcccatttattgaataacagaaatgtgccaggcattgttctaaaagcttttcaagaagtacttaatttt

SEQ ID NO: 63973 - DNA, 601 bp, Human
tatttctcactcgcttttgaaggatacttacggaggttacagaattttaggtgctttggttttttctttcaatactttaagtatttctctccatgcctcttgcttgcatggtttctgggaaaagtcagatataattttatatttgctcttctataggtgaggggtgttttcctttggcttctttcaagtcatttttctttacctttgattttttgaagtttgaatatcacatgccttggtatagtttttgtttggttttgggttttggtacttatcctggtttgtgttctctgaatttccwgactctgtggtttaaaatctgacattaattttgggaaattctcagtcatttttgtttcaaatattgcttcttttcctttctctttttcttcttttactgctgatattctcgttacacatatgttacatcttttgtagttatcacacagttcttatttgtttctgtttgttttcattcacttccttttctctgttttttggttttgaaagtttgcattgtcatatcctcaagctcagagattcttttctcagccatgtccagtctactaatgagcccaccgaaggtagtcttcaatttgtt

SEQ ID NO: 63974 - DNA, 601 bp, Human
tatacacaagcacatatatatatacatatgcacacataaacaaatgcatggttgctatgattgtcttgaacaaattgctatctgttagaccaattaagattaagaaaaataaaaatttttattttacctttacttgttcattctctcatgctcttcctttatgtagatctgagtttctggcctacatcattttccttctctttaaagaacttcttttaatatttcttacaagatgggtctactggcaacaaattatctcaagttttgtttgagaaaatatttctcactcgcttttgaaggwtacttacggaggttacagaattttaggtgctttggttttttctttcaatactttaagtatttctctccatgcctcttgcttgcatggtttctgggaaaagtcagatataattttatatttgctcttctataggtgaggggtgttttcctttggcttctttcaagtcatttttctttacctttgattttttgaagtttgaatatcacatgccttggtatagtttttgtttggttttgggttttggtacttatcctggtttgtgttctctgaatttcctgactctgtggtttaaaatctgac

SEQ ID NO: 63975 - DNA, 601 bp, Human
ttaaatggtgtatttagatcactgacatttaaggtaatcattgatatagttggattagtatctaccatatttgttattgttttctatttgtcgtccttattctttgtttctagttttgtctttcactcattttctgacttttgtggtttgaactgagcattatatataatttcatctcctttcctttcataaagtatcaattatacttccttttttcttttttttttttttctggtagttgccctagagtttgcagtatacatttttaactaatccaagtccacttttaaataacactacrccgctttacaggtagtgattgtatcttataataacaaaatatttctaatttttccctcttgtttattttatcattgttgtcattcattttacttatacacaagcacatatatatatacatatgcacacataaacaaatgcatggttgctatgattgtcttgaacaaattgctatctgttagaccaattaagattaagaaaaataaaaatttttattttacctttacttgttcattctctcatgctcttcctttatgtagatctgagtttctggcctacatcattttccttctctttaaag

SEQ ID NO: 63976 - DNA, 601 bp, Human
gtcttttcatttaaagtaggtttcttgtagacaacatatagttgggtcttgttattttcatctactctaacaatctctgtcttttaaatggtgtatttagatcactgacatttaaggtaatcattgatatagttggattagtatctaccatatttgttattgttttctatttgtcgtccttattctttgtttctagttttgtctttcactcattttctgacttttgtggtttgaactgagcattatatataatttcatctcctttcctttcataaagtatcaattatacttccttttttcttttttttttttttctggtagttgccctagagtttgcagtatacatttttaactaatccaagtccacttttaaataacactacaccgctttacaggtagtgattgtatcttataataacaaaatatttctaatttttccctcttgtttattttatcattgttgtcattcattttacttatacacaagcacatatatatatacatatgcacacataaacaaatgcatggttgctatgattgtcttgaacaaattgctatctgttagaccaattaagattaagaaaaataaaaatttttattt

SEQ ID NO: 63977 - DNA, 601 bp, Human
tctactttttgtatgagttttggtagcttacatctttcaaggaattgttttatttcatctaggttatcaagtatatgagcatagagttgttcttaatattccttcattatccatttaatgtacatgagctctatagtgagatctttttattttgatattagtaatttggatcttctctttttttttttagttagcctggccagaggcttattaatttcattgatctttttaaggacccaaatttcagttatgttgattttctctattgattgtctgttttcaatgaaattgatttttgctscaaattttatttttcttcagcttactttgaatttaatttgcctttttttttctagttttctaaagtgggagcccagattgctgattttatttgtattttatttttattatttatttatttatttatttatttgaaatggagtctcactctgtcacccaggctggagtgcaatggcgcaatcttggctcactgcaacctccacttcctgggttcaagtgattctcctgcttcagcctcctgagtagctgggattacaggtgtgtgccaccatgcctggctaatttttgtatttttagtaga

SEQ ID NO: 63978 - DNA, 601 bp, Human
ttttaaatgtttgataggatttaccagtgaatctatctgggcctggtgctttctgtgttaaaggttattaattaatgattcaatttcttcaatagttataggcctattcagattatctactttttgtatgagttttggtagcttacatctttcaaggaattgttttatttcatctaggttatcaagtatatgagcatagagttgttcttaatattccttcattatccatttaatgtacatgagctctatagtgagatctttttattttgatattagtaatttggatcttctcttttttttyttagttagcctggccagaggcttattaatttcattgatctttttaaggacccaaatttcagttatgttgattttctctattgattgtctgttttcaatgaaattgatttttgctccaaattttatttttcttcagcttactttgaatttaatttgcctttttttttctagttttctaaagtgggagcccagattgctgattttatttgtattttatttttattatttatttatttatttatttatttgaaatggagtctcactctgtcacccaggctggagtgcaatggcgcaatcttgg

SEQ ID NO: 63979 - DNA, 601 bp, Human
ttacatttgttggagagtattaatgtaaaacgtaaatgataatgtgttttgaatttcaagttccacttatacattgctgttacatatgaaagtgattaacttttgtattgcctctgattctatcttctggaagagattgtggagaattgacataatttcttttttaaatgtttgataggatttaccagtgaatctatctgggcctggtgctttctgtgttaaaggttattaattaatgattcaatttcttcaatagttataggcctattcagattatctactttttgtatgagttttggtrgcttacatctttcaaggaattgttttatttcatctaggttatcaagtatatgagcatagagttgttcttaatattccttcattatccatttaatgtacatgagctctatagtgagatctttttattttgatattagtaatttggatcttctctttttttttttagttagcctggccagaggcttattaatttcattgatctttttaaggacccaaatttcagttatgttgattttctctattgattgtctgttttcaatgaaattgatttttgctccaaattttatttttcttcagctta

SEQ ID NO: 63980 - DNA, 601 bp, Human
gacaaatgcatgattacaggtgttgacccttatgatatcttacagaaagagttatactgccctaaaaaacctctgtaccctgactattcatccctctgtttcccctaatcactggcaaccactagtctttttactgcctccatggttttgtcttttctagaatttcatagaatagatatcatacaatatgtagcttctaaagattgatttctttcacttagtagtagcaattaaggtttgtctatgtcttttcatagcttgatagctcctttcattttggcactgaattaacattccattrtttggatgttctacagtttattcacctactgaaggacatcttggttgcatctaagttttggcaattatgagtaaggttgttgtaagcatgcctgtgcaggttttcatgtggcaataagttttaaattcctttgagtcagttccaaggtgtgtgatcactgaggtgcatgataagacatgttcagttttgtaagaaactgccaaattgtcttccacagtggttgtgcagtttgcattctcaccagcaatgaatgagagttcctgttgccccacatcctcaccagaatctgatgttgtcagt

SEQ ID NO: 63981 - DNA, 601 bp, Human
atgccctggcctacctgaagtgaaagtcctgcatcccactcacctggccctctgaggaaggacatatttcacagaagcgccttttccagacaaagtgccagtgcattattacttagatctattttcttgataattcattggtgtgttaatgacataaattactgtgatgtacagtaatgcatcactgccctcaaggtctattgaggttggataagactacattttctcatccccaccctcctgagattcctactttactaaataggctaaggcttctgcactggtgcctttaaaaaaaaargttttttttttagagtggtttaaggttcacagaaaaaactgagtggaagatgtagagaattcccaaatacccctatcccaacatacacgcacaacctttctcacttcagtatcctcaaaagtggcatatttgttacaactgatggacccacattgacacatcattatcacccaaagtccattaatttacatgaaggttcactcttggtgttgtacattccattggttttgacaaatgcatgattacaggtgttgacccttatgatatcttacagaaagagttatactgccctaaaaaacc

SEQ ID NO: 63982 - DNA, 601 bp, Human
ttccagggggagaagaactcacttactgagtggtctttcttctggttcatgcagcaatttggattattcccatctcctccacagcatccaccatcctagagagatgatgaacatctgcacaagggtatttacaaagagtatttgcagaagctaaggaatctagattactaatatccagaacactccagctctgacgcctgtcccagcatcaacagcaggggcatcctgcctgcctgttgcccagagtggaggcctccgctacattccctcttgcttggctaacgtagattaaacaactcayggataaacaaataggagcaacaaggccactgaatttcaggaacttttctccataaaagctaggtcctactttatcaaaacctatcccttatgcccatttctcttcttcagtgctgcttcctcaggaagcgtctatgagggatattcccattggctctctcaagactcaagaggcttgacttccagatcagcaaggttctaggggcgtggctggtgtctcccaggctgggctctctgcaggaccctgccaaaggatgtccaagacgggtgctgagcccagcactgtgtccagccagtgtgc

SEQ ID NO: 63983 - DNA, 601 bp, Human
ctaacgtgcaccatcaccatccccacagtctgccatcaccgactcaccgtaggttcctcttccagcccccaccgccagggacatggagctcgtgcactgactcctctaagtctcagattacccccaggcttccagggggagaagaactcacttactgagtggtctttcttctggttcatgcagcaatttggattattcccatctcctccacagcatccaccatcctagagagatgatgaacatctgcacaagggtatttacaaagagtatttgcagaagctaaggaatctagattactaayatccagaacactccagctctgacgcctgtcccagcatcaacagcaggggcatcctgcctgcctgttgcccagagtggaggcctccgctacattccctcttgcttggctaacgtagattaaacaactcacggataaacaaataggagcaacaaggccactgaatttcaggaacttttctccataaaagctaggtcctactttatcaaaacctatcccttatgcccatttctcttcttcagtgctgcttcctcaggaagcgtctatgagggatattcccattggctctctcaagactcaaga

SEQ ID NO: 63984 - DNA, 601 bp, Human
tcctctggtttgaataaagatggcgagaggctgacctatggggaaagagaacaggtaggtgatgcagtatctcctcctttcaaacacccaagaggaccaattcagcctttccttccagcaagctcattcccagccccctgcaggctgcaagaggagcaggtaatccctgggaggcaggaatgagagagtctcagttacaggacccggggctaacgtgcaccatcaccatccccacagtctgccatcaccgactcaccgtaggttcctcttccagcccccaccgccagggacatggagctcrtgcactgactcctctaagtctcagattacccccaggcttccagggggagaagaactcacttactgagtggtctttcttctggttcatgcagcaatttggattattcccatctcctccacagcatccaccatcctagagagatgatgaacatctgcacaagggtatttacaaagagtatttgcagaagctaaggaatctagattactaatatccagaacactccagctctgacgcctgtcccagcatcaacagcaggggcatcctgcctgcctgttgcccagagtggaggcctccgctaca

SEQ ID NO: 63985 - DNA, 601 bp, Human
ggaaatgcagttttcttactacactgtctccctcttcctactgtcattcctcttataaattgctttaagtcctcaatgggatgttttactgacattcagaatgaaaatatctaacaggaagaagcaaggggaagtaatatgttcagaggcaggaactccattgggactagtctttacaagacttccatgaaggaggcattatgagcctcattttcaccagtgaaagaagatcctgagggtcaaggaggttatgggacctgctgaaggtcacctgccatgaggggtccccaacagacctggmtgaaagcccagattccttgcagtgccccataatatctccagggggcaccatggacaaggcatgagaagggagggagggagggagagagggagggagggagggagagagggagggagggagggagggaagaaaggaaggaaggaaggaaggaaggaaggaaggaaggaaggaaggaaggaaggaaggagtttgttataaggggatgcctaggaaggctggctttagtgcttgcaggaagacactgggctgagaacgaagccctcaaatcgaactgccagtattttcaaagtttcacagtcc

SEQ ID NO: 63986 - DNA, 601 bp, Human
ataatcgtaataaaaacatgaaagtttaacattaaaacaaaaaaggaaaatgggagggaaaacttcaaatctgtcctccagttcccactatctgcctgagttcttcaagttgtctggctttgcggggccacacatctgtgtgtggtttctggccttcctgactaaatgagtcagaagcctctgttaaacaagtgtgcctctgttccttagacccagttggctcagcacctctcccagccctgccaacagtgtatagatggaaaaggttaaaaaagaaatacctgtgacctctttgcccccscttccccccaggtgctgtttaggatttctgaagggggccctaggctttgtggatccccagattccagaatcttcaaagctcccttcagaaatcctagaagcacctgaataccagccccttttgaatatcagcttccaggacaaagaacacagattgaagcagcaagttctacgttactaaggttttctctttgtctgccttcccccaacactctgcgttgactggaggtgactatgctattggggtatgtataagagagaagggagtggcgcagaaggaaatggtcttgagaaatcattt

SEQ ID NO: 63987 - DNA, 601 bp, Human
cttgaacttcatctcaatgcctagagagaaacaagaagctgaagttgtaggcccattgttgtatcaccagggcaggccttagcagcttttctcaccattacacacaggatatatgacatatccacaatcataatatgctctctggtgactgtaggtgtctgggaataggaaactcagtagaccaggggtgggattagatgcagtctttggactgtcagcccaaaactaggtctttctttccctctcaaaaaacctacctgaattcaaatgaaatgagtttgaattcactctagtgtgtgtttgtgtgtgtgtgtgtgtgtgtgtgtgtgtgtgtgtttgtgtacattagaaaacacaggaaattaaggtatgtcaggaacccttctaagcactttccctattttaacttaattaatgctcacaacaaccctatgaggtactacgatttttctgtttatagatgaagaagctgaggcacagaaaagttaagtttcttgcccaaatcacacagctaagaataaccaaatttcagtactggaatgattattcgtgttggggtataatcgtaataaaaacatgaaagtttaacattaaaacaaaa

SEQ ID NO: 63988 - DNA, 601 bp, Human
atagtttatgctgaacccctgctttccttctgggagtccagactttaggcacatgctagtagaggctgcctatgtgatgagctcccaagaaaacctctgtcgctgagcctctaacaagctttcctggtaggcaaggcatcacttgtgttgtcacaacttattgctggaggaattaagcatgcactgtgtggctccactgggagaagtctctggaagattggacctggttcctccagactttgctcccatgtatcttttccctttgctgattttgcatcctcctgctataataagtcatagscaggaatatgacggcatgctgaatcctctcagtgaatatcagagccggggtggtcttggggaccctctgacaaggcagagatgcactggagcacataattgtagagcatttccaccgtacagacagaacagatgcaaataactccaggagcactgataacagcaaaatgaagtacttacgaagtgatgaattttgagtatttattccttttgttttgaatataatttatttcattgtaattttatacaattttatttttatttttattttttgagacagggtctcactctgtcacccagg

SEQ ID NO: 63989 - DNA, 601 bp, Human
aaaaaaaaattagccaggtgtggtggtgcacacctgtggtctcggctacttgggagggtgaagtgagaggatcacttgagcctgggacattgaggccacactgagccgtgatcatgccaccacactccagcctgggccagcaggcagagtgagaatctgtctcaaaaaaaaagagaagaaagagaaagaaaggaagaaagaaagaaagaaagaaagaaagaaagaaagaaagaaagaaagaaagaaaggaaggaaggaaggaaggaaggaaggaaggaaggaaggaaggaaggaaggaagsaagcaagcaagcaaagcaagaaagcaagcaagaaagaaaatatcactatcacactatgaaacaatcactgcccttgtgctttaaacacattttccttcctgggttcgagccaggatctttctttaaggataggaggagagcatgagctattttccaggaaagagccacctgacttcaggccctttctgtgtcaggttccttttgaggtctgtactcactctggcaccacaaattctgatgaacaccaaaattagcaggtttagggagaggagatctattggaaaaagcacaatgaggccc

SEQ ID NO: 63990 - DNA, 601 bp, Human
ttttaaaagaccaccaaaataataacagttaaaatctatcaagtcctcacaatgtgccaggcaacatcttaagtgttttatatgaattctcacttttaatttaaatttgaaaatgtagtaagcaaaattcctacacccatttaccaatgagaaaactgaggcacacggagattaagtaacttgacttatgttatctatttggtaaatgacaaagccaggaatttcggaaccaaggaaccaaactccaagttaagctttattgatcctatgtgggtgctgtaaggatttcctaggataatgytagtgaagtgttcggtacaatttctgttatataataaccatagaaatagtaatagtagtagcagtagtactaatcacagccatagtggtagcaatagtagcaataacagagcagtagtagtagcatcagcatcaatactactagtaataatactagcaacagcaataatagttgcagtagtggtaacaagatagatagtagtagtagaagtagtaatagtcatagaagcagttgtcatagaatcaacagcaacagtagtaataatagtagtaacagaagcaatgccaaaaagtagcagtc

SEQ ID NO: 63991 - DNA, 601 bp, Human
caaaatttggcttggatacttagagttgggtgactttaggcaactttaattaatctcattgagcctgtttcctcatcttcaaaaatagatacaattttaaaagaccaccaaaataataacagttaaaatctatcaagtcctcacaatgtgccaggcaacatcttaagtgttttatatgaattctcacttttaatttaaatttgaaaatgtagtaagcaaaattcctacacccatttaccaatgagaaaactgaggcacacggagattaagtaacttgacttatgttatctatttggtaaaygacaaagccaggaatttcggaaccaaggaaccaaactccaagttaagctttattgatcctatgtgggtgctgtaaggatttcctaggataatgttagtgaagtgttcggtacaatttctgttatataataaccatagaaatagtaatagtagtagcagtagtactaatcacagccatagtggtagcaatagtagcaataacagagcagtagtagtagcatcagcatcaatactactagtaataatactagcaacagcaataatagttgcagtagtggtaacaagatagatagtagtagta

SEQ ID NO: 63992 - DNA, 601 bp, Human
ccaacttcttatatccccaaacatgctacagagagcctgtgcctggccaggccccactcacgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcctgccagagagcagggcgtgggacagcgctcccgcccagccctccagacccctttgtgtagagcygtgtgcccagggcctcggagctgtacaaagcttggttcaaaatttggcttggatacttagagttgggtgactttaggcaactttaattaatctcattgagcctgtttcctcatcttcaaaaatagatacaattttaaaagaccaccaaaataataacagttaaaatctatcaagtcctcacaatgtgccaggcaacatcttaagtgttttatatgaattctcacttttaatttaaatttgaaaatgtagtaagcaaaattcctacacccatttaccaatgagaaaactgaggcacacgga

SEQ ID NO: 63993 - DNA, 601 bp, Human
gacactgagctgccccctagcacctcatgcaacctggcataggataggtgcaaaataaattcttggtgaacaaatctcaggagctgggcccacctcagcctgcactctctcttgaagacatatcctatggattccacggcctcctggctattgcagccccacctgacattcccattccaccctacatactcatcacactctgcattccctttctttttttcctttctttctttctttctttctttctttctttttttttttttttttttgagacagagtttcgctcttgtagcccaggctrgagtgcaatggcatgatcttggctcactgcaacctccacctcccgagttcaagtgattctcctgcctcagcttcccacgtagctgagattacagggcaagaacctctgtcgccaaagcccagcccagcactctgcctctaagccagctggtcactcccatttccaagattcttgtgctgtgaccctggtccctgctattctgccctcagatgtccagaggagaggagcaaatttactacccagaccaacttcttatatccccaaacatgctacagagagcctgtgcctggccaggcccca

SEQ ID NO: 63994 - DNA, 601 bp, Human
tactcacttggaagagctggacatcggctggggggtctttctgaaacagtaaagttgcactggcgaaagtggggtccagtttaccacacttctgtggagacaagaaaacagaggtgaccaggattatatttcaatcactgattccttccttgcttgtccataaaaatgaccaaactgataactgatccccttgtctcttcacttcatacgcctttgagtgctgactggatccctcagcatccaaacacgggctctgagagctcagaatttaagagcagcctcagcttcactgctagccccmcagtggaccctgtagactgaatggtctgtactttctccaacaccccaaactctttccctccttcttgcatttatgcctgctgctgtctctgttgggaatatccttctcctccttccttgccctcctcaattctgtgggaagcatttaatgatatggaaaatgttcacaatataatcccaatggaagcaaagggggatttaaagcgctatatgcagtgtggtcccaagtctatttagaaaataatatatccacatcaaaagataggaagatgacagatattgatagatggatggaaggaca

SEQ ID NO: 63995 - DNA, 601 bp, Human
tctttatgcttttctgtattttctaaaatgttttaaattattgatctcataataaagttctgtttttgttttacaaagtaatcataacaatggctaatgtttattgagtgtttcaccatatcccagggaccatctaagcaatttacttttattaacacatttaatcctcaaaaccatcttatgaaacaggtatgtgattatccacatttgcaggtgggtataattaacttgcttaagaggcacacaagggaataagtaagttgttcaaggttgcacaattaggaaatggcagagtgtggayacaaattcaggcagtcaggttccagagttcatgcctgggacgactacactctagtgtgcagggggcagtaaattgtggcatgggggccaacacaagcccactgcctgtttttgtaaataaagttttattggaaggcaacacactcattcattcctgtttttcctgtggctgcttttgtgctacaatgacagagttgagaagttgcaatagaaaccatctggcccacaaaatctaaaatgttttcaggaaaagtttgctgaccctttacgtagcacctctcaaaaagctggagcagataga

SEQ ID NO: 63996 - DNA, 601 bp, Human
caaagtcactaagccagaaagcagtgtgactgggattattggaactgaggttaagttaggagggttaagctctgtcctgccaaacccacttccaagtgtgtgcagcccaggaaggccccaactgttgcagttacaacaatgtcaaccccctcatcctcttccatccattcacacattgcttggatggaggtggtttgagcgtagacaatgtgggttatggtattgtcaatatgggctcaagacaaggaacaaaagggaaagaatgtatcctatagctgccaaccatgggaacttaaacacttttttttttgttttcagggacctggacaagtttatttatctgttagatttcagctgtgcctggttcaccattcctggagggatcccgtctccaaactaggagcagcagcagagaaaagaccaatgacaaggaaacctgattcctagtccacacagtgggcccaaggaagggcttttcctagctgatctgctcagcagggtatgtgtctaacgcccaccaggaagtgaagttcacactctctggcttgaacatcctgaggcagcacaacacagttgctcacgttgcttggcttcaaattcc

SEQ ID NO: 63997 - DNA, 601 bp, Human
ttaggtagtttttccaaagtcactaagccagaaagcagtgtgactgggattattggaactgaggttaagttaggagggttaagctctgtcctgccaaacccacttccaagtgtgtgcagcccaggaaggccccaactgttgcagttacaacaatgtcaaccccctcatcctcttccatccattcacacattgcttggatggaggtggtttgagcgtagacaatgtgggttatggtattgtcaatatgggctcaagacaaggaacaaaagggaaagaatgtatcctatagctgccaaccatrggaacttaaacacttttttttttgttttcagggacctggacaagtttatttatctgttagatttcagctgtgcctggttcaccattcctggagggatcccgtctccaaactaggagcagcagcagagaaaagaccaatgacaaggaaacctgattcctagtccacacagtgggcccaaggaagggcttttcctagctgatctgctcagcagggtatgtgtctaacgcccaccaggaagtgaagttcacactctctggcttgaacatcctgaggcagcacaacacagttgctcacgttgct

SEQ ID NO: 63998 - DNA, 601 bp, Human
catggagcccggctgtgccactgatccaatggccctgaacagcttcataaagctggatttgtctccccacattcattgtgctatcccagcatgacagggcatcctaccataattaggcaacacgaaccgcaaagggagaatgcccgactatatgatcaaggataacagtctcaactatgtactcatcacactggcacatgcccccatggggaaatagggcaacacatttcagggaaaggtatgtaaactgccctgaagttctaaccatcttccaaatgcttaatcctcacaagaaaccctsaaagtacttatcctaattcccattttatgtttggggaaactcagactcaaggaagttaggtagtttttccaaagtcactaagccagaaagcagtgtgactgggattattggaactgaggttaagttaggagggttaagctctgtcctgccaaacccacttccaagtgtgtgcagcccaggaaggccccaactgttgcagttacaacaatgtcaaccccctcatcctcttccatccattcacacattgcttggatggaggtggtttgagcgtagacaatgtgggttatggtattgtcaata

SEQ ID NO: 63999 - DNA, 601 bp, Human
ggtagggggaggatgagaatttatgcggttagaggcctggcagacctaaggctgtcaggcatatgtggctgttatcatccctagttggtcttccggatcagaatactctagaatctctctagaatcattaggtccagcctagagacaggagagtagagattaagataactgaagctctttcccatccaactgtctcctattttgctacaaacgtaagagggaatcttctgtcaggaaatgtccagaaatcacttccctgcttcagggttcaatgcatatctcttgaatttaatttgcaaascagggccaccccattcccactgcggcatggaacagctctacctgacacaacattatctgcttcggaaaaccccttctttaggtcccctttctcgatcttcagctcaggtccataaaaggagttgttctttatagcatcctgaggatcacaaagaagtttcagaaatgtggcttttagcagggagggaaagataggttctgattagggaaagagaagctctctgaattgttgactctctctttccataaatgaatctctatatgcttcacatacagacttgaagtaagctctactatagcc

SEQ ID NO: 64000 - DNA, 601 bp, Human
aaagcctcctcccattctcttcactcgaaccacaatccggtttgctggaacccccaacatttttgcaacaaagctctgtgagtgaaagacagaacattcgcactgaatgcattacctgaacttatttcaggcctaaggcagagcctgtccaacatgcatggacctaattactgctgcgaattctgaaattccttgattgaaaatcccatgcagctttgtggttagtgatgctggggcctgccagactgaattcagcattggtttttaaccagagggcaagcagttggtcacagaatacttytagaaacttattctgtctgaccaggtgaccagcgactggtagatcatgagagtaggaccagctgccgaaaacactggcaaccgctgtcacattacaggcagtagagaaacaaagaatatttgagctgctgtagataatttagtggtccctgtggctatgacttaatccaacaccttcattttacatatgaggaaactgaggcaggatatgacttgaccgaggccataggcactgaaatgataactgccaacatgtaccaaactctagtctaaatattaaaactcatctaataattatgac

SEQ ID NO: 64001 - DNA, 601 bp, Human
gcatgtcctcatcacggtccagcatgcatcgcacagggcggccggtcctgggggttaccgacagtgttagaagcctgtgagccttcaacagcagctcagccctgcaagtctcagaataaaaacagccgggaagccatcttttccacctgcacgctgagcagacctgtacagggctgctttgccatctaggcactgtgatagacaaggtggagaatataaggaagcgaggtatgtgctttcatttagagagctcacagccagtaggagagatcagaggtggatacctgtgccagaccacaayggaacaggcgatgttaccctcccactatgcccaagggttctaaaaacagagggctgtgagaattcaaagcagggggaaactaattctaacagggggaagtcctgaaaaccttcctggcacagacagccttattcttcttcccagagccagatgggagaaacaggctttggaactcacttatatgcagccagggccactgccgtggacaccacagtgctccgggtctccttgcctccaaagcctcctcccattctcttcactcgaaccacaatccggtttgctggaacccccaacattttt

SEQ ID NO: 64002 - DNA, 601 bp, Human
cggtcccagctttcctcacaaaatggctcatcccgccccagcacagccccaacatctagaaccttgtatctggccaggaagggatgtctgccaccagttatcagcatgtcctcatcacggtccagcatgcatcgcacagggcggccggtcctgggggttaccgacagtgttagaagcctgtgagccttcaacagcagctcagccctgcaagtctcagaataaaaacagccgggaagccatcttttccacctgcacgctgagcagacctgtacagggctgctttgccatctaggcactgtgmtagacaaggtggagaatataaggaagcgaggtatgtgctttcatttagagagctcacagccagtaggagagatcagaggtggatacctgtgccagaccacaacggaacaggcgatgttaccctcccactatgcccaagggttctaaaaacagagggctgtgagaattcaaagcagggggaaactaattctaacagggggaagtcctgaaaaccttcctggcacagacagccttattcttcttcccagagccagatgggagaaacaggctttggaactcacttatatgcagccagggccac

SEQ ID NO: 64003 - DNA, 601 bp, Human
caggcctgtgatcatgttaatgttgggctaccaagcgcgatggtttaccctgagtatgctggtgaatcatgtttctgagcctgaccagactcagaacacagcaaatccacagaagtcacgaatgccacccttgggagatggggtgccagcctccctcagcactacctttctgtgttgctgttagcctatttgaatttctcttcttgctatatcttatttgaacttctacagataggcaaaaagtaggagtgcagctcaggatgcctggacattcggtcccagctttcctcacaaaatggcwcatcccgccccagcacagccccaacatctagaaccttgtatctggccaggaagggatgtctgccaccagttatcagcatgtcctcatcacggtccagcatgcatcgcacagggcggccggtcctgggggttaccgacagtgttagaagcctgtgagccttcaacagcagctcagccctgcaagtctcagaataaaaacagccgggaagccatcttttccacctgcacgctgagcagacctgtacagggctgctttgccatctaggcactgtgatagacaaggtggagaatataaggaagc

SEQ ID NO: 64004 - DNA, 601 bp, Human
gcctgtccaggcccctgggaagttttatttctcacagtaaattactaagctgtcattccaatttttacatcaggcctgtgatcatgttaatgttgggctaccaagcgcgatggtttaccctgagtatgctggtgaatcatgtttctgagcctgaccagactcagaacacagcaaatccacagaagtcacgaatgccacccttgggagatggggtgccagcctccctcagcactacctttctgtgttgctgttagcctatttgaatttctcttcttgctatatcttatttgaacttctacarataggcaaaaagtaggagtgcagctcaggatgcctggacattcggtcccagctttcctcacaaaatggctcatcccgccccagcacagccccaacatctagaaccttgtatctggccaggaagggatgtctgccaccagttatcagcatgtcctcatcacggtccagcatgcatcgcacagggcggccggtcctgggggttaccgacagtgttagaagcctgtgagccttcaacagcagctcagccctgcaagtctcagaataaaaacagccgggaagccatcttttccacctgcacgct

SEQ ID NO: 64005 - DNA, 601 bp, Human
ataaacagaacaccacatcatcccgtgaaaaaaaggtgaccttcagaagtcaccagaaggtaacaagtgaagaagagaggaactgacctctccccagtggcacacacttggctccccacccctggaagcccttgtccccacacctcttcctcctgctaccggcacctggcttctggtctcggaggggagtaaggaggttggaaagagaaggctggtcacgatagggcgggggggaagcgcagggaagagaaactaggaaagataccggactgtctcctcacagattttggtcagaagacamaaaaagtttcatttcacaggagcacgcaaatccttgaccttatgtacactgttaaaataccctttacaggctgttttacacacacggaaactgggaccccagaagatcaaggaatcctcttcaggcccacaagaatttggggctaagagaaatataatcccttgctgggagttaaatcatgaaacaaactcagaataggtcaaaggccatgttcaaggccaattcatggagagagggctctcaggtttctagagctaggcggagccccataaggctttgctgatgtgtacagggaaaggg

SEQ ID NO: 64006 - DNA, 601 bp, Human
gcagggactggggaggcctgtgcctgcgtgggaacaggctgacctcgaagtcagctctgggtgcaggggcggctgcaggtcctactcacactctgagagagatcctgggtgttccccacattgctgaagtggtccacctcaagagccacaactgtcccagtcttcatgaagccaacctgataaaaggagaaaggagagggatttatcataagtcccgtttcccccacctctctgtctccctctgatcctccctcccacttatgtcacctggaggaaataaacagaacaccacatcatcccrtgaaaaaaaggtgaccttcagaagtcaccagaaggtaacaagtgaagaagagaggaactgacctctccccagtggcacacacttggctccccacccctggaagcccttgtccccacacctcttcctcctgctaccggcacctggcttctggtctcggaggggagtaaggaggttggaaagagaaggctggtcacgatagggcgggggggaagcgcagggaagagaaactaggaaagataccggactgtctcctcacagattttggtcagaagacacaaaaagtttcatttcacaggagca

SEQ ID NO: 64007 - DNA, 601 bp, Human
taaagttccttttatttaaacaattgtagaatattagtaataataaagcccagctctcccagtgcctgccgggccgcctccgcccatgaaaatgcgatcatttcttaaaatgttaagctcaccacagattcagcaattctattcctaggaatttagtcaagagaaatcaaaatacatgtctacataaggctagtatgagagtgttcagagcagtattatgcataaaagcaaaaaactggaaacaacacaaatgtccatcaagtggtgaatgggaaacaacatatggtatatccctatgatrgaatattattcatcaatgaacaggagtgacgtagtgatacatgctataatatagatgggccggatgcagtggttcacgcctgtaatcccagcactttgggaggctgaggagggctgattacttgaagtcaggagttcgagaccagcctcatcaacatggtgaaaccctgtctctactaaaaatacaaaaattagccaggcataggggtgcatgcctgtaatcccagctactcgggaggctgagacaggagaatcgcttgaagctggaggcagaggttgcagtgagccaagatcgtgccac

SEQ ID NO: 64008 - DNA, 601 bp, Human
tattttattaaagtgacatctatagaagcaaatatctaaacatttttaatatgagttttacctgtcatgtaaattcctcattgtcacaagcctaattcaattagctcgtcataattcctaaagtaatttactaaaattcagctcatcttgacataggttcttgagccagtattccaaactgtttcattataaagttccttttatttaaacaattgtagaatattagtaataataaagcccagctctcccagtgcctgccgggccgcctccgcccatgaaaatgcgatcatttcttaaaatsttaagctcaccacagattcagcaattctattcctaggaatttagtcaagagaaatcaaaatacatgtctacataaggctagtatgagagtgttcagagcagtattatgcataaaagcaaaaaactggaaacaacacaaatgtccatcaagtggtgaatgggaaacaacatatggtatatccctatgatggaatattattcatcaatgaacaggagtgacgtagtgatacatgctataatatagatgggccggatgcagtggttcacgcctgtaatcccagcactttgggaggctgaggag

SEQ ID NO: 64009 - DNA, 601 bp, Human
gcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaagaaacaaaaggctagatatagaaattctactttgggatattttaaactccttaaatttatcctataatgagtatatacttgctctcattacaaatatatatatatatataactgatctttacaattacaaatgagcacaggactgactatgttgcttttctgccttttggggtgagtagagcaggaagataatcagcaagctttcctcagagcactaggcagcctttaactgaaggtgctatgttcgaggcaccattgactatgatttgggatcacaggggagcagatgtactagtggaaccaggattcagaaaagatgtctggatccaaaaaggggaggctctctgcaagtcatagatgaagagaaaaaccataacatctcaagctactgatcc

SEQ ID NO: 64010 - DNA, 601 bp, Human
ttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaagaaacaaaaggctagatatagaaattctactttgggatattttaaactccttaaatttatcctataatgagtatatacttgctctcattacaaatatatatatatatataactgatctttacaattacaaatgagcacaggactgactatgttgcttttctgccttttggggtgagtagagcaggaagataatcagcaagctttcctcagagcactaggcagcctttaactgaaggtgctatgttcgaggcaccattgactatgatttgggatcacaggggagcagatgtactagtggaaccaggattcagaaaagatgtctggatccaaaaaggggaggctctctgcaagtcatagatgaagagaaaaaccataacatctcaagctactga

SEQ ID NO: 64011 - DNA, 601 bp, Human
tttactttcaataaaaagacaatcagcaatattttattttggacacttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaagaaacaaaaggctagatatagaaattctactttgggatattttaawctccttaaatttatcctataatgagtatatacttgctctcattacaaatatatatatatatataactgatctttacaattacaaatgagcacaggactgactatgttgcttttctgccttttggggtgagtagagcaggaagataatcagcaagctttcctcagagcactaggcagcctttaactgaaggtgctatgttcgaggcaccattgactatgatttgggatcacaggggagcagatgtactagtggaaccaggattcagaaaagatgtctggatccaaaaaggggaggctctct

SEQ ID NO: 64012 - DNA, 601 bp, Human
tgacttacagaaggcaggttggcttaatgaggaaatttactttcaataaaaagacaatcagcaatattttattttggacacttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaagaaacaaaagrctagatatagaaattctactttgggatattttaaactccttaaatttatcctataatgagtatatacttgctctcattacaaatatatatatatatataactgatctttacaattacaaatgagcacaggactgactatgttgcttttctgccttttggggtgagtagagcaggaagataatcagcaagctttcctcagagcactaggcagcctttaactgaaggtgctatgttcgaggcaccattgactatgatttgggatcacaggggagcagatgtactagtggaaccaggattcag

SEQ ID NO: 64013 - DNA, 601 bp, Human
tatctccagcttcagtttattccaacattaatttatgaaaggacagttattaaaatcagccatttctcagactgtaactttgaaatcataagaaatggacaattaagctcactagtcaaaatcttgattcaagtgatgatccaatagcttataaatgtcttcaataaactgagctttgaagcagaacaaaaaacagaaaaatctaaaacctctctatcccaagcaccaataatggaggctaagcaattatacctacaaatccttaatgacaggtctctcctaatgaaaaatcctgagattyaagcactatgacttacagaaggcaggttggcttaatgaggaaatttactttcaataaaaagacaatcagcaatattttattttggacacttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctctgatctttcagattaatctttcatgtgtgaatttaatggtaattgcttgcaaatattcatgaaaga

SEQ ID NO: 64014 - DNA, 601 bp, Human
atttagtagctattggacataaaacaggtaattatttcagactttagccagttttcatgaagtatttatctccagcttcagtttattccaacattaatttatgaaaggacagttattaaaatcagccatttctcagactgtaactttgaaatcataagaaatggacaattaagctcactagtcaaaatcttgattcaagtgatgatccaatagcttataaatgtcttcaataaactgagctttgaagcagaacaaaaaacagaaaaatctaaaacctctctatcccaagcaccaataatgraggctaagcaattatacctacaaatccttaatgacaggtctctcctaatgaaaaatcctgagatttaagcactatgacttacagaaggcaggttggcttaatgaggaaatttactttcaataaaaagacaatcagcaatattttattttggacacttagcatttcacagatcctcaatatgttttgaggtaggtcaaatattaatagtgtattttacaaacaaaactcaagcagatgctttgttacttgtcccagaccacagaagcagttctatcatggtcaggaataatacggtctctc

SEQ ID NO: 64015 - DNA, 601 bp, Human
tcaggtgtccactagggttcttggaatgtatctcctgcagataaggggagatgactgtataacaaggagttcagtactatctgatgtttcaggcatccactgggagtcttggaatgtatctcttgcagataaggggagactactgtgttacatttcagcttccataaaactttactaatttggattaagaacacaagcctgatttagtaaaaagtatccataaatattcagaggtatagttttgtttcatcaagtaaaaagagcaactaattccaactgttgaagtagtaacaagtaaagrcttcaccaggcttgccttgatgaagaattaagacatatttttaggtcaacagcacaagattgctgaataacttgtatgctacaaacacgctccttccactcatcgtaacagcccagcaatctttactattccaacttgctgagaaccatgtcagatgttgccttcaagaatgaaatgtttctcaaaactgttctatcaaatttagtagctattggacataaaacaggtaattatttcagactttagccagttttcatgaagtatttatctccagcttcagtttattccaacattaattta

SEQ ID NO: 64016 - DNA, 601 bp, Human
aggagcagtaaccccctttatctgcaatttcactttccgtagtttgttaaccaaggaagccttggtccaaacatattatgtggaaaattccagaaataaacaatttatgttttaaatcacaagtcggccgggcaaggtggctcatgcctataatcccagcactttgggaggatgaggcgggtggatcacccgaggtcagaagttcgagaccagcctggccaacctggtgaaaccccgtctctactaaaaatgcaaaaattagctgggcgtggtggggcagggcacttgtaatcccagctayttgggaggctgaggcaggagaatcacttgaacccaggaggcggaggttgcagtgagccaagactgcaccactgcactccagcctgggtgacagagtgagactccatctcaaaacaaaaaataaataaaataaatcacaagctgtcctgagtgatgaaatctgatgatctcctgctctgtcctgtgcgggatgtgaatcttccctttgtcctgcttatccacactgtgtactacctgccccttagccgcttagtcccgccttggttgtcagattgaaaaaacatagtctataaagggttca

SEQ ID NO: 64017 - DNA, 601 bp, Human
aatatattaattataccatgaccaagctggattcattccaaggacagtggttggttcagtgtttaaaaaaatcaatgaatacaatccacaatattaacaagctaaagaagaaaaaatcacatgatcatatcagtcagtgcagaaaaagcatttgacaaaattcaacacccattcattataaagatgctcagaaaacactaatggaagaaaactttcttaatctgatcatgagtatctacaaaaaacaaacaaacaaacaaaaccctaccaataacatatttaatggtgaaagactggatgycttccccttaagaataaaaacaaaggaaggatatatgacctatagttctgcaaggtctggctagccatctcagtatgtaaagaaaaggagatgaaaacatgcagattggaaaggaagaaaaaaaccatccctatttgcagatgataatgattgtctgcagagaaaatcccaaggaatctacagaagaaatcctagaactcataaatgagttctgcaaggtcacaggatataagaaacacaaactgaaatcacaatgagctatcacttcacacccactaattctagtgggtaaagacagac

SEQ ID NO: 64018 - DNA, 601 bp, Human
acagtagaacaatatggtgactataatatttttaaatatatgataatttatcgtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatgagatagatamtttgaatagtcctagaactattaaggaaatttaatcaatagtgtttttttgtttgtttctttttttttcaagtattatacttttaagctctaggacagatcaacgagacagaaagttaacaaggatatccaggaattgaactcagctctgcatcaagctgacgtaatagacatctacagaactcttcaccccaaatcaacggaatgtacattcttctcagcaccacatcacacttattccaaaattgaccacatagttggaagtaaagcactcctcagcaaatgtaaaagaacagaaatt

SEQ ID NO: 64019 - DNA, 601 bp, Human
accaaatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaacatctagcatacagtagaacaatatggtgactataatatttttaaatatatgataatttatcrtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatgagatagataatttgaatagtcctagaactattaaggaaatttaatcaatagtgtttttttgt

SEQ ID NO: 64020 - DNA, 601 bp, Human
acagaaaaacaaagtgaagccacaaattaccaaatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaacatctagcatacagtagaacaatatggtgactataatatttttaaatatatgataatttatcgtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatgagatagataatttgaatagtcctagaactattaa

SEQ ID NO: 64021 - DNA, 601 bp, Human
aagacagaaaaacaaagtgaagccacaaattaccaaatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaacatctagcatacagtagaacaatatggtgactataatatttttaaatatatgataatttatcgtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatgagatagataatttgaatagtcctagaactat

SEQ ID NO: 64022 - DNA, 601 bp, Human
aaaagagcaataaaattgacaaacctctggcaagacagaaaaacaaagtgaagccacaaattaccaaatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaayatctagcatacagtagaacaatatggtgactataatatttttaaatatatgataatttatcgtatatttaaaaataaataagagtagaattgaaatgttccctaacacagaaaaatgataaattcttgaggtgatagatattgacgttaccctgatttgtttatcctgatacactgtatgcctgtatcaaaacatcatatgtatcctataaatatatacaactactatgtaccaataataatgaaaaacaaaacatttttaaatgaatgtctcaaaatacaaaactaccacttcagtatg

SEQ ID NO: 64023 - DNA, 601 bp, Human
gtctaaagtagtgctgaggggaaactttacagcactaaattgaatacattaaaaaagaggaaaacattctcagatagttaatttaagctttcaactcaagaacctagaaaaagagaagcaaaataaatccaaagcaaacagagtgaacgaaataataaggataagagcagaaatcagtgaaattgaaaacaaacacaatagagaaaatcaatgaaacaaaaacccgggtctttaaaaagagcaataaaattgacaaacctctggcaagacagaaaaacaaagtgaagccacaaattaccawatcaggattgaaacacgggctatcactacagaccctgaagacatcaaaagagaaataagaacacactatgaacgattctacacacatgaattttttaataacttagacaaaattaaattgaattcatggagataaagagtagaatgatgtttaccagaggctggggagggtagggggacagaggataaaatggggatggttaatacatataaaaatatagttagaatgagtaacatctagcatacagtagaacaatatggtgactataatatttttaaatatatgataatttatcgtata

SEQ ID NO: 64024 - DNA, 601 bp, Human
ttacagttggagatttcaatgctcctctctcaaaattggtagcaaaaaatagacagaaaatcaggaagggtatagaagaactcaacaccaccatcaggatctagtggatatttatagcacattatacatgtggtaggaaaaagaaatgcctccccaaagatatattcactttctaatcatggaacctgtaaatactaccttatatggcaaaatatgtgataaagttaaggatctggagagaagtagcttatcctgaaccattggagtggatcctaaatgcaatcacatgtctctgtaagasagaagtatgtctaggtagacaagaatggacacacaggagaaggtgatgggaagacaaagacagagattggactgatgcaaccacaagtcaaggagtgccaccagccaccagaaactacaaaaggtcaggaatggatccttccctagagcttccagaggatgtgcggtcctgccaacaccttgatttcagacttctggcctcagaactgtgagaaaataaatgttcgttattttaagccacccaatttgtggtgatttgttataacagccacagaaaactaatacacagccatcaacagca

SEQ ID NO: 64025 - DNA, 601 bp, Human
gtataaatacagttaaaagagattagcagaatggatttacaaacatgacccaattacatactgtcttcaagaaaatcacttcaaatataataatgtaggcaagttgaaagtaaaaggatggaaaaagatataacatgcaaacattaatcaaaagaaagcaagagtggctttattaatatgagataaagtagacttcagagcaaatacaattaccagagacagagagaaggagattacataatgataaaagtgtcaatcctcccaaaagacagcaatactaattgtgtctgccccaaataamagagctgaaaaagatatgaagtaaagactggtagaactaaaaggagaaatagaaaactccacaattacagttggagatttcaatgctcctctctcaaaattggtagcaaaaaatagacagaaaatcaggaagggtatagaagaactcaacaccaccatcaggatctagtggatatttatagcacattatacatgtggtaggaaaaagaaatgcctccccaaagatatattcactttctaatcatggaacctgtaaatactaccttatatggcaaaatatgtgataaagttaaggatctgg

SEQ ID NO: 64026 - DNA, 601 bp, Human
cagagtcataaagggaggtaagttttctatacttcaccaaaactagtaaaatgagaacttcagtaggctgtgataagttgtgtatatataacataataccttgaacaatgactaagaaagctatgtaagagatacttttaataaaaatggaatattaaaaaaaatgtccaagtaacccacccacagcaaggcacacaaaagaatacagagaaatgaaaagctgatagaacaaacagaaaacaaaaaataaagtggcagtcttatgcctcaacacatcaatcattatatgatgtataaattstataaatacagttaaaagagattagcagaatggatttacaaacatgacccaattacatactgtcttcaagaaaatcacttcaaatataataatgtaggcaagttgaaagtaaaaggatggaaaaagatataacatgcaaacattaatcaaaagaaagcaagagtggctttattaatatgagataaagtagacttcagagcaaatacaattaccagagacagagagaaggagattacataatgataaaagtgtcaatcctcccaaaagacagcaatactaattgtgtctgccccaaataaa

SEQ ID NO: 64027 - DNA, 601 bp, Human
ataagatatattatccagtctgaactatattgagaatatggaatgaaaaaaaaattacagtttcaaggacatttgggactataacaaaagacctaacactcatgccattggagatctggaagaaaaggagaaaaagagaagagcatgaaagtactcaaagcaataataactgaaaagttcccaaggtttcaagatatgtaaacctacagattcaagatgcttggtgatcttaaaacaggataagcctgaagaaatctatggtaagtcctatcataattaaacttctgaaaactaaagacamaggaaaaatcttgaaagcacccagagaatatgacaacttacctatagggggagcctaattagaatgacagaggatttctcatcagaagccatagagaccagaacgaagtggcagtttttcaggtgctgaaagaaacgaactgttaactcaaaacttaatgcccagtaaagtgatccttcaggaacaaggaaaaaaatcaagacattctcagatggaaaactaagaaaatgtgtccccagcagacccacaataaaataatgactaaaggaagttctaaacagaaagaaaatgataaaagaa

SEQ ID NO: 64028 - DNA, 601 bp, Human
aaatagaaggcttaaatagatccaagctctcagaacatcgtcatcaccaccatcatctgtacattaatgacgggtttctccaagtttcagtgaaaaatcacttgtcataccaagtgataggaagatctcaaacttcctgaataataaaagataaccaagagatgccatcactgaggtgacaaagatgttaaaattatctgactgtagttttaatgcagccatgaaaaaaatgcctctgagatcaattgtgaacacacttgacagaaataaaaagcttctggaaataaacagatagtctcascaaagacatagaagatacaaagaagaacctaatgggcctttcagaattgaaaaggcaacaaccaaaataaatagcttattgggtggattcaacagcagaagagaagggacatagaagagaatcagtgaactgaagaatagaataagatatattatccagtctgaactatattgagaatatggaatgaaaaaaaaattacagtttcaaggacatttgggactataacaaaagacctaacactcatgccattggagatctggaagaaaaggagaaaaagagaagagcatgaaagtactcaaa

SEQ ID NO: 64029 - DNA, 601 bp, Human
acaggcttttgccatgttggccaggctggtcttgaactcctgacctcaagtgatctgtctatctcggcctcccaaagtactgggattataagcatgagccaccgcacccagccacctctttttttttttttttcaaacaagaatctatacatacgtaactactatggttacaaaattaagatttaaaaaactgtaaaaagtggtaccaccaaaataaatttgttaattctcacaattgactttatttcatccaagccctctagttatttttctaaacaactcaatattccaagttcatctsccaaagctgtgaccacaataatgaggagtacgtagctcccacttctggtcttaccctggtcatttacaatgtgactggaggagcatcaactgagactaaatataaaagcacacgataattactgacacattactcaggattctatcttgtgagaaactcaacattgaagtatatacagagactttcacttccatacttccattaagtaccactaaaaactctggaattctatatatttatttaaaatcaaccacaacaacaatgtaagaatactctgaaaagtggaggaaaaaaaaaggc

SEQ ID NO: 64030 - DNA, 601 bp, Human
ttttgaacaattttaaccctagatctgaagtgtgaagtttcctaactgagccaattaggcagcccctagcagagaggagtgtgatccaaaagggtaaaggggaatgtcggcttttcctgaaaactttaacctttttttttttttttcaaagagacaggcttttgccatgttggccaggctggtcttgaactcctgacctcaagtgatctgtctatctcggcctcccaaagtactgggattataagcatgagccaccgcacccagccacctctttttttttttttttcaaacaagaatctayacatacgtaactactatggttacaaaattaagatttaaaaaactgtaaaaagtggtaccaccaaaataaatttgttaattctcacaattgactttatttcatccaagccctctagttatttttctaaacaactcaatattccaagttcatctcccaaagctgtgaccacaataatgaggagtacgtagctcccacttctggtcttaccctggtcatttacaatgtgactggaggagcatcaactgagactaaatataaaagcacacgataattactgacacattactcaggattctatct

SEQ ID NO: 64031 - DNA, 601 bp, Human
ttatcaacttgtatttctgtttcttttatcatctacttcccctgccatattgtgaatttcttgagggcagaaacaatgtcatagccttccttatgtagccaccctaggcacttaatatatttgctggattgaattgaaaatcttgtaggatgtctagggacaaagactgtatgtttttcaacgtgattttttcccataccagaaagcatgtcttatacttgaagagaacaagaaataagaataattctttttttgaacaattttaaccctagatctgaagtgtgaagtttcctaactgagycaattaggcagcccctagcagagaggagtgtgatccaaaagggtaaaggggaatgtcggcttttcctgaaaactttaacctttttttttttttttcaaagagacaggcttttgccatgttggccaggctggtcttgaactcctgacctcaagtgatctgtctatctcggcctcccaaagtactgggattataagcatgagccaccgcacccagccacctctttttttttttttttcaaacaagaatctatacatacgtaactactatggttacaaaattaagatttaaaaaactgtaaaa

SEQ ID NO: 64032 - DNA, 601 bp, Human
ttttgtattttctctattttttcacattgttttccatttttgggagatttgtcaagtttctttgaacccctctgctttcatagtgtcaagtcatgagagctcatttttattctttgactgctccattttagtaacattctgttccttctttaagttgtaatatctcatctctctggaaagatcaatggcagctttctttttttgttgtttgttttattttggttttggtttatttccctatgggtactctctctctcccacaagttgctttatgtgtctttgataatttcagtcttactcmtcctaaatgatttttctatgtctcaattaattctacttttgctttccctagtactttatcaacttgtatttctgtttcttttatcatctacttcccctgccatattgtgaatttcttgagggcagaaacaatgtcatagccttccttatgtagccaccctaggcacttaatatatttgctggattgaattgaaaatcttgtaggatgtctagggacaaagactgtatgtttttcaacgtgattttttcccataccagaaagcatgtcttatacttgaagagaacaagaaataagaataat

SEQ ID NO: 64033 - DNA, 601 bp, Human
tgaaggcattttactagtacattctagcttcctgctattgagaagtccaatcaatgcctttccaattcttggagagttctgttttttcttcctgaaaattgtgaaatcttctctttgtcctcaggtttctaaatttcataacattataacctggcataggtctattttctttcattgtgctggttattatatgggctgttttaatcccaaagtgtatgcccatcagttttggaaaattttttgaattattgatagcttccccttctctgttttttccattctttctttctgaaatgtctaygatttggacctcttgaactgatcctcaaaatttttttgtattttctctattttttcacattgttttccatttttgggagatttgtcaagtttctttgaacccctctgctttcatagtgtcaagtcatgagagctcatttttattctttgactgctccattttagtaacattctgttccttctttaagttgtaatatctcatctctctggaaagatcaatggcagctttctttttttgttgtttgttttattttggttttggtttatttccctatgggtactctctctctcccacaagttg

SEQ ID NO: 64034 - DNA, 601 bp, Human
tatatagaatcctaatttggaagtaggctttccagtttttctcagcaatgtgaaggcattttactagtacattctagcttcctgctattgagaagtccaatcaatgcctttccaattcttggagagttctgttttttcttcctgaaaattgtgaaatcttctctttgtcctcaggtttctaaatttcataacattataacctggcataggtctattttctttcattgtgctggttattatatgggctgttttaatcccaaagtgtatgcccatcagttttggaaaattttttgaattattratagcttccccttctctgttttttccattctttctttctgaaatgtctatgatttggacctcttgaactgatcctcaaaatttttttgtattttctctattttttcacattgttttccatttttgggagatttgtcaagtttctttgaacccctctgctttcatagtgtcaagtcatgagagctcatttttattctttgactgctccattttagtaacattctgttccttctttaagttgtaatatctcatctctctggaaagatcaatggcagctttctttttttgttgtttgttttat

SEQ ID NO: 64035 - DNA, 601 bp, Human
tcaacagtcaatttaatattataactctgtaaacattacttacagctgaaccatgtagttacattacaatttcttctctcttgataatatttttttcaccctggagttaataattgtctttattttttcatctgcttcattttgtatgtacttattactaagccaacttaaagttttccccaattctaaaaatctgctcctaatatattttctcttttccctcctgagctctgcttccaacatgttcaagcacatcagattttctatcctagagccatctggcctactccaatttaaattsgctgcccactagatctgctattcagctgttacctaaggatttaaatcttaaatcccccagtgggatccaaaggggtaaagggattcatcccagggattcccttcacctctctccatattgaatcccctgttcctagattccatgcctttccctttttaaattttactccctcattttgttggagtacatcctttaatatcttcataagaaagggtacacaaagaggaacatctttgacaccttgcatgtctgaaatgtctttattctactttcacctttaattaatgattcagctgtata

SEQ ID NO: 64036 - DNA, 601 bp, Human
agacttttaggttgtctttcttttatggaaaaggagaatttagttttggcttagccccctccctccagccctcacccctaccagcttcctatttcccagtatagttgtattttgatcagatcaacagtcaatttaatattataactctgtaaacattacttacagctgaaccatgtagttacattacaatttcttctctcttgataatatttttttcaccctggagttaataattgtctttattttttcatctgcttcattttgtatgtacttattactaagccaacttaaagttttcccyaattctaaaaatctgctcctaatatattttctcttttccctcctgagctctgcttccaacatgttcaagcacatcagattttctatcctagagccatctggcctactccaatttaaattcgctgcccactagatctgctattcagctgttacctaaggatttaaatcttaaatcccccagtgggatccaaaggggtaaagggattcatcccagggattcccttcacctctctccatattgaatcccctgttcctagattccatgcctttccctttttaaattttactccctcattttgtt

SEQ ID NO: 64037 - DNA, 601 bp, Human
tatgtcttgactttttcagttttagacttttaggttgtctttcttttatggaaaaggagaatttagttttggcttagccccctccctccagccctcacccctaccagcttcctatttcccagtatagttgtattttgatcagatcaacagtcaatttaatattataactctgtaaacattacttacagctgaaccatgtagttacattacaatttcttctctcttgataatatttttttcaccctggagttaataattgtctttattttttcatctgcttcattttgtatgtacttattaytaagccaacttaaagttttccccaattctaaaaatctgctcctaatatattttctcttttccctcctgagctctgcttccaacatgttcaagcacatcagattttctatcctagagccatctggcctactccaatttaaattcgctgcccactagatctgctattcagctgttacctaaggatttaaatcttaaatcccccagtgggatccaaaggggtaaagggattcatcccagggattcccttcacctctctccatattgaatcccctgttcctagattccatgcctttcccttttt

SEQ ID NO: 64038 - DNA, 601 bp, Human
gattttatagcagttgtccatgtggaataaagctcgttccataatctgaagcagaggaaacaaaaatgggagagaacagtgtactgattgcattggttcctcaaagtaggaactttgagggctgtatccattgcctgcctttcccctctgcacccaagttatttctcccccaggatattgcagcagcatcttttttttttttttttttttttttttgagatggagtctcgctctgtcaccaggctggagtgcagtggagcgatcttggctcactgcaaactcctactccctggttcaagcrattctcctgcctcagcctcctgagtagctgggattacaggcacgcaccacacgcccagctaatttttgtatttttagtagagatggggtttcaccatgttggcctggaaggtctcgatctcctgacctcgtgatccgcccgccttggcctcccaaagtgctgggattacaggcatgagcccagcctgcggcagcatctttactgcaccttatccacccactagtcccctcattcagcaactctgtggagaaattcattccagagcctctagttggaactaatcacttgcctctttttgaa

SEQ ID NO: 64039 - DNA, 601 bp, Human
cacatgatgaaactgaggcccagggactcccaaattcatatttatagatcagtgtcagaggcaggtgcataactgtgacgtgttagtcctaggccagtgttctttatcatacggtgtgcccaaaggtttacaaacgcgtaaagatgaaccacaactgacaggctatgacaccgattgcaggctgtgagcccacctgccccgggctgaagatcattataagatcttaaagagatggctgtgaatgagttggcaaactcagcagtctcataagttatccattgaattattagcttcctatatggggtcagcagaaaggctgtaggatatgaaacccagaagagcaactggacttctactcctagtgcttacttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcaccttcccaaggagagagacacagaggccttgttggcggcaagagactgtgggggcagggcacaacctaaagttaagcttccaacccc

SEQ ID NO: 64040 - DNA, 601 bp, Human
catattgaggacatgaatatctttggatgttcacatcaaaacaggacatccttggggttgcccacaaagatgagaacagtcagctggtgcacagcccacaccagggggtcttgtcaacactcttcttccctgagtgcaacccgtactgggtcagagtgccctggtaatcttgggctgtcatcatctccaggaggcactgtgcctcactgacaataataaagccttctctgtgctttatatttaattatctgagtaactctgtgaggaagacagagccagcccaattatgcccacttttcasatgatgaaactgaggcccagggactcccaaattcatatttatagatcagtgtcagaggcaggtgcataactgtgacgtgttagtcctaggccagtgttctttatcatacggtgtgcccaaaggtttacaaacgcgtaaagatgaaccacaactgacaggctatgacaccgattgcaggctgtgagcccacctgccccgggctgaagatcattataagatcttaaagagatggctgtgaatgagttggcaaactcagcagtctcataagttatccattgaattattagcttcctatatggg

SEQ ID NO: 64041 - DNA, 601 bp, Human
aaggaactgtaaagcttattccaaacttggtgggaattatgcacaatcctctctttttccaacaattctccctagagaaaaaggaatattcttatagaaccttcgctatcatattgaggacatgaatatctttggatgttcacatcaaaacaggacatccttggggttgcccacaaagatgagaacagtcagctggtgcacagcccacaccagggggtcttgtcaacactcttcttccctgagtgcaacccgtactgggtcagagtgccctggtaatcttgggctgtcatcatctccaggmggcactgtgcctcactgacaataataaagccttctctgtgctttatatttaattatctgagtaactctgtgaggaagacagagccagcccaattatgcccacttttcacatgatgaaactgaggcccagggactcccaaattcatatttatagatcagtgtcagaggcaggtgcataactgtgacgtgttagtcctaggccagtgttctttatcatacggtgtgcccaaaggtttacaaacgcgtaaagatgaaccacaactgacaggctatgacaccgattgcaggctgtgagcccacc

SEQ ID NO: 64042 - DNA, 601 bp, Human
aagtgaagaaacagaacaagaaaaatagagtagctctctccagtccgatagttaaggaaaggtaagaactagaggttgatcccagatctctgagtctcactgcccatgacctactggacaaataggactgtgcaagttcgactttcatttaaagagcaaagagttcctccagtaagccctgttaccagtgacaacgaaatttcccttgcaatactgtaaacaacagggaaatggggtcccagtccagcggagatggacacaattctataaagcaattacctgattcagaaaaggaactgtraagcttattccaaacttggtgggaattatgcacaatcctctctttttccaacaattctccctagagaaaaaggaatattcttatagaaccttcgctatcatattgaggacatgaatatctttggatgttcacatcaaaacaggacatccttggggttgcccacaaagatgagaacagtcagctggtgcacagcccacaccagggggtcttgtcaacactcttcttccctgagtgcaacccgtactgggtcagagtgccctggtaatcttgggctgtcatcatctccaggaggcactgtgc

SEQ ID NO: 64043 - DNA, 601 bp, Human
tagacggcctgtccattgaggtcagcgctgacagaggcagccgtgggagaggtgttgggcacagtgttagtgcttgtctcgctgatataaatcttagaggtggggattttcagagctctactggccacctgcgaaaagagaagacattgccctctagggaaggggttatcatggggcttggctgccttctccccaagacaggattcacattcactgttacaggcaagaaaacaatttcgtaaactctaatctcattgtctgggatgtccttacatctggctgaatttgaaggagcacttgrtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtcctcagaggtcacctggccaactcctttgcacagatgaggaaactgagttcaagtgggggaaaa

SEQ ID NO: 64044 - DNA, 601 bp, Human
ccaggcccacagctctgggctggccctctgctctgcgggatcccatgggctccttacatagacggcctgtccattgaggtcagcgctgacagaggcagccgtgggagaggtgttgggcacagtgttagtgcttgtctcgctgatataaatcttagaggtggggattttcagagctctactggccacctgcgaaaagagaagacattgccctctagggaaggggttatcatggggcttggctgccttctccccaagacaggattcacattcactgttacaggcaagaaaacaatttcgtaarctctaatctcattgtctgggatgtccttacatctggctgaatttgaaggagcacttggtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtcctcag

SEQ ID NO: 64045 - DNA, 601 bp, Human
actctccaggcccacagctctgggctggccctctgctctgcgggatcccatgggctccttacatagacggcctgtccattgaggtcagcgctgacagaggcagccgtgggagaggtgttgggcacagtgttagtgcttgtctcgctgatataaatcttagaggtggggattttcagagctctactggccacctgcgaaaagagaagacattgccctctagggaaggggttatcatggggcttggctgccttctccccaagacaggattcacattcactgttacaggcaagaaaacaatttygtaaactctaatctcattgtctgggatgtccttacatctggctgaatttgaaggagcacttggtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtc

SEQ ID NO: 64046 - DNA, 601 bp, Human
gcttcagcccattgtcctattgctagctccagcaccagggagtaattccagaagcctctgctttccctcggtatcctcatctccccatcctgcactcatccttcccagctttgagggcagtgattatgattcttgggcctctcttttagcttgaggtttggagaaacagcatcctcctggataagggagccagaggcctggccagagccaaagagcctgcaaggaacccttctagctcccacccagggagactctccaggcccacagctctgggctggccctctgctctgcgggatcccaygggctccttacatagacggcctgtccattgaggtcagcgctgacagaggcagccgtgggagaggtgttgggcacagtgttagtgcttgtctcgctgatataaatcttagaggtggggattttcagagctctactggccacctgcgaaaagagaagacattgccctctagggaaggggttatcatggggcttggctgccttctccccaagacaggattcacattcactgttacaggcaagaaaacaatttcgtaaactctaatctcattgtctgggatgtccttacatctggctgaatttg

SEQ ID NO: 64047 - DNA, 601 bp, Human
ccagggtgccactcaaacagcctggccacccactccagaatgatcaaggcccagggtagaatcgacaggacctggccaatagggccaccactagtccctgcttggagagcacttcctgactcaattcttaggctgacagagggcgaaatgtttgagggatccccagagaggtgtcttcttccctcaaactgcttgtttgattatatcccccatatggcagaggagccagtgtggccaacctgcctctataatcaaatttcagcttcagcccattgtcctattgctagctccagcaccaggsagtaattccagaagcctctgctttccctcggtatcctcatctccccatcctgcactcatccttcccagctttgagggcagtgattatgattcttgggcctctcttttagcttgaggtttggagaaacagcatcctcctggataagggagccagaggcctggccagagccaaagagcctgcaaggaacccttctagctcccacccagggagactctccaggcccacagctctgggctggccctctgctctgcgggatcccatgggctccttacatagacggcctgtccattgaggtcagcg

SEQ ID NO: 64048 - DNA, 601 bp, Human
caaaacccgagggccccagcaaggctacctccaagcaatgctgtacccagggtgccactcaaacagcctggccacccactccagaatgatcaaggcccagggtagaatcgacaggacctggccaatagggccaccactagtccctgcttggagagcacttcctgactcaattcttaggctgacagagggcgaaatgtttgagggatccccagagaggtgtcttcttccctcaaactgcttgtttgattatatcccccatatggcagaggagccagtgtggccaacctgcctctataatcaratttcagcttcagcccattgtcctattgctagctccagcaccagggagtaattccagaagcctctgctttccctcggtatcctcatctccccatcctgcactcatccttcccagctttgagggcagtgattatgattcttgggcctctcttttagcttgaggtttggagaaacagcatcctcctggataagggagccagaggcctggccagagccaaagagcctgcaaggaacccttctagctcccacccagggagactctccaggcccacagctctgggctggccctctgctctgcggg

SEQ ID NO: 64049 - DNA, 601 bp, Human
tctgagatttctgacattcaggccactggtctagaagtcagagaattgggctcattcttatcataagtgcttgttctgtcattccccaaatcacaggaatgatagaagtccttgggtgatgttttctccccacgctgtcacagagggaatctcagtagactcagactcaagagatggagatttgaggaaaaccaggctcatctgggacaagcggggtgtgggagcagacccactgagtcaagacaatccgatgaggcatgttcagcaggcacccatcctctcaggctcaggcaaagaaaascctgattcccacaaggctgtcaagatcctggatcaaaaacttccctcaaatgacctccctcaatgatgaaagctatagagaaagggacccagccagaatgagcatttattcatcctgtaaaatcacacaaaccacctcaacttctctctgctgttctgactaaaatattgtctcctattacttgttcggattcggaacggaggccctgctgtcaatttccctctcctttgcaaacgtgacttggatcagctcagacttacccagtcttcccaggagccactgggattcttcttcttgtag

SEQ ID NO: 64050 - DNA, 601 bp, Human
ttatactcacaaccccagaaaacctatactattattagcctcattttacagatgaggaaactaaggcttggaaagacttggtcctaaaacctgcactagtcatttaacataatgtgcgtgtgcatgtgtgtgtgtgcacgcatgcttgtgtgcgtttgtgtgtgcgtgcacatgcgcatgtgtatgtatgtgttggtgactgtggttcatttattggggttatctgtttcccaggcacactggtctacatggctggtggttgaagacaaagctcagatccacaggtcagatgatagaacaytgttgtcgggactgttgttaaaaacatttaaactgcctgataaatccatgctaaaacccaactaccaaaatcaggctactttcatgtgctattggtacacgtggtatggagaggtcatagaaggcatagtaagatgagtgggtctgagaaaaatggcatgttttctttaaatctattgaggaagatttctagtgagccggtttatgtgcagtcacatttgatgtgttactcttctgcccagttctaccactccaatactggggaaggatgcagagctgccattaatatttccacttgctg

SEQ ID NO: 64051 - DNA, 601 bp, Human
atgtggttcctcttctatatatgtgcaaatccttttcttccctcaacaactactcaaacttgccctccattctcccctccttggtgaactctccctaactggccattataaaagcaacacgctatagcgctcatgtggtacttcacatgttcaccttgtgcttttacatatgctttcctgttgatcaaactatccctccatcctatcccttggactatataatgtgcttttttggtatccccaaacactagcacagactcagatttaagttgtacttgatataatttatgccttcttcatyagcagccaccaaacgatttactgtgtcacacgcgctatttagcactttgcatacattatcttacttatactcacaaccccagaaaacctatactattattagcctcattttacagatgaggaaactaaggcttggaaagacttggtcctaaaacctgcactagtcatttaacataatgtgcgtgtgcatgtgtgtgtgtgcacgcatgcttgtgtgcgtttgtgtgtgcgtgcacatgcgcatgtgtatgtatgtgttggtgactgtggttcatttattggggttatctgtttcccaggc

SEQ ID NO: 64052 - DNA, 601 bp, Human
ctgttaggcagtcgatttctacttcagagcaagccaccccatagctgaagtagtggaaggggttccctgagttagtctcaaagctgtagcccagattgggtgttctgggagaggaaagagaaggtactgcacatgtattaacatgaacacacccccttccctatgcacgtacagcttgacccacaacatctttaaaccccacaagtttttgcattcagctgttctccaaaaaagtccatggtttgaacaatttgaacctgttaacgaaacccagatattccagaacattttgtctctgggycctcctctattttgccagtagcccttctgtactcattctgtacagcctagcagtgtttagtaccatgctagcctctgcacagtagaaagagaggtaacagatccatctgggctcacgaaggacatgaaagtcacactccaaaggatgtactgaattagaatccaaggtcttcaggactgaaggttctgcctgtggtggctcttagactgttcacacaagttctcctgcttaccttctcaaggtgaaagttaataagatcagcatctcatgctaacctgggtgcatctttaagcggccact

SEQ ID NO: 64053 - DNA, 601 bp, Human
gctttctgccttgagggttggttggactatcaccaatctaaattctactttgggggaaactccctaggttccatgtttcagcctgtttgaagacaaccttggacaacatgttgtggcaggtggccccaggaggggaatggggtgcatcggtggccaagtctgtcaccaccctggtcccactgagcctcacctgtccaatatcaatggcagggtttagactggagccaacatccatgacaatatctgtgcggaggttctagagtagacagcaaaattacaagaagttagaggaggaaaagaygtttggaatatgacagatgactcatagtgaccctcagactacaagtgccaaccaaagagtacgttcccaagcagaaagccctgggtgtgctcaggcagaagtgttgatgttcccaccaaatctctgctgccaccatccccgctggagtctgagtttgtagcagccgggtaggaagtggggagcagcaatgatctctcagtaactgggaataacacacattcatacgtgagtagtcagatagggtcccagaaacctggggctttgaatctgagtctgggtagatcatgtacaaaagagtca

SEQ ID NO: 64054 - DNA, 601 bp, Human
agactgctttcccgtaggtcggagcctcatcttctagtattcttaaaacctctcccctttcagggcactgtagctgtcgactttgtttcagacaccagccttcccccacacttctgcatgacccaggtcactatgagacacccagacgtgttgatgacagtgacatttgtcctagagtgaccacactgatcctttctagcactgtgaagagtgtgcagcttcctctgaaccaaggtttccaaaaggttttgatattgaagaagcagtgccgccttactggcttttaatgaaagcagagtaytgtagtgtcagaaaaaaagaacaaatggtgacaattttgaaagaaatagctgcatatgactgcagttgaatttgcatcattttaatcaagataatcattttatcagtacaacgattcctgaatactttttcaatgaagttatatttagcataaaacttttccccctgttgctttgattttaattaaaacagtattccaaagtagcctttaatttccaagttgaaatgtttgatgaatggattgcgtaaacttaaacataccactttacagtaaaacctaaaacaactatgtatgtttctg

SEQ ID NO: 64055 - DNA, 601 bp, Human
agagtattgtagtgtcagaaaaaaagaacaaatggtgacaattttgaaagaaatagctgcatatgactgcagttgaatttgcatcattttaatcaagataatcattttatcagtacaacgattcctgaatactttttcaatgaagttatatttagcataaaacttttccccctgttgctttgattttaattaaaacagtattccaaagtagcctttaatttccaagttgaaatgtttgatgaatggattgcgtaaacttaaacataccactttacagtaaaacctaaaacaactatgtatktttctgaatgaaagcaaggatactacatctttcgggtttcttttaagctaacttttttttttttttgagacggaatctcgccctgtcgcccaagctggagtgcaatggtgcagtctcggctcactgcaacctccgactccctggttccagcgattctcctgcctcagcctcccgagtagctgggattacaggcacgcaccaccacgcctggctaatttttgtatttttagtagagtagggatttcaccatgttggccaggatggtctccatctcctgacctcgtgatcggctcgcctcgg

SEQ ID NO: 64056 - DNA, 601 bp, Human
tatcagtacaacgattcctgaatactttttcaatgaagttatatttagcataaaacttttccccctgttgctttgattttaattaaaacagtattccaaagtagcctttaatttccaagttgaaatgtttgatgaatggattgcgtaaacttaaacataccactttacagtaaaacctaaaacaactatgtatgtttctgaatgaaagcaaggatactacatctttcgggtttcttttaagctaacttttttttttttttgagacggaatctcgccctgtcgcccaagctggagtgcaatrgtgcagtctcggctcactgcaacctccgactccctggttccagcgattctcctgcctcagcctcccgagtagctgggattacaggcacgcaccaccacgcctggctaatttttgtatttttagtagagtagggatttcaccatgttggccaggatggtctccatctcctgacctcgtgatcggctcgcctcggcctcccaaagtgctggtaatacaggcatgagccaccgcgcctggccttaagctaacattttttattatatgtgccaggcattgtgctattagctttgcatgtgttat

SEQ ID NO: 64057 - DNA, 601 bp, Human
cacacctcaattagatactcacttgcattgtccattagtgaaaacagaaacaatctgcacttcattcatagtgtctgtctctactgccaactccaaaaactgttctagaatttcaatcttgttgaaacctgtttcctttgtggggcctgggagtgggaagtgggatataaggaaagaggcagttattcattgttttggacagtaaggaaagagtgacggttaagagaggtcaaggagggtgttaacatttaagaatactatgtgtttgtagaaggaaattttttgttaactgctccattcttttttttttttttttttgagatggagtctccctgtgtcacccagactggagtgcagtggcgtgatctcagcttactgcaacctctgcctcccagacgcaggcgattctcttgcctcagtctcccgagtagctggaaccacaggtgcgccctatcacggctggctaattttttgtatttttagtagagatggtgtttcaccatgttggccagactggtcacgaactcctgacctcaggtgattcgcctgcctcgaccttccaagtgcttggattacaggtgtcagccactgtgcccaccca

SEQ ID NO: 64058 - DNA, 601 bp, Human
gctccattcttttttttttttttttttgagatggagtctccctgtgtcacccagactggagtgcagtggcgtgatctcagcttactgcaacctctgcctcccagacgcaggcgattctcttgcctcagtctcccgagtagctggaaccacaggtgcgccctatcacggctggctaattttttgtatttttagtagagatggtgtttcaccatgttggccagactggtcacgaactcctgacctcaggtgattcgcctgcctcgaccttccaagtgcttggattacaggtgtcagccactgygcccacccagcaagctccattctttatcacctcttaagaacatccaggatcccttggggagaattaaaacggttgcaaagttttagaatagaggaacatgtttaagcgtagatcattttttgggccagtcatggtggctcacgcgtgtaatcccaacactttgggaggccggggcgggtggatcatgaggtcaagagtttgagaccatcctggccaacatggtgaaatcccatctctactaaaaatacaaaaattagctgggcatggtgacacatgcctgtagtcccagctactcaggag

SEQ ID NO: 64059 - DNA, 601 bp, Human
tgcttggattacaggtgtcagccactgtgcccacccagcaagctccattctttatcacctcttaagaacatccaggatcccttggggagaattaaaacggttgcaaagttttagaatagaggaacatgtttaagcgtagatcattttttgggccagtcatggtggctcacgcgtgtaatcccaacactttgggaggccggggcgggtggatcatgaggtcaagagtttgagaccatcctggccaacatggtgaaatcccatctctactaaaaatacaaaaattagctgggcatggtgacayatgcctgtagtcccagctactcaggaggctgaggcaagagaagtgcttgaacctggaaggtggaggttgcagtgagccgagatcgtgccactacactccagcctgggcggcagagcaagactccgtcttgaaaaaaaaaagtaggtcatttttggctgggcacggtggctcatgcctgtaattccagcactttgggaggctgaggtgggtggattgcttgagcccaggagtttgagaccagcctgggcaacatagtgaaaccctgtctttgtgaaaaatacaaagattagctaggcgcag

SEQ ID NO: 64060 - DNA, 601 bp, Human
ctgagctcttagatttgaagaaatagcagttccatgtgaggaataagtggaagaaatagaattcagacctcaggtctcaggctggtgacttaaatctttcagtatcacatatatgaatatatctattatacttaaatcctcctaaacatttttatttttcagttggatatattaaatatataaaaataattatttaatttattttagagacagtgtttcactctcttacccaagctggagtggaatgtgatcatagctcactgcagcctcaaggctcattcctaggcttaagtgatcctcttttttttttttttgctagagataggatcttgttatgttagccaggctggagaaatttcaacaatattttgaacaataaaaaaaaaataaattaggttttattgtaaagtggtatgtttaagtttacgccattctcctgcgtaatgcatatttcatactcttcctactgataatgtttctgttcacaactttttctttatattttgatttcttttctcttttctttttttttttttttgagacagagcctcgctttgtcgcccaggctagagtgcagtggcgcgatctcggctcactgcta

SEQ ID NO: 64061 - DNA, 601 bp, Human
agccaggatggtctcgatctcctgacctcgtgatccacccgcctcggcctcccaaagtgctgggattacaggcgtgagccaccgcgcccggcacatattttgatttctaatgtggacatcagaatgggctgttgacagctcttttttttttttttgaggcagagtctcgcttcttcacccaggctggagtgcaatggcgcgatctcagctcactgcaacctccacctcccaggttcaagcgattctcctgcctcagcctccccagtaactgggattacaggcatgtgccaccccacacccrgccaatttttgtatttttagtagagacagcatttcaccatgttggccaggctgttctcgaactcctggcctcaagtgatccactcgccttggcctcacaaactgctaggattacaggtgtgagccaccgtgcccagccttgacaggtctttagtttgattttagttcaacaactgatgccgtaatatgccaaattaaattagttcagactgaaacggattacttaaagattcattttcctttaaaaatgaagtaaaactttagccggatgtggtggcgggtgtgtgtaatcccagctact

SEQ ID NO: 64062 - DNA, 601 bp, Human
tgatccacccgcctcggcctcccaaagtgctgggattacaggcgtgagccaccgcgcccggcacatattttgatttctaatgtggacatcagaatgggctgttgacagctcttttttttttttttgaggcagagtctcgcttcttcacccaggctggagtgcaatggcgcgatctcagctcactgcaacctccacctcccaggttcaagcgattctcctgcctcagcctccccagtaactgggattacaggcatgtgccaccccacacccagccaatttttgtatttttagtagagacagsatttcaccatgttggccaggctgttctcgaactcctggcctcaagtgatccactcgccttggcctcacaaactgctaggattacaggtgtgagccaccgtgcccagccttgacaggtctttagtttgattttagttcaacaactgatgccgtaatatgccaaattaaattagttcagactgaaacggattacttaaagattcattttcctttaaaaatgaagtaaaactttagccggatgtggtggcgggtgtgtgtaatcccagctactcgggagggtgaggcaggagaatcgcttgaa

SEQ ID NO: 64063 - DNA, 601 bp, Human
gcaggacaattgcttgaactccagaggtggagattgcggtgggccaagatcacgccactgcacgccagcctgggcaacagagcaagactccatctctcaaaaaaaaaaaaaaaagaaaactgagtttatattgttatggttcttatctatcttaaattttttctttaggagattgaatatttttgtactttagtcttaatccagtggttgaaagagagtgcacttttgaagtctgcctcttggctgtccttgacaacacaaaccttagttccaagagaatgtaattcttcctctttctcastgcttcaaaatatatatgatcaaatagaaacgagttgaataggcagtctcttcaaaggtttcctaactctgtggttaactatcaaggagctggtaatatcatgcactgccattcccttggcaacatgacttatcttttttttttttttttcttttttgagacagagtcttgctctgtcacccaggctggagtgcagtggcgagatctcagctcgctgcaagccccgcctcccacgttcacgccattttcctgcctcagcctcccaagtagctgggactacaggcgcctgccatcacacct

SEQ ID NO: 64064 - DNA, 601 bp, Human
ttcaccgtgttagccagtacggtctcgatctcctgtcctcgtgatccgcccaccttggcctcccaaagtgttgggattacaggtgtgagccactgcgcctggcctacttatcttctaatttaactgaaaaccaatttatttgattcagtgaaatggcatcaaactgtagtagtgttaattgaaatatttggtaccttgaaatgttaaatgccaaattaaatctcattttaatgaaatctcgtgtaaatgtgttttatatggtgactatgtttattctgaattttattcttatggcatactaaaaaaaaaaaaaatttttttttttttttgtaatggagtcttgctctgtcacccacgctggagtgcagtggcgcaatctcggttcactgtaacctccacctcccgggttcaagcgattctcctgcctcagtctcccgagtagctggtactacaggcgtgcaccactatgcctggctaatatttttgtatttttaggagagacagggtttcaccatgttggtcaggctgatctcgaactcctgacctgaagtgatccgcctgcctcagcctcccaaagtgctgggattacaggtatgaccca

SEQ ID NO: 64065 - DNA, 601 bp, Human
cagtacggtctcgatctcctgtcctcgtgatccgcccaccttggcctcccaaagtgttgggattacaggtgtgagccactgcgcctggcctacttatcttctaatttaactgaaaaccaatttatttgattcagtgaaatggcatcaaactgtagtagtgttaattgaaatatttggtaccttgaaatgttaaatgccaaattaaatctcattttaatgaaatctcgtgtaaatgtgttttatatggtgactatgtttattctgaattttattcttatggcatactaaaaaaaaaaaaaatttttttttttttttgtaatggagtcttgctctgtcacccacgctggagtgcagtggcgcaatctcggttcactgtaacctccacctcccgggttcaagcgattctcctgcctcagtctcccgagtagctggtactacaggcgtgcaccactatgcctggctaatatttttgtatttttaggagagacagggtttcaccatgttggtcaggctgatctcgaactcctgacctgaagtgatccgcctgcctcagcctcccaaagtgctgggattacaggtatgacccactgcacccaaccca

SEQ ID NO: 64066 - DNA, 601 bp, Human
cccaaagtgctgggattacaggtatgacccactgcacccaacccatactcaaatttgacactgaattttcataaaggccttaatttatctgaaaccaaactatttcaaaagaggaatagcacagcaaattctgttgacttaatgagaggatatgtgaagtctatttattaaagcaaatattaattggaggccagttaatttgtacagctctgcattttagatatttgagaaatatttatttcctctccagtgagatgtgttaaaacattagttatgtgattaacaaatatgtgtacatacrtatatatgtacatacacattttgagacagggccttggtctgttgttcaggctggagtgcaatgacaccatcttagctcattgaagcttcagcctcgcaggctcaatcgatccacccacctcagcctccctagtagctgggtctacagacatataccaccatgcttggctgattttttaattttttgtagagatggtgatcttgccctgttgactaagttggtaaatattttaattgttgaactttcttggaagactgaaaacctgtgatagccattttatataaggagaagctgaagttc

SEQ ID NO: 64067 - DNA, 601 bp, Human
actgcaagctccgcctcctgtgttcacgccgttctcctgcctcagcctcccgagtagctgggactacaggcgctggccaccatgcccagctattttttttgtatttttagtagagacgggatttcaccatgttggccaggatggtctcgatctcttgacctcgtgattcacccgcctcggcctcccaaagtgctgggattacaggcgtgagccactgtgcccggcctcaaaatacttcaatttctttcatggcctgctatctgacgtgatgctgtactagagtcaggctgggaatttggcrtcttattgctacaaaacatcttaatatctctgttttaatgttaatgctgatcagttgtccctgaattccaaagggaagagggtatatgagtcatgtccaacccccacttctcattatggcctgaactagttttttaggttaactttggaatgcctttggcaaggggagggtccatgagtcagttgggggtcttagagttttattttttgcttaccggtttataaaaagttaatgaaaattatcatatttcataattctatataattcaatattgtactttatttaaaactcacgtataaa

SEQ ID NO: 64068 - DNA, 601 bp, Human
aaactcacgtataaaatagctgtccatatctgttttcagaagatgaggatggagggtagaaatcagaagtgtcagatttggtaattttcttacactgctgaaaacctatacctaccactttgaaaggattaatttcagacttgctttctttgggcctaatgattctactttgaagtttctctgattaaactaaggaataaatctgataaatggacattcagatgataccatacttttccaaaagataacattgcttttgattacatatgcaataaacatttcacattttttctcaagattwtttactggcatctgcaccaaagacacaaaaaagcagccactgttaaggactttatcccttgttctgtttttagctggtttgttgttgtatttttcctcatgttgaatacagttaaaccctattaaactggattccccatattactgttagttgtcctgatgacaattaaggatagttagtaaatggatattgaatcattttatttttttagtagtgatggcgtttcgctgtgttggccaggttggtctcgaactcctggcctcaagtgatctgcctgtgttggcccctcaaagtgttagg

SEQ ID NO: 64069 - DNA, 601 bp, Human
taattttcttacactgctgaaaacctatacctaccactttgaaaggattaatttcagacttgctttctttgggcctaatgattctactttgaagtttctctgattaaactaaggaataaatctgataaatggacattcagatgataccatacttttccaaaagataacattgcttttgattacatatgcaataaacatttcacattttttctcaagattatttactggcatctgcaccaaagacacaaaaaagcagccactgttaaggactttatcccttgttctgtttttagctggttttttgttgtatttttcctcatgttgaatacagttaaaccctattaaactggattccccatattactgttagttgtcctgatgacaattaaggatagttagtaaatggatattgaatcattttatttttttagtagtgatggcgtttcgctgtgttggccaggttggtctcgaactcctggcctcaagtgatctgcctgtgttggcccctcaaagtgttaggattacaggcgtgagccactgcacctggctggatattgaattattgaagaaggatgttccctaacacttcctgcctcttttc

SEQ ID NO: 64070 - DNA, 601 bp, Human
aaactagaatgatgtctttacatagggtttaaaactttccaaattaacagggaaaataattctttaccttgaaaataaatgtttgctagtgaaagcaaatacaatctttttactaaatgttttattaaatttttttttcttgtagacacagggtcctactgtattacccaggctggtcttgaatgcctggcctcaagcaatcctcctacctcagtcttccaaagtgctgggactacagacatgagccatcacactgggtcttttttaccaaattatagtagaaagcactttttctctaatrgtgaactatgagagaattaatcaggggctattagtaattcatccctgaattaatcagtgattataatgctttgtggtccatgtagtttgctggggattaacacaccatgaaagtctaccaggagatttttttttttctttgagaacaggggccataatcagtagtccttaaatgaaatggactattcccatttcattatatgttgcctaggctggactcgagctccttggcttaagtgatcttcccacttcagactctcaagcagctgggactataggtgtgtgccaccatacctggctt

SEQ ID NO: 64071 - DNA, 601 bp, Human
ggggccataatcagtagtccttaaatgaaatggactattcccatttcattatatgttgcctaggctggactcgagctccttggcttaagtgatcttcccacttcagactctcaagcagctgggactataggtgtgtgccaccatacctggcttaattgagtgtttgttttttgtttttttttctgagacagagtctcgttgtgtcgcccaggctagagtgcagtggcacaatctcggctcactgcaacctctgtttcccaggttcaaacgattctcctgcctcagcctcccaagtagctgrgattacaggcgcctgccaccatgcctggctaatttttgtatttttagtagagatggggtttcaccatcttggccaggctgatctcgaactcttgacctcatgatccacacaccttggcctcccaaagtgctgggattataggcgtgagccaccgcgcccggctttaattgagatttttagatatctattactctgctaattttgtcacttgcaagttgccatcagaaaattgtaggaaaatggatatatttgttccttggaatggtttgtgtgagaatacttaaggattaaatagataag

SEQ ID NO: 64072 - DNA, 601 bp, Human
gggccataatcagtagtccttaaatgaaatggactattcccatttcattatatgttgcctaggctggactcgagctccttggcttaagtgatcttcccacttcagactctcaagcagctgggactataggtgtgtgccaccatacctggcttaattgagtgtttgttttttgtttttttttctgagacagagtctcgttgtgtcgcccaggctagagtgcagtggcacaatctcggctcactgcaacctctgtttcccaggttcaaacgattctcctgcctcagcctcccaagtagctggrattacaggcgcctgccaccatgcctggctaatttttgtatttttagtagagatggggtttcaccatcttggccaggctgatctcgaactcttgacctcatgatccacacaccttggcctcccaaagtgctgggattataggcgtgagccaccgcgcccggctttaattgagatttttagatatctattactctgctaattttgtcacttgcaagttgccatcagaaaattgtaggaaaatggatatatttgttccttggaatggtttgtgtgagaatacttaaggattaaatagataagt

SEQ ID NO: 64073 - DNA, 601 bp, Human
ctcgaacgcctagcctcaagtgatctaccctccttagcctcccaaagtgctgggattacaggtgtgagccactgtgcccggccccatttctacaacaattaaaaaatattagcccagtgtagtggtgcatgtctctagtcccagctactcagaaggctgaagtgaaaggattgcttgagcccagaatttcaaggctacagtgagctatgataatggcattgcactccagcttgggtgacagagtgagaccctgtctctaaaaaatgaagtaaaatagtgcacaagtatagaacttgaaaawcttccttaaccttaccataagggaaatgattactaataagtttcttaactttttgtacttacataaacataaatattcatcagagaaaaaaatatgcaaaacaatttgcaatctttttcacttaccatattttggaatttttttcatttcaatatatttgatcttccttgtgttttttcagtttgtttgtttttgtcacccaggttggagtgaagtggtaagaacatggcttattgcagcctcaatctcctgctcccattcagcccctcaagtagctgggactacaggtacatgtcacca

SEQ ID NO: 64074 - DNA, 601 bp, Human
ttaaccttaccataagggaaatgattactaataagtttcttaactttttgtacttacataaacataaatattcatcagagaaaaaaatatgcaaaacaatttgcaatctttttcacttaccatattttggaatttttttcatttcaatatatttgatcttccttgtgttttttcagtttgtttgtttttgtcacccaggttggagtgaagtggtaagaacatggcttattgcagcctcaatctcctgctcccattcagcccctcaagtagctgggactacaggtacatgtcaccacgcccrgctaatttttatttttattttggtagagatggggtttcaccatgttgcccaggctgatcttgaattcctgggctcaagtgacccgcccacctcagcctcccgaagtgttgagagaacaggtgtgaaccaccatgctccacctcttagtctttacaatctgcaaaacctcataagtggctaatagaggaatatagtaaagcaaagggggatatcactgattagaactgtgtttttaggctgggtgcggtggctcacgcctgtaatcgcaacattttgggaggctaagtgggagtatcactt

SEQ ID NO: 64075 - DNA, 601 bp, Human
ttgctctgtcacccaggctagagtgcagtagcacaatcaactcactgcagcctcctcttcctggactcaagcagtcctaccacctcagcctcccaagtagctgggaccacaggtgtgcaccatcatgcctggctaatttttgtactttttgtagagatagggtttcaccatgtggttcaccatctctaactcctgggctcagtcagtccacttttgcctcggcatgagccactgtgtgcagcccacgttttttattaatggatatttggattgtttccatctattgtgaataatgtggctrtgaacattggtctaaatatctgtttaagtcccggctttcaatacttttggatatatacctaggagtagaattactgaattatatggtaactttctgtttaaatttttgaactgccaacctgttttccataggggctgcaccattttgcattcccaccagcagtgtacaagggttccagtttctccacatttgttatttttcattttttaaaataatagtcatcctaaagggtatgaagtggtatctcgttgtgattttgatttgcatgtatttttctaatgacttatgatgctcagcatt

SEQ ID NO: 64076 - DNA, 601 bp, Human
tcactgcagcctcctcttcctggactcaagcagtcctaccacctcagcctcccaagtagctgggaccacaggtgtgcaccatcatgcctggctaatttttgtactttttgtagagatagggtttcaccatgtggttcaccatctctaactcctgggctcagtcagtccacttttgcctcggcatgagccactgtgtgcagcccacgttttttattaatggatatttggattgtttccatctattgtgaataatgtggctatgaacattggtctaaatatctgtttaagtcccggctttcartacttttggatatatacctaggagtagaattactgaattatatggtaactttctgtttaaatttttgaactgccaacctgttttccataggggctgcaccattttgcattcccaccagcagtgtacaagggttccagtttctccacatttgttatttttcattttttaaaataatagtcatcctaaagggtatgaagtggtatctcgttgtgattttgatttgcatgtatttttctaatgacttatgatgctcagcattttgtcatgtacttatgtaccatttgtgtatcttctttggaa

SEQ ID NO: 64077 - DNA, 601 bp, Human
agtgagctaggattgtgcccctgcactctagtgtgggtgacagcaagactctgtttaaaaaaaaaaaaaaatgaggccgggcgcggtggctcacctctgtaatctgagcactttgagaggccaaggcgggtggatcacctgagttcaagatcagcctggccaacatggtgaaaaccccgtctttatacttaaattacaaagattagctgggtgtgatggtgcacacctgtaaccccagctactccagaggctgagacagcagaatcgcttgaacccgggagggggaggttgcaatgagccragattgcaccactgcactccagcctaggtgacagagcaagactctgtctcaaaaaaaaaagaaaaaaagtctaagaagttaattttcattcagacaaatgttcaaaaataatagaaataaaacaaaaaattaattttcaaatatgtgatttgagtataacgatcactttacagaagttattctacatactttttgattatgctgagtttttaggtccttttaaagcttaacttgtatcaggaattaatgttttaaactagttgttgggttcaaagaaaatagaaatgtgttattaaatgc

SEQ ID NO: 64078 - DNA, 601 bp, Human
aacaatgctttttgtttcattgttattgaaatcatatttgtatttttcaaaagtatatatacttaaaaattcctaaataaaatgtctttctgtaatacagcattttaggttataaggatcaataccatgggctgataagcaaaataggactcacggccccaaaatgttgataaacatcatgaccatattccccataatggagttacatatacacattacaatgataaaaatactaagaagttatatagtaatgtttctcagacttgttcacaaccctgttttttatgtattacctctcaamagcatgatttgcaatatttagtgtactcttcatacgatctatacaaataattttttattttaaagcaggacagaaggagcaagctgtggaatggtataagaaaggtattgaagaactggaaaaaggaatagctgttatagttacaggacaaggtaagattgtatttgtttatagccatcccaaattatgatatattcacatgattgtccagatttcagatctatttatttatttatttatttttctttctttcttttcttttcttttcttttttttttttttttttgagacagggtcttt

SEQ ID NO: 64079 - DNA, 601 bp, Human; identical to SEQ ID NO: 37858

SEQ ID NO: 64080 - DNA, 601 bp, Human
tccatccacctcagcctcccaaagtgctgggataggccgggcacggtggctaacgcctgtaatcccagcactttgggaggccgaggcgggtggatcacgaggtcaggagattgagaccatcctggctaacacggtgaaaccccgtctctagtaaaaaaatacaaaaaactagccaggtgtggtggcgggcacctgtagtcccagctacttgggaggctgaggcaggagaatggcatgaacccaggaggcggagcttgcagtgagccgagatcatgccactgcactccaggctgggcaaaasagcgagactctgtctcaaaaaaataaaataaaataaatagataaataataataataaagtgctgggattacaggcatgagccaccacgcccagctgaagctaatattattagctaataataatatctcatatttttgaccattgaattattaaaggaacctaaaccatagtagtaagtgctttaaaaatgttggtttttatttatctgtttacctgactgtcatcacctcctttgcttaggtagaaagatatattcataaacacatacatatacattttattcattctttaattcattta

SEQ ID NO: 64081 - DNA, 601 bp, Human
tgctgggataggccgggcacggtggctaacgcctgtaatcccagcactttgggaggccgaggcgggtggatcacgaggtcaggagattgagaccatcctggctaacacggtgaaaccccgtctctagtaaaaaaatacaaaaaactagccaggtgtggtggcgggcacctgtagtcccagctacttgggaggctgaggcaggagaatggcatgaacccaggaggcggagcttgcagtgagccgagatcatgccactgcactccaggctgggcaaaagagcgagactctgtctcaaaaaaawaaaataaaataaatagataaataataataataaagtgctgggattacaggcatgagccaccacgcccagctgaagctaatattattagctaataataatatctcatatttttgaccattgaattattaaaggaacctaaaccatagtagtaagtgctttaaaaatgttggtttttatttatctgtttacctgactgtcatcacctcctttgcttaggtagaaagatatattcataaacacatacatatacattttattcattctttaattcatttactcctatatggtcattgtgtttgt

SEQ ID NO: 64082 - DNA, 601 bp, Human
gccgggcacggtggctaacgcctgtaatcccagcactttgggaggccgaggcgggtggatcacgaggtcaggagattgagaccatcctggctaacacggtgaaaccccgtctctagtaaaaaaatacaaaaaactagccaggtgtggtggcgggcacctgtagtcccagctacttgggaggctgaggcaggagaatggcatgaacccaggaggcggagcttgcagtgagccgagatcatgccactgcactccaggctgggcaaaagagcgagactctgtctcaaaaaaataaaataaaatmaatagataaataataataataaagtgctgggattacaggcatgagccaccacgcccagctgaagctaatattattagctaataataatatctcatatttttgaccattgaattattaaaggaacctaaaccatagtagtaagtgctttaaaaatgttggtttttatttatctgtttacctgactgtcatcacctcctttgcttaggtagaaagatatattcataaacacatacatatacattttattcattctttaattcatttactcctatatggtcattgtgtttgtgggatttttgc

SEQ ID NO: 64083 - DNA, 601 bp, Human
ctgctttcagatgagtaacaaggtagtgttccctggcttctgtggctgacaggatttgccttcttcctttctaaatggaggttattactgtgtcagatataattaaatagtgtattaaagtttgttgcaataaaataattgatggttctaattggtactttctacgtgttttatctttaaagcttttcagtgtatatataaagtatatatcatacagaataaatttgattgtggagcattttgtaacatctttcaaaattaataagagttggtttttatgttttgtttgatgttatgatayaggacattagaagtattaatatcaattagagactcatctttgaatgtgactttgtactttcttatttgtgttagtagaggagagaacaaaaagaagatatgtaatgtaatatgaaactaggcatttaaagatttaacgttttggatattttaaagttggtgtctgttttcaccctcaaaaatgctattacctatttatgaaatatctttaaaagtgtggagtggtagatgggaaaggtgacatcggctgggcgcggtggctcacacctgtaatcccagcactttgggaggccaaggtggg

SEQ ID NO: 64084 - DNA, 601 bp, Human
tcaaaaaaaaaaaaacgccgggcactgtggctcacacctgtaatcctagcactttgggagactgaggcgagcagatcacttgaggtcaggagttcgagaccagctgggtgcctgggcaacatagtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactcygtctcaaaaaaaaaaaaaaaaaaaaaaatagccgggcatggtggcgggcacctctaatctcacctacttgggaggttgaggcatgagaattgctcgagcctgggaggcagaggttgcagtaagcagagaccacaccactgcactctagcctggatgacagagtgagactttgtctcaaaacaaaaacaaacaaaccaaaccacctcttgtccactcctaatctcccttactgtgtttcacttatttttttcccatatatttgtcaccttctaataaactgtgtaacttattttttatgtt

SEQ ID NO: 64085 - DNA, 601 bp, Human
tgggagactgaggcgagcagatcacttgaggtcaggagttcgagaccagctgggtgcctgggcaacatagtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaaaaaaaatagccgggcatggtggcgggcacctstaatctcacctacttgggaggttgaggcatgagaattgctcgagcctgggaggcagaggttgcagtaagcagagaccacaccactgcactctagcctggatgacagagtgagactttgtctcaaaacaaaaacaaacaaaccaaaccacctcttgtccactcctaatctcccttactgtgtttcacttatttttttcccatatatttgtcaccttctaataaactgtgtaacttattttttatgtttattgtgtactatctgtcttctccctgttggaatataaactctatggaggaggg

SEQ ID NO: 64086 - DNA, 601 bp, Human
tgaaatactctgacttaaattttagaaggatcactctggttgctatgttgcattatagactctaagggtagaaccagggagagcaattaggacactgttacagtaatctaggagaaaagtgatagaggcttgcaccagggtagtatcaggagaaatggtaacaagtggttggattatgattatagttgaaggtcgaacaactagatttgctgatagattggataaaatggtcctctctttatggatctcataatacagtaggagaaacagacacataaatagtcatcactgcaggatgggkattagaaatattttgcaagggtgtaaaaggtgctaagaaagctttcttgtgtgacaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctggacagcgtactgagaccccatgtctaaatttaaaaaaaaaaaaaatagccaggagtggtg

SEQ ID NO: 64087 - DNA, 601 bp, Human
atagactctaagggtagaaccagggagagcaattaggacactgttacagtaatctaggagaaaagtgatagaggcttgcaccagggtagtatcaggagaaatggtaacaagtggttggattatgattatagttgaaggtcgaacaactagatttgctgatagattggataaaatggtcctctctttatggatctcataatacagtaggagaaacagacacataaatagtcatcactgcaggatggggattagaaatattttgcaagggtgtaaaaggtgctaagaaagctttcttgtgtgmcaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctggacagcgtactgagaccccatgtctaaatttaaaaaaaaaaaaaatagccaggagtggtgatgtgcacctgtagtcctagctacttacttgggaggctgaggcaggaggattgc

SEQ ID NO: 64088 - DNA, 601 bp, Human
acataaatagtcatcactgcaggatggggattagaaatattttgcaagggtgtaaaaggtgctaagaaagctttcttgtgtgacaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctggacagcgtactgagaccccatgtctaaatttaaaaaaaaaaaaaatagccaggagtggtgatgtgcacctgtagtcctagctacttacttgggaggctgaggcaggaggattgcttgagctcaggaggtcgagactgcagtgagccatgagtacaccactgcactctagtctgggtgacagagtgagaccctgtctcaaagaaaatgaaaagaaaaagaatttgagaaaagatatgtcaggaaaatgtgatgacatgaacaaatactcaaaggcaagaaaagcatggtgagtaggggagggtacaggttgagacatgaagttgggattgccg

SEQ ID NO: 64089 - DNA, 601 bp, Human
atgtctaaatttaaaaaaaaaaaaaatagccaggagtggtgatgtgcacctgtagtcctagctacttacttgggaggctgaggcaggaggattgcttgagctcaggaggtcgagactgcagtgagccatgagtacaccactgcactctagtctgggtgacagagtgagaccctgtctcaaagaaaatgaaaagaaaaagaatttgagaaaagatatgtcaggaaaatgtgatgacatgaacaaatactcaaaggcaagaaaagcatggtgagtaggggagggtacaggttgagacatgaarttgggattgccgaggcgtaagaggtataggcagatcatggatggcctggtttgtcataggaaggagcttgggctcttatctgtgggcaatgggaagccactaaagggttttaagtagaagagtgttatatggtaaggttttcctctccagtagatcactcagatgactgtgggggttggatgtgaggaggtaaagcagcaaagttactgctttaatttaaatcattgattaatctgtacaatcctagtcattccaaaaagaaacattagtcctttaacagaagtgaattgggtctgggcg

SEQ ID NO: 64090 - DNA, 601 bp, Human
ttttttatgtattcattgacttgctggtacagaagaaaagaatcaattatgattcagcacaatactccacttggggaagagagtgcagcagtagtttagagtgtcagggatcaaactgctaccttcttgggcttcagttgctagacttaagagacccagatcttgggaggggtttttgttgttatttgatgtgggggtaaggttgaaatactcccttttaattgattaatataaaaaataggtaatgtagacgtatgtcacaaaattttaacaagtttgagtgtgaaaagcatccatcccrttctatgccctggctacccatttcccctccctagaggcggctgttattatcagtttctctgggtcctttttagaggtaatctttttgtatgcaactgtgcacatgtatgtttacacaaatggtagggtattgtatatatatacagttactgcagtatgcttatttgactttgctttattgcttttattttctgcctgacatatgttaatgtggccaaatagggcatttcccagacaatccttatagtttcattctgtgctactttaaatgctgttctccttccctgaaatgtcctttttt

SEQ ID NO: 64091 - DNA, 601 bp, Human
gaatcaattatgattcagcacaatactccacttggggaagagagtgcagcagtagtttagagtgtcagggatcaaactgctaccttcttgggcttcagttgctagacttaagagacccagatcttgggaggggtttttgttgttatttgatgtgggggtaaggttgaaatactcccttttaattgattaatataaaaaataggtaatgtagacgtatgtcacaaaattttaacaagtttgagtgtgaaaagcatccatcccattctatgccctggctacccatttcccctccctagaggcrgctgttattatcagtttctctgggtcctttttagaggtaatctttttgtatgcaactgtgcacatgtatgtttacacaaatggtagggtattgtatatatatacagttactgcagtatgcttatttgactttgctttattgcttttattttctgcctgacatatgttaatgtggccaaatagggcatttcccagacaatccttatagtttcattctgtgctactttaaatgctgttctccttccctgaaatgtcctttttttttttcttttctttttttttttttgagacagagtctcgc

SEQ ID NO: 64092 - DNA, 601 bp, Human
ctgcagtaaacatggggtgtagatgtctgttcgatatgatgattttctttcctttggataaattcccaatagtgggattggtgggtcatatggtagttctgtttgtagtttttgaggaacctccatactcttctccatagtagctgtactagtttagattcccaaaagtagcgtataagagttcactttctacacatcctcaccagcatttggtactttttttgtctttttgataatagccatcctaactggggtaagataccttgttgtggttttgatttgcatttccctcataattaaygatgttgagcattttttcatatctttgtttttgacggtccagctagttttattggttactttttttttttttttttagcaatagtttcatgtgcagggctcaaattatatttaatattacttttttcaaattataccagaacaaccttaggttaggctataaaacaactgccttctttttcttttggcataataattatatatatatttttaattacactttacgttctagggtgcatgtgcacaacatgcaggtttgttacatatgtatacaagtgccatgttggtgtgccgcacccat

SEQ ID NO: 64093 - DNA, 601 bp, Human
gtcatatggtagttctgtttgtagtttttgaggaacctccatactcttctccatagtagctgtactagtttagattcccaaaagtagcgtataagagttcactttctacacatcctcaccagcatttggtactttttttgtctttttgataatagccatcctaactggggtaagataccttgttgtggttttgatttgcatttccctcataattaacgatgttgagcattttttcatatctttgtttttgacggtccagctagttttattggttactttttttttttttttttagcaatartttcatgtgcagggctcaaattatatttaatattacttttttcaaattataccagaacaaccttaggttaggctataaaacaactgccttctttttcttttggcataataattatatatatatttttaattacactttacgttctagggtgcatgtgcacaacatgcaggtttgttacatatgtatacaagtgccatgttggtgtgccgcacccattaacttgtcatttacattaggtatatctcctaatgctacccctcccctctcccctcaccccacgacaggccccattgtgtgatg

SEQ ID NO: 64094 - DNA, 601 bp, Human
ctttggaggagaagaggcgctctgaattttagaattttcagcttttctgctctggtttctccccatctttgtggctttatctacctttggtctttgatgatggtgacgtacagatggggttttggtgtggatgtcctttctgtttgttaattttccttctaacactcaggaccctcagctgcaggtctgttggagtttgctggaggtccactccagaccctgtttgcctgggtatcaccagcggaggctgcagaacagcaaatgttgcagaacgacaaatgttgctgtctgatccttcctytggaaccttcgtctgacaggggtacccaggtatatgaggcgtcagtcagcccgtatggggaggtgtctcccagttaggctacttggggatcagggacccacttgaggaggcagtctgtccgttcgccgatctcaaactccatgctgggagaactactactctctttagagctgtcagacagggacctttaagtctgtagaagttactgctgccttttgttcagctatcccatgtccccagaggtggagtctacagaggcagtcaggcctccttgagctgtggtggactccacccagttca

SEQ ID NO: 64095 - DNA, 601 bp, Human
actcaagcctcagcaatggcagatgcccccgcctccagcctctttgccgccttgcagttcgatctcagactgctgtgctagcagtgagcgaggttccgttggcatgggaccctctgagccaggcatgggatataatctcctggtgtgccgtttgctaagaccattggaaaagcccagtattagggtgggagtctccctattttccaggtaccatatgtcacggcttcccttggctaggagagggaattccccaaccccttgcgcttcccaggtgaggcaataccccgcccttcagctcacrctatgtgggctgcacccactgtctgacaatccccagtgagatgaacccagttcctcagttggaaatgcagaaatcagctgtcttctgtgtcgctcacactgggagctgcagactggagctgttcctatttggccatcttggaaccctgccttcttcattcatatgtaatacaaaacttctaaggttttagtggagaagagatagagtaaaaggatttctatagacagaagaaacagttggtcatcaactctttcccttgtggcttcacatctcccctaaggacttcttatgttggtttgg

SEQ ID NO: 64096 - DNA, 601 bp, Human
tgtcactcaggctggagtgcggtggcgcaatcttggctcactgcaacctccgcagcctcccctaaccccatccctgtgggttcaagcgattctcccacttcatcctcccaagtagctgggactacaggcacctgccaccacacccaactaattttttgtatttttagtagagatgaggtttcaccatgttggtcaagctagtctgagactcctgaccttaagtgatccacctgccctggcctcccaaagtgttgggattacagtcatgagccactgtgcctagccaaatatccaaaacttyttgagcgctgacatgatgctcaaaggaaatactggagtattttgcattttggatttttgggttaaggatgctgaaccagtaagtataatgtaaacattgcaaaatgcaaaaaaatgtaaaaaccctaagcagttctggtcccaagcatttcgcataagggatactcaacccataatcttttcttttctgttttctggttggaagggcatattggctttatagctaatttacacagcattgatgtttaatacacagtgagtccaagtagatcactcagacctattagtagtttattagtgt

SEQ ID NO: 64097 - DNA, 601 bp, Human
ctttatattataggtatatactcttttctctgtttaatttgctttttaactagaagacctcctttagtagttcttttagtgaatatctgtggttaaactcttagtctttccagtgtctgaaataccctcattttaatgtgacaggtcacttttctcacctcaacattttggacatacctcatttccaacaaacatttgttacttctgatagagagtctgctgtcattctcatacttgttccttgtggaaatgtctatatataaagtctcagaactatatatttttaatatatatacatatwtttatttatttaaaaatgtataattaagttagtagtagtagtagtagtagtagtagtagtagtagtagtagtttttttttttttagatggagcctccatctcccgggttcaagtgattctcctgcctcagcctcctgagtagctgggattacaggcacacaccaccatgcctggctaatttttgtattttgagtggagatggggtttcaccatgttggccaggctgatcttaaactcctgacctcagatggaccacctgctttggcctcccaaagcgctaggattacaggcatgaaccac

SEQ ID NO: 64098 - DNA, 601 bp, Human
acctcaacattttggacatacctcatttccaacaaacatttgttacttctgatagagagtctgctgtcattctcatacttgttccttgtggaaatgtctatatataaagtctcagaactatatatttttaatatatatacatatatttatttatttaaaaatgtataattaagttagtagtagtagtagtagtagtagtagtagtagtagtagtagtttttttttttttagatggagcctccatctcccgggttcaagtgattctcctgcctcagcctcctgagtagctgggattacaggsacacaccaccatgcctggctaatttttgtattttgagtggagatggggtttcaccatgttggccaggctgatcttaaactcctgacctcagatggaccacctgctttggcctcccaaagcgctaggattacaggcatgaaccactgcgtctggccttaagttattattgactattgatgccctgttgctctatcaagtagtaggtcttatttattctagaacctcgttttaaggtatcctgaatgtggcttttttttttttttttcctaagacggagtctcactctgttgcccaggctgg

SEQ ID NO: 64099 - DNA, 601 bp, Human
ttttagatggagcctccatctcccgggttcaagtgattctcctgcctcagcctcctgagtagctgggattacaggcacacaccaccatgcctggctaatttttgtattttgagtggagatggggtttcaccatgttggccaggctgatcttaaactcctgacctcagatggaccacctgctttggcctcccaaagcgctaggattacaggcatgaaccactgcgtctggccttaagttattattgactattgatgccctgttgctctatcaagtagtaggtcttatttattctagaacctygttttaaggtatcctgaatgtggcttttttttttttttttcctaagacggagtctcactctgttgcccaggctggagtgcaatggagtgatcttggctcaccgcaatctctgcctccttggttcaagcaattctcctgcctcagcctcctgagtagctgagattacaggcgcacgccaccacacctggctaatttttgtgtttttagtagagacggggtttcaccacattggtcaggcttgtctcaaactcctgaccttgtgatccgcccaccttggcctccgaaagttctgggattaca

SEQ ID NO: 64100 - DNA, 601 bp, Human
ggttcaagtgattctcctgcctcagcctcctgagtagctgggattacaggcacacaccaccatgcctggctaatttttgtattttgagtggagatggggtttcaccatgttggccaggctgatcttaaactcctgacctcagatggaccacctgctttggcctcccaaagcgctaggattacaggcatgaaccactgcgtctggccttaagttattattgactattgatgccctgttgctctatcaagtagtaggtcttatttattctagaacctcgttttaaggtatcctgaatgtggcttttttttttttttttcctaagacggagtctcactctgttgcccaggctggagtgcaatggagtgatcttggctcaccgcaatctctgcctccttggttcaagcaattctcctgcctcagcctcctgagtagctgagattacaggcgcacgccaccacacctggctaatttttgtgtttttagtagagacggggtttcaccacattggtcaggcttgtctcaaactcctgaccttgtgatccgcccaccttggcctccgaaagttctgggattacaggcgtaagccaccacgcccagccta

SEQ ID NO: 64101 - DNA, 601 bp, Human
gtctttttttttggccactctaatttgctgactgacttaacatttgtcttcacagtaaacattgtaaataaacactgatgtttgttgcgtagtatgtaaaaatattatttaggagtggtgagatttaaacatttacaaacctgtaatatatatagtacagcaacactggacaaataaccttttcaacttaatcagaggtgttctataaatgttcatttgcatatatacagcccatataatacttagcatatgtaaaagcacatctttatactctttcaattaaaattgattattattattwttttttttttgagacagagtccctctcagtcacccaggctggattgcagtggtgtgatcagggctcactgcaatcgggtagctggaactacagggatgtgccaccacgcccagctatttttgtatttttagtggagatggggtttcaccatgttggccaggctggtcttgaactccatacctcaggtgatctgcccgcctcagcctcccaaaatgctgggattacaggcgtgagctactgcacccggcctaaaattgattagtttttaagaccctcttggtgggaacagactttcatagt

SEQ ID NO: 64102 - DNA, 601 bp, Human
tatttgcttcataactttttttttttttttttttttttgagacagagtttcactctgtcacccaggctggagtgcagtagtgcaatctcggcttactgcaacctccgcctcctgagttcaagtgattctcctgcctcagcctccgaagtagctgggattataggcccccaccaccacgtctgactgattttttgtatttttagcagagacgaggtttcaccatgttggccagcctggtcttgaactactgacatcaggtgatccgtccacctcgatctcccaaagtgctgggattacaggygtgagccatcgcgcccggcgcttcataacctttttatattgtctttctgttccccaaaatgaagtagtttcttcttaaaaatactgttttttgtttttttgtttttttttttatttgagatggagtctctctctgtcgccaggctggagtgcagtggcacgatctcggctcacttcaacctctgactccgtggttcaagcaattctcctgcctcagcctcccaggtagctgggattacaggcacaaatactgtttttaataagaaaattagaatagggacaggcacaatggctcactctt

SEQ ID NO: 64103 - DNA, 601 bp, Human
ttgagacagagtttcactctgtcacccaggctggagtgcagtagtgcaatctcggcttactgcaacctccgcctcctgagttcaagtgattctcctgcctcagcctccgaagtagctgggattataggcccccaccaccacgtctgactgattttttgtatttttagcagagacgaggtttcaccatgttggccagcctggtcttgaactactgacatcaggtgatccgtccacctcgatctcccaaagtgctgggattacaggcgtgagccatcgcgcccggcgcttcataacctttttrtattgtctttctgttccccaaaatgaagtagtttcttcttaaaaatactgttttttgtttttttgtttttttttttatttgagatggagtctctctctgtcgccaggctggagtgcagtggcacgatctcggctcacttcaacctctgactccgtggttcaagcaattctcctgcctcagcctcccaggtagctgggattacaggcacaaatactgtttttaataagaaaattagaatagggacaggcacaatggctcactcttgtaatcccagcactttgggaggccaaggtgggagga

SEQ ID NO: 64104 - DNA, 601 bp, Human
agagtttcactctgtcacccaggctggagtgcagtagtgcaatctcggcttactgcaacctccgcctcctgagttcaagtgattctcctgcctcagcctccgaagtagctgggattataggcccccaccaccacgtctgactgattttttgtatttttagcagagacgaggtttcaccatgttggccagcctggtcttgaactactgacatcaggtgatccgtccacctcgatctcccaaagtgctgggattacaggcgtgagccatcgcgcccggcgcttcataacctttttatattgtytttctgttccccaaaatgaagtagtttcttcttaaaaatactgttttttgtttttttgtttttttttttatttgagatggagtctctctctgtcgccaggctggagtgcagtggcacgatctcggctcacttcaacctctgactccgtggttcaagcaattctcctgcctcagcctcccaggtagctgggattacaggcacaaatactgtttttaataagaaaattagaatagggacaggcacaatggctcactcttgtaatcccagcactttgggaggccaaggtgggaggattgcctg

SEQ ID NO: 64105 - DNA, 601 bp, Human; identical to SEQ ID NO: 37859

SEQ ID NO: 64106 - DNA, 601 bp, Human; identical to SEQ ID NO: 37860

SEQ ID NO: 64107 - DNA, 601 bp, Human
aataactatatgtcatagggcttaggcttcatcttgtaataactgggccctgtttgtatcgtagaactaactgaggtcttgtttcttagtggaacagctgttaaatttgatgatatagctggtcaagacttggcaaaacaagcattgcaagaaattgttattcttccttctctgaggcctgaggtaagaactttatattatcatttttctataataccatctgttactgaatccatagtagtagtagtagtaaagaaatatttgagctatactaaaataattaattcatataaggtaacartagatttaatgttttaaaaaagataaaacattaacaattgatgttgagaagttattatagaataggaaaatggatatgagttcctaatttccaatccttttatatttttaggaaaagtgggtagtatgatataattttgttttgttttggagacggagtctcactcattgtgtcgcccaggctggagtgcagtggcatgatcttagctcactgcaacctctgcgtcccagaattcaagtgattctcctgcctcagcctcccaagtagctgggattacaggcatgtgccactatgcccagc

SEQ ID NO: 64108 - DNA, 601 bp, Human
atgtcatagggcttaggcttcatcttgtaataactgggccctgtttgtatcgtagaactaactgaggtcttgtttcttagtggaacagctgttaaatttgatgatatagctggtcaagacttggcaaaacaagcattgcaagaaattgttattcttccttctctgaggcctgaggtaagaactttatattatcatttttctataataccatctgttactgaatccatagtagtagtagtagtaaagaaatatttgagctatactaaaataattaattcatataaggtaacaatagatttartgttttaaaaaagataaaacattaacaattgatgttgagaagttattatagaataggaaaatggatatgagttcctaatttccaatccttttatatttttaggaaaagtgggtagtatgatataattttgttttgttttggagacggagtctcactcattgtgtcgcccaggctggagtgcagtggcatgatcttagctcactgcaacctctgcgtcccagaattcaagtgattctcctgcctcagcctcccaagtagctgggattacaggcatgtgccactatgcccagctaatttttg

SEQ ID NO: 64109 - DNA, 601 bp, Human
gtgtaaccccagctactcgggatgctgaggcaggagaatcgcttgaacccgggaggcggaggttgcagtgagccgagatcacgccactgcactccagcctggcgacagagcgagactccgtctcaaaaaaataaataaaaatttaaaaagataaatacataaaaataaataaataatattaagagaaggaaatcaggcaggtagtggcccctgacacaatgagttttcccagaattggattgcttggaaatgccgctcaaagagtgtggtaaactccatcgaaggctaaataccaacgtgmcagtgataataaacaagtactttatgggaaagttttttttttaattatttttaaaaagagagaaattgtactggagaaaagaggaattcaggtagaataattcttttttttttttttttttgagatggaattttgctcctgttacccaggctggagtgcagtggcttgatgttggctcactgcaacctctgcctttggggttcaagtgattctcatgcctcatcctcctgagtagctgggtctataggcatgcaccccaacacctggctaatttttgtgtttttagtagagatagggttt

SEQ ID NO: 64110 - DNA, 601 bp, Human
gtagaataattcttttttttttttttttttgagatggaattttgctcctgttacccaggctggagtgcagtggcttgatgttggctcactgcaacctctgcctttggggttcaagtgattctcatgcctcatcctcctgagtagctgggtctataggcatgcaccccaacacctggctaatttttgtgtttttagtagagatagggttttaccattttggccaggctggtctcaaactcctggcttcagatgatccgcccaccttggcttcccaaagtgctgggattacaggcagaggccmctgtgcctggcatgaagaacaatttttaaaagaatgacttttaaggatattaagtcatcaaagtagatagagccattaaatgatgggtagaaacctaatcttccatcccatattttatgacttattaaggaagataggcaatcttgcagttgataataaatatttggctttccatacttagcaccgttttgaatttttccagttcacagatggtatatttagtgctgttccaataatattgcaaaaaataaatctgaagactcacttctgggtcacagttatttcactattaacattaaa

SEQ ID NO: 64111 - DNA, 601 bp, Human
ctgggattacaggcagaggccactgtgcctggcatgaagaacaatttttaaaagaatgacttttaaggatattaagtcatcaaagtagatagagccattaaatgatgggtagaaacctaatcttccatcccatattttatgacttattaaggaagataggcaatcttgcagttgataataaatatttggctttccatacttagcaccgttttgaatttttccagttcacagatggtatatttagtgctgttccaataatattgcaaaaaataaatctgaagactcacttctgggtcacagwtatttcactattaacattaaaatcttacggacctacctgcaacatgtagtggaaataagttgtgtggcacgttgtggtgggtgcattattaaataaatgtgcaaaggttttatggctgtctcaatttttccatagtcttgagtcattcacatactgcctttatggtgtttatcacttgtaagtgagtaccaactgtactagaacttactgaatatttttcaagtctattttacttattactcattctaagtacataaaatcactggtctgatatgcaagttaggttttcgctaataccca

SEQ ID NO: 64112 - DNA, 601 bp, Human
aacttactgaatatttttcaagtctattttacttattactcattctaagtacataaaatcactggtctgatatgcaagttaggttttcgctaatacccagtaaaataattagataattattaaaatagaaagcatttgtcattatgtgaactggatttatgtcatgtaccacctcaggtcacactttgggaaacgtagcttacgtattgagctaacattttgctggagttatataagattagtaaatgctatagactaaatattgaaaaaaaagcttgcttaaagaggatttacataattrtagacctgaaaaggatcttagcagtcttctgatcgattcattgataaagaaactagtcctaagagctaaaatgacttgctcaagattttagttaagtggtagacctaggaaatacctttctaagattagagctgcctggttagtgctatagctgccacctaattcttacatttatttattaagggacatgctttttacggtagaaaaatatatctaaaattgtgaaggtaataccaaggaaatatttaggctatgcaagaaaagtcattcagcttttgctttacccaggcctatagagaa

SEQ ID NO: 64113 - DNA, 601 bp, Human
tactgaatatttttcaagtctattttacttattactcattctaagtacataaaatcactggtctgatatgcaagttaggttttcgctaatacccagtaaaataattagataattattaaaatagaaagcatttgtcattatgtgaactggatttatgtcatgtaccacctcaggtcacactttgggaaacgtagcttacgtattgagctaacattttgctggagttatataagattagtaaatgctatagactaaatattgaaaaaaaagcttgcttaaagaggatttacataattgtagwcctgaaaaggatcttagcagtcttctgatcgattcattgataaagaaactagtcctaagagctaaaatgacttgctcaagattttagttaagtggtagacctaggaaatacctttctaagattagagctgcctggttagtgctatagctgccacctaattcttacatttatttattaagggacatgctttttacggtagaaaaatatatctaaaattgtgaaggtaataccaaggaaatatttaggctatgcaagaaaagtcattcagcttttgctttacccaggcctatagagaacata

SEQ ID NO: 64114 - DNA, 601 bp, Human
acttattactcattctaagtacataaaatcactggtctgatatgcaagttaggttttcgctaatacccagtaaaataattagataattattaaaatagaaagcatttgtcattatgtgaactggatttatgtcatgtaccacctcaggtcacactttgggaaacgtagcttacgtattgagctaacattttgctggagttatataagattagtaaatgctatagactaaatattgaaaaaaaagcttgcttaaagaggatttacataattgtagacctgaaaaggatcttagcagtcttckgatcgattcattgataaagaaactagtcctaagagctaaaatgacttgctcaagattttagttaagtggtagacctaggaaatacctttctaagattagagctgcctggttagtgctatagctgccacctaattcttacatttatttattaagggacatgctttttacggtagaaaaatatatctaaaattgtgaaggtaataccaaggaaatatttaggctatgcaagaaaagtcattcagcttttgctttacccaggcctatagagaacatatctaaaataataagtaacatgtgaat

SEQ ID NO: 64115 - DNA, 601 bp, Human
ctagaaatcaacccacacagataaagtcaactgatctttggcaaagggacaaagacaattcagtggagaaaagatagccttttcaacaaatggtataggacaactggacatccacatgcaaaaaagttaatctagacacagacctgacaactttcacaaaaataaatggatcatagacctaaatgtaacatgcgaactgaaacttctagaggataacataggagaaaatctaggataacatgagaaaaatttttggtttggcagtgacttcttaggtacaataccaaaacatgatccttgaaaaaaaaaatcagtatgttgaactttgtttaaattataaacttctgctctgtgtaagatgctgttaggagaatgaaaagacatgcagcagagtgggagactttacaaaattcattatctgatgaaggaccagtatccaaaatatacaaagaacttttaaaactcaacaataagaaaatatacaacccagttaataaatgggcaaaatatctgaacagacacctcaccaaggaagatagatagatgacaacaagcatatgaatatatgctcaacatcatgtcgttagggaaattgcgcatt

SEQ ID NO: 64116 - DNA, 601 bp, Human
tttggaaggtagttggacagttttttacagaactaaagacagtttgacagtttcttacaaaactcttaccatatggtccagcagtcttactccttagtatttacccaaataagtttaaaatgtacatccaataaaaaaaactgcacatgaatatttctagcagcattattcatagttgccaaaacttggaagcagtcaaggcatccataagtaggggaatggataaacagactttggtatatcatgtaatggagtattattcagcaataaaaagaaatgatctatcaagccacaaaaatayatggaggaaccataaatgcatattgctaaatgaaagaagccagtctgaagaggctacactataggattctgactatatgatgttttggaaaaggcaaaactatggaaacagtaaatagatcagtggttgccaagggagacagggagagatgaataggtggagcacagtggatttttaaggcagtgaaactgttctttatgataatccaatggtggatacatgtcattatacctttgtcaaaacccacagaatataaaacataagagtgaaccctaatgtaaaatatggacttcagttaat

SEQ ID NO: 64117 - DNA, 601 bp, Human
tcattatacctttgtcaaaacccacagaatataaaacataagagtgaaccctaatgtaaaatatggacttcagttaataataatatatgaatattttttcattagttctaacaagtgtactacactaatacaagatattcagagtaggggaaattggaaaggaatgagaggttatatgggaactctgtactttctgctcaattttctgtaaacctaaaatcactaaaaaaaaagtttatttttatttttatttttttttaatttttaattttttgagatggagtttcactcttgttgcccrggctggaatacaatggcacgatctcggctcactgaaacctccgcctccagggttcaagcgattctcatgcctcaacctcccgagtagctgagattacaggcatgtgccaccacgcccagctaattttgcagttttagtagagacagggtttctccatgttggtcaggctggtcttgaactcctgatctcaggggatctgcccgcctcggcctcccaaagtgctgtgattataggcgtgagccactgcgcccagcaggtttttttttttaagttggatattagccatttcatatgattcaa

SEQ ID NO: 64118 - DNA, 601 bp, Human
tattttttcattagttctaacaagtgtactacactaatacaagatattcagagtaggggaaattggaaaggaatgagaggttatatgggaactctgtactttctgctcaattttctgtaaacctaaaatcactaaaaaaaaagtttatttttatttttatttttttttaatttttaattttttgagatggagtttcactcttgttgcccaggctggaatacaatggcacgatctcggctcactgaaacctccgcctccagggttcaagcgattctcatgcctcaacctcccgagtagctgrgattacaggcatgtgccaccacgcccagctaattttgcagttttagtagagacagggtttctccatgttggtcaggctggtcttgaactcctgatctcaggggatctgcccgcctcggcctcccaaagtgctgtgattataggcgtgagccactgcgcccagcaggtttttttttttaagttggatattagccatttcatatgattcaacttaaaagtacatacaccttcactgttattaaagtgtaggtgagatgttttcagtctggagctctacccttgattcctgccatgcctagtg

SEQ ID NO: 64119 - DNA, 601 bp, Human
attcctgccatgcctagtgtccctgaatctggagactctgacttatttctttagagaacgaaactcctgccttctgctttggtggtgattggtacctgcttgactgcctttggtggggagttcctcataccaactttcaatcagttcctgtgtttgtttgtttgtttgtttttgagacggagttttgctctgtcgcccgggttggagtgcagtggcgcaatcttggctcaatacacgctccgcctcccgggttcacgccattttcctgcctcagcctcctgagtagctgggacgacaggcrcccgccaccacgcccggctaatttttttgtatttttagtagagacggggtttcatcgtgttagccaggatggtctcgatctcctgacctcgtgatccgcccgccttggcctcccaaagtgctgggattacaggcgtgagccactgtaagccaccgtgcccggccagttcctctgtttttgactgcctgccttactactgctttctgtggtgcctgataacatccaattcctgaaccttcctgggatttttgttcacgtcagcgtgcttcttgcatttaggtatcccttcacaagtaggca

SEQ ID NO: 64120 - DNA, 601 bp, Human; identical to SEQ ID NO: 37861

SEQ ID NO: 64121 - DNA, 601 bp, Human; identical to SEQ ID NO: 37862

SEQ ID NO: 64122 - DNA, 601 bp, Human; identical to SEQ ID NO: 37863

SEQ ID NO: 64123 - DNA, 601 bp, Human; identical to SEQ ID NO: 37864

SEQ ID NO: 64124 - DNA, 601 bp, Human; identical to SEQ ID NO: 37865

SEQ ID NO: 64125 - DNA, 601 bp, Human; identical to SEQ ID NO: 37866

SEQ ID NO: 64126 - DNA, 601 bp, Human; identical to SEQ ID NO: 37867

SEQ ID NO: 64127 - DNA, 601 bp, Human; identical to SEQ ID NO: 37868

SEQ ID NO: 64128 - DNA, 601 bp, Human; identical to SEQ ID NO: 37869

SEQ ID NO: 64129 - DNA, 601 bp, Human; identical to SEQ ID NO: 37870

SEQ ID NO: 64130 - DNA, 601 bp, Human; identical to SEQ ID NO: 37871

SEQ ID NO: 64131 - DNA, 601 bp, Human; identical to SEQ ID NO: 37872

SEQ ID NO: 64132 - DNA, 601 bp, Human; identical to SEQ ID NO: 37873

SEQ ID NO: 64133 - DNA, 601 bp, Human; identical to SEQ ID NO: 37874

SEQ ID NO: 64134 - DNA, 601 bp, Human; identical to SEQ ID NO: 37875

SEQ ID NO: 64135 - DNA, 601 bp, Human; identical to SEQ ID NO: 37876

SEQ ID NO: 64136 - DNA, 601 bp, Human; identical to SEQ ID NO: 37877

SEQ ID NO: 64137 - DNA, 601 bp, Human; identical to SEQ ID NO: 37878

SEQ ID NO: 64138 - DNA, 601 bp, Human; identical to SEQ ID NO: 37879

SEQ ID NO: 64139 - DNA, 601 bp, Human; identical to SEQ ID NO: 37880

SEQ ID NO: 64140 - DNA, 601 bp, Human; identical to SEQ ID NO: 37881

SEQ ID NO: 64141 - DNA, 601 bp, Human; identical to SEQ ID NO: 37882

SEQ ID NO: 64142 - DNA, 601 bp, Human; identical to SEQ ID NO: 37883

SEQ ID NO: 64143 - DNA, 601 bp, Human; identical to SEQ ID NO: 37884

SEQ ID NO: 64144 - DNA, 601 bp, Human; identical to SEQ ID NO: 26270

SEQ ID NO: 64145 - DNA, 601 bp, Human; identical to SEQ ID NO: 26271

SEQ ID NO: 64146 - DNA, 601 bp, Human; identical to SEQ ID NO: 36819

SEQ ID NO: 64147 - DNA, 601 bp, Human; identical to SEQ ID NO: 36820

SEQ ID NO: 64148 - DNA, 601 bp, Human; identical to SEQ ID NO: 36821

SEQ ID NO: 64149 - DNA, 601 bp, Human; identical to SEQ ID NO: 36822

SEQ ID NO: 64150 - DNA, 601 bp, Human
ataaattattttagttagtcaccctcttggggtcatttggtcttcctgcccattcatgatagggagttccaaaccaaccaggagacatagcacgagtgagtgatgttgaggagatatggacataacttcctggaaaatattggtattcaactcatactgggcaggaagaagagaaggagcatgttctcctataaactgacagctcagtggggtcatcaagaggggacctgggcctcttgtgagaggattgtgttgactcacccaattggtaaaaagtacatgaggaacataattttccccrtcactttatagaagttgcttatgaacaaataacataagaagaaaatacagttttaaaataaacatatgtaaaaatgatcaactttgctagtaatcaacaaattctatacgaaaacatcaatgaagatctttttaacctgttatttgagtggggggtggtggcagaagagtaaagcagcaatatagccaggtgattaagagcactgtggcattagacagggtctgagtttagtttagatactaccatttagttgctgtgtgacctcggacatggcttataaaccttctgaaccttagcttc

SEQ ID NO: 64151 - DNA, 601 bp, Human
gtccattgtatcctctttactagatagataatgtaagcaaggtctcaagatgagctggcagcccgattgttttctatcttgtattgaatgatgaaatgataaaatgaaaagtttaaaattcagaattcttttgaatattcttcttatgccacccatgtacaaatatcaatagcttaaatagtgcagaacaggcttaggaagcagtaattaattaaaaaatctcacctacttatttatggtgagaacacaaaatatagtcttagcaattttcaaagtaattaactttttaaaaacccaaatrttaatgacaaatatcagagataagagctaaggactttgaatggtttttcttagagggggaatggatggggagaagggactacaacctggtaattaaaaattattttaaaggccctgcagacagccgtctttactgacgcctatagatttcggttggttccagtaacatcttttgcttctttatctttcttttcatacctttttttctattgtagggggttgaggaacacaaacatagaggcaaatgaggtatgtgggataacatatattatatatttcatttattttgaccctagcactt

SEQ ID NO: 64152 - DNA, 601 bp, Human
atctttcttttcatacctttttttctattgtagggggttgaggaacacaaacatagaggcaaatgaggtatgtgggataacatatattatatatttcatttattttgaccctagcacttattttcacaaatatctttgtattttttaggtgctagtgaaaaaaatataaagtgaaaataaatatccctctatgttttttgggcatagaggccaaatgtgctaaacaaaacaacattttaattaattataaccttgttttacttggtagttacctaattggttggttatttttagggttcastttgtgtgctggtaaaaaatgttgtgattcttttgtgtttttatttcttgtaacatttttagttgggaactcttggctaataaaatcttctaattttttttaacttagaatctagagcaacagaatgtaatatataagctcagattcctaagttactcatgcctctgactttttatatgaggctagcaattcatttatttaacaatgtcatcatcatggtaatcatcaaaatgtacttgaggcatttatgtctgtgttcccatatctttcccactatatgaagtacaataaattgactaa

SEQ ID NO: 64153 - DNA, 601 bp, Human
tctctcctttacctgttctagagaatcccatcagggtacctgtggccttttgctgtctagccttctccatcagattgtgctccttgaagacagggacttcttacctagcactgggctggagcaaggagtgaatacctttgaagtttgaataataacatgcattttccatggtttttaaaactgtttctattatttattttaaaaattatttttgtatattaattaaaaaattgttatgtatttacggggtacaagtacagatctttttttcttttcttttcttttttttttttttttttttctttttgagacagagtctgactctgtcacccagactggagtgcagcggtgcaatctcagctctctgcaacctccgcctcctgggttcaaacgattcacccacctcagcctctcgagtagctgggattgcaggtgcatgccaccacgcctggctaatttttgtatttttagtagagacggggtttcactatgttggccaggttagtcttgaactcctgaccttaggtgatctgcccacttcggcctccctaagttctgggattacaggcgtgagccagtgcgtctggccatgagtacagat

SEQ ID NO: 64154 - DNA, 601 bp, Human
attatttattttaaaaattatttttgtatattaattaaaaaattgttatgtatttacggggtacaagtacagatctttttttcttttcttttcttttttttttttttttttttctttttgagacagagtctgactctgtcacccagactggagtgcagcggtgcaatctcagctctctgcaacctccgcctcctgggttcaaacgattcacccacctcagcctctcgagtagctgggattgcaggtgcatgccaccacgcctggctaatttttgtatttttagtagagacggggtttcacyatgttggccaggttagtcttgaactcctgaccttaggtgatctgcccacttcggcctccctaagttctgggattacaggcgtgagccagtgcgtctggccatgagtacagatttcttacatgcatacattgcatagtggtgaagtctgggcaggttttttttttttttttttaagcaaaatgcaaagttataggtagagtgaaaccacaactatggttgcaaatgctatataaagcaggtggaaaacaaatgaaacaacttctagattcaaaaagcattactttgtaaagatgtaattcc

SEQ ID NO: 64155 - DNA, 601 bp, Human
tacagatctttttttcttttcttttcttttttttttttttttttttctttttgagacagagtctgactctgtcacccagactggagtgcagcggtgcaatctcagctctctgcaacctccgcctcctgggttcaaacgattcacccacctcagcctctcgagtagctgggattgcaggtgcatgccaccacgcctggctaatttttgtatttttagtagagacggggtttcactatgttggccaggttagtcttgaactcctgaccttaggtgatctgcccacttcggcctccctaagttytgggattacaggcgtgagccagtgcgtctggccatgagtacagatttcttacatgcatacattgcatagtggtgaagtctgggcaggttttttttttttttttttaagcaaaatgcaaagttataggtagagtgaaaccacaactatggttgcaaatgctatataaagcaggtggaaaacaaatgaaacaacttctagattcaaaaagcattactttgtaaagatgtaattccatttattttagctattttcttctttaccgggacactccagaccctctctgtagttttgcgttactcg

SEQ ID NO: 64156 - DNA, 601 bp, Human
ctctctgcaacctccgcctcctgggttcaaacgattcacccacctcagcctctcgagtagctgggattgcaggtgcatgccaccacgcctggctaatttttgtatttttagtagagacggggtttcactatgttggccaggttagtcttgaactcctgaccttaggtgatctgcccacttcggcctccctaagttctgggattacaggcgtgagccagtgcgtctggccatgagtacagatttcttacatgcatacattgcatagtggtgaagtctgggcaggttttttttttttttttttaagcaaaatgcaaagttataggtagagtgaaaccacaactatggttgcaaatgctatataaagcaggtggaaaacaaatgaaacaacttctagattcaaaaagcattactttgtaaagatgtaattccatttattttagctattttcttctttaccgggacactccagaccctctctgtagttttgcgttactcgattcagcttggtctcagctgttaaaggtctaatgctaaattagtggtggggatgggagctaaaatgacttcaaatttcctcagcctattgttgttcaaggctata

SEQ ID NO: 64157 - DNA, 601 bp, Human
ccatgcctggctaatttttgtgttttttttgttttttgtagagacggggttttgccctgttgtccaagctggttttgaactcctggcttcaagcaatctgcctgcctcaggctcccaaagtgctaggattacaggcatgagccactgtacccaggcaaaatgtagatttttttttttagacctgctttatttcaaaaagcttttgaagtgatacagctgtatatttttatggcaaaaaccagcccatcttcaaactgataaatagggccacctaactgcaaagaaatgattaatttataaytttgttgtattttttaatgaaacaaaatataactttggtagggcttagagatagttaaaagcagtgtttgaaaaaaaattaaaaagcaataaagtttaaagagattaagttccagaggagttttttttaattagtgtgctggatacatatttttttcttttttctttttggagaacctcttcattttgaattctttttatgagtcctcatgatcacttgtttgctcaaattcttctgtctcacatctccactatgagctgaaagattattcgagtatcatatgtttagagtaatcctttc

SEQ ID NO: 64158 - DNA, 601 bp, Human
gaggtttttgattattctaagttgaagattttgatccacttaaattgcaacacttctcatgcctgttactgacagatcactgcaagcttagcccttcgttaggaaaaaaccaaacaaaccaaaaacccagattccaagaacagcacagaatgaaattcttaagaaaatgcaactgtgtgagaagcaaagtcttgtcaccccaagtttttacggatcaaaaaattgtatgcacataccctcataaatgttgttggaaagaattatggaaaaactgagagaggcagagaagtgtgaaaagatkacgcttccccctcgcttgtcacagtaccacagaggaggctgcctcagtttcttcactcaaaatgagctactcctaagccacataaaactagttattcctttactaaaaaacaactgatcatcagatttggcgactgtacatttttatctacatatatgcaataaacagctttaattattattcatgaataaggaaggtgctattggatagtttcctctgacagtttgcagtcaaaaaaaaggttaaagataaataacccctaatgtttaaaaaatgtaatattttaactttaataagggt

SEQ ID NO: 64159 - DNA, 601 bp, Human
ttaaaaaatgtaatattttaactttaataagggtctgaattaaggcagcagggtaagtgtgaaaaagtaaatgaatattatttctagtatatattattaattctttgaagaagaatgatacactcctttcatataatttattttaaaaatagtgatagaggcaggatgaagtagcctgttggatgtgtagtatgtatgatgtgcattatttaggtgtgccttattaaagaagacatatattccaccatcttttaaaataagaaactttctgctatattaaaaattaagctaaaaattttayatttgtttatttctttgtaacaataatgttagtacagttaggcccagcagtagctatatgtatgggcaagagacatgcttatatttacttttttaaaactcatattgaagaaaatttggcaaacagagaaaaaagataccacccatagtaccatcaacccagtataaatgctgttagcatgttgatataacatgtagccttttctctttgcatttttagacataggtataaccagtttttaatcttgtttgttatgtaacagtataggatatgtcacatattattgtgtaatggaagata

SEQ ID NO: 64160 - DNA, 601 bp, Human
atttattttaaaaatagtgatagaggcaggatgaagtagcctgttggatgtgtagtatgtatgatgtgcattatttaggtgtgccttattaaagaagacatatattccaccatcttttaaaataagaaactttctgctatattaaaaattaagctaaaaattttacatttgtttatttctttgtaacaataatgttagtacagttaggcccagcagtagctatatgtatgggcaagagacatgcttatatttacttttttaaaactcatattgaagaaaatttggcaaacagagaaaaaakataccacccatagtaccatcaacccagtataaatgctgttagcatgttgatataacatgtagccttttctctttgcatttttagacataggtataaccagtttttaatcttgtttgttatgtaacagtataggatatgtcacatattattgtgtaatggaagatatattataaaaattttttgaagatttacttaaaatttgaaatgaggcaatgatattttcagggactgaagataaatttcttggctcactgctttttttggtcaaccttttttgagcatctaagttggtacatatca

SEQ ID NO: 64161 - DNA, 601 bp, Human; identical to SEQ ID NO: 36823

SEQ ID NO: 64162 - DNA, 601 bp, Human; identical to SEQ ID NO: 36824

SEQ ID NO: 64163 - DNA, 601 bp, Human; identical to SEQ ID NO: 36825

SEQ ID NO: 64164 - DNA, 601 bp, Human; identical to SEQ ID NO: 36826

SEQ ID NO: 64165 - DNA, 601 bp, Human
atgttgacctctctaaaccttagtttggttacccataaaatgtaaataattagagtacttatttcatagggtcattgtaaagagtaaatgagatattgtatgctaagcatttagctcaatcccaggcacatattaagcacgcaaaagaacaaaaacaaccaaagagttgtatttaagaaataaaacatgcaagcgggtcaggctaatttaaaagatttaaaaaaaaatgaatggggtgtggcaaattcatttgaatagtcagttataatgctatataaatgagatattactcttcatacastatgtttctacaaataatgaacaaaaactatgtattgttataacttttaaagtagtccctacagataagtttgcctagttttaggtcttcatctgaaagatagagtctgctaacagccttcagttctctcaactctgttcatgacctccaacagtatgactggccgtcaagtgccagagccacaggaaagtagaagtttcacattgctgaagccactcacccaggcaggatacagttctgtgtatcaaacacctatgtcctttcttcctccttccaataaaataaactgcccctcttagt

SEQ ID NO: 64166 - DNA, 601 bp, Human
tgcagaggttactgctgtctttttgtttgtctgtgccctgcccccagaggtggagcctacagaggcaggcaggcctccttgagctgtggtgggctgcacccagttggagcttcccagctgctttgtttacctaagcaagcctgggcaatggcgggcgcccctcccccagcctcgctgccgcctttcagtttgatctcagactgctgtgctagcaatcagcgagactctgtgggggtaggaccctccgagccatgtgtgggatataatctcctggtgctccgttttttaagccgattggaaragcacagtatttgggtgggagtgacccgattttccaggtgccgtctgtcacccctttctttgactaggaaagggaactccctgaccccttgcgcttcccgagtgaggcaatgcctcgccctgcttcggctcgcgcacccactgacctgcgcccactgtctggcactccctagtgagatgaacctggtacctcagatggaaatgcagaaatcacccgtcctcttcatggctcacgctgggagctgtagaccggagctgttcctattcggccatcttggctcctacctcccatgaatatttt

SEQ ID NO: 64167 - DNA, 601 bp, Human
tgctgtctttttgtttgtctgtgccctgcccccagaggtggagcctacagaggcaggcaggcctccttgagctgtggtgggctgcacccagttggagcttcccagctgctttgtttacctaagcaagcctgggcaatggcgggcgcccctcccccagcctcgctgccgcctttcagtttgatctcagactgctgtgctagcaatcagcgagactctgtgggggtaggaccctccgagccatgtgtgggatataatctcctggtgctccgttttttaagccgattggaaaagcacagtattygggtgggagtgacccgattttccaggtgccgtctgtcacccctttctttgactaggaaagggaactccctgaccccttgcgcttcccgagtgaggcaatgcctcgccctgcttcggctcgcgcacccactgacctgcgcccactgtctggcactccctagtgagatgaacctggtacctcagatggaaatgcagaaatcacccgtcctcttcatggctcacgctgggagctgtagaccggagctgttcctattcggccatcttggctcctacctcccatgaatattttcttaatctaaag

SEQ ID NO: 64168 - DNA, 601 bp, Human
tctgtgggggtaggaccctccgagccatgtgtgggatataatctcctggtgctccgttttttaagccgattggaaaagcacagtatttgggtgggagtgacccgattttccaggtgccgtctgtcacccctttctttgactaggaaagggaactccctgaccccttgcgcttcccgagtgaggcaatgcctcgccctgcttcggctcgcgcacccactgacctgcgcccactgtctggcactccctagtgagatgaacctggtacctcagatggaaatgcagaaatcacccgtcctcttcrtggctcacgctgggagctgtagaccggagctgttcctattcggccatcttggctcctacctcccatgaatattttcttaatctaaagataccaaagcactaaaaagagatgataaagcaaggtagaaggtgaaaagatactgaagtggctggggacagagataggaagtaatgaaaattctccaggccaaatgaaatatgtaaaaccaatatatttatagaatattacattttttacaaatatatactagtgcaatcttctgttgtccagctgatttatattattgctctattagcaaga

SEQ ID NO: 64169 - DNA, 601 bp, Human; identical to SEQ ID NO: 36827

SEQ ID NO: 64170 - DNA, 601 bp, Human
aaagacagttggataaaaatattagaggtgttttagcaattcttcccacagtagctggcactgtatgtgcccaatatatatctgttgaatgagtaacatgcttacatttatatgaaatggaaacttcactcctctggttgtggatacttagaactgccaacttctcttgagagcaaaagaaaataacaccaaatgtactatttacaagtcatacactatgaaacacttaagtagtttcaaaatatttccaattagcaagaaactctaaaacaaatgtagcaattcataaatataaggtagsaacgtaagtggttacagtaaaacatacacaattacaagattttttaaggcaaactggaattcagacgagttcccagaaagcacactctttttcggcagcatattgttgacactaccttactaaattaaaccccgagacagaaacactctcctgaccaaaacaccagaactccaaaggagataaaagcaccataaatatgagtaagcactacagtattcatcctttttttaaattgtaagtttctattctagtaataagggacccaaaaactactaacataaataataaaagagcttaaca

SEQ ID NO: 64171 - DNA, 601 bp, Human
aaaaaaaaaaaaaaaattatgatgtatccaatatggtctttgtctattccaaaaaccagagcttgtggagaatataatcaaagctactgacgctccaccaaggacaccatgaattctccaatccacacacaacacagcacatggtgctcatcaggctggccctcacagattcccacggtaaagacccacggatgtccagaaccatccagctctattactcggacagagacctgcctgaaactgcctggcaggccctttcccctctctggggactgttctttccccaacgccaacaggcaarcgctgccatgtttttataactgcttagtccaagggacggccacaaatgaccaaggccagaccaatcccaagtggaatccttccacggtatttttataactgaattagagacaggaaacccttttgggggagcagaaatgacaaaatgtgaaatacaggaaccgttcattccctgctctgtggaggaaccagccagctatgaaggagaactgagccaaagggtacagaaaagtcccacgcactcacacacccacacactcaagcacccagctcttcacatggttccattaccagcctttcc

SEQ ID NO: 64172 - DNA, 601 bp, Human
tcacccaagctacagtacactgtacaaccatggctccctgcagcctggacctcctggactcagatgatcctcccacctcagcctcctgagtagttcaggctacaggtgtgtgccaccatacccatctatgtttttacattttttgtagagacagggtcttgctatgctgcccaggctggtctcaaaatcttggcctcaagcaatcctcctgcctcagcctcccaatgcatgactaggattacatgcatgagccacctacccagcagcagagcctaatttagcagacttttttttttttttwaaaagtccccgattgataaacaccttaaattttgagaaacagggatctggttcttttaatatatcaccatccaaactgcatttgaactttattacttttaggcatcatttactgaatccttatgatgtgctaattacagtgctaggccttaaacacagtatctcatttaactctcaaccctgtgaagtcatatcattatctccattttaagaatgtgaaaattgaggctcaagtgactaaatcacctgctcaaagagcccatcagttccaaagttagcatttgaacctcatctgtctaac

SEQ ID NO: 64173 - DNA, 601 bp, Human
atttagtgggagcctccatctgtcacccaagctacagtacactgtacaaccatggctccctgcagcctggacctcctggactcagatgatcctcccacctcagcctcctgagtagttcaggctacaggtgtgtgccaccatacccatctatgtttttacattttttgtagagacagggtcttgctatgctgcccaggctggtctcaaaatcttggcctcaagcaatcctcctgcctcagcctcccaatgcatgactaggattacatgcatgagccacctacccagcagcagagcctaattkagcagactttttttttttttttaaaagtccccgattgataaacaccttaaattttgagaaacagggatctggttcttttaatatatcaccatccaaactgcatttgaactttattacttttaggcatcatttactgaatccttatgatgtgctaattacagtgctaggccttaaacacagtatctcatttaactctcaaccctgtgaagtcatatcattatctccattttaagaatgtgaaaattgaggctcaagtgactaaatcacctgctcaaagagcccatcagttccaaagttagc

SEQ ID NO: 64174 - DNA, 601 bp, Human
tccatataacaaacttccaaagtaggtaccattattacctccttttataatcaaggaactgagaggcaaaataacttgttcaaggtcacatagccaaccgaacaaggactccagagctcttaatcactgtgcccaggtagctgaaaaactataaagatttagaattgtgaggcttagctttaggtaagttactgttttaaaactccctacaacatttttcttaaataaattatgtactggttctctccctacatgctctgaacattaacaatgattttctttctatgaagggaaaaactgkttttcaagtagttttctcccatgttaacagctaatactctgtccatccaagaagaacagctcttaagactaagaaaataaaagaactcaaagaaatgaatgattcctgagcttggcccaggcagcacagctcagtggttaacggtaccgttgtgaatcccaagtactaggcactgtgacccaggcgggtaatcaattcagcctatgcgtgttcccccccaagaattcttcctggctgctgcgtgctctccccactttctcaccccacactatccccatcttattcttgcaagggttcttg

SEQ ID NO: 64175 - DNA, 601 bp, Human
acaatctgataatttgctacctcttagcatttaagatattaaaaaaaaaaataggataggcatggtggctcaaggctctatttccagcactttgggaggctgaggtgagaggattgcttgaggtcagaagtttgagaccagcctggccaatacagcaagaccctgtctctattttaaaggatagtaataatgacagctagcacattaagaacttaccatgtgccagcaactatttaggcatcttacaagtatgaattgatttaatccatataacaaacttccaaagtaggtaccattattrcctccttttataatcaaggaactgagaggcaaaataacttgttcaaggtcacatagccaaccgaacaaggactccagagctcttaatcactgtgcccaggtagctgaaaaactataaagatttagaattgtgaggcttagctttaggtaagttactgttttaaaactccctacaacatttttcttaaataaattatgtactggttctctccctacatgctctgaacattaacaatgattttctttctatgaagggaaaaactggttttcaagtagttttctcccatgttaacagctaata

SEQ ID NO: 64176 - DNA, 601 bp, Human
tggaggtgaaagctagattggggtaagttaaggagatcatcgcaggtaagttgacggttgccaggtacggtgtctctatagaaataggagacctcagctttagacaaggcttttcactcctgctatgaaaaggaacagggcaggtgtggtagctcacatgtataatcccagcacttagggagtctgaagcaggactgcttgagaccaggagtttgaggcagcagtgagccatgattgcaccatgcactccagcccaggccaaaaagcaagacctcatctgaaaaaaaaaaaaaaaaaaaaagaacagaaaacacgagaagacactaaaatgagagactaagggtgaaggagagcttctgctgttactgtagtttattttgctttcaagatgggcggccccggaatggtgagccatgtcagtggaagacactgcaatggtgggaatcgtctatatctgcactgttcaatccagtaaccactaaccacatgtggctagtgagcacttgatatgagaaactgaattttaagttttattagctgaaatttaaattgccatatatagctagcagctacaaaaccaggcagggcagcccctccagca

SEQ ID NO: 64177 - DNA, 601 bp, Human
aaaattataaaaattatccaggcatggtggtgcacacctgtagtcccagctacataggaggctgaggcaggaggattgcttgagcccaggacttcaaggctgcagtgagctatgaccatgccactgcactccagcccaggtaacagagcgagaccttgtctcaaataaaaaaataaataaataaaagagggaaaaacattcccgacgaagagaaaaataaagactgaagaactgtggctgctctgagcttgcctttaggaacagaaaaagcgcagggcagctggaacataggaatcatgargagggtgttatgggatgagggcaaggaggaaagtggggcccaggccagtaagatcctgcaggtcagaaaaggtttggattttattctaaatgcaatgtaaagcctttggaaggtttaactgaggacatgacatgaaatcatctacagtttagcaagattcctctgccactgctgcagacaaggtggactgaaacagggcaaaactgaatgccgggagaccaaacaggaggctaccacagtgttcctgagaaagaagattcaaatagaaagcatgtggattcgggactcaaaaattggatg

SEQ ID NO: 64178 - DNA, 601 bp, Human
aggcatgtctgaagccattaaaagaacaagtcagtaataacactgcagcacactcttctaacataatatctcagattacttagaaatgcattcatagtcttcacgcagttcacttggcggcccttcaacatctgacactgtttgaaagaagttgtttactttctgaaccttttctgtcgtgttcacaagacacagttcttgcatgctgctgtaaacataacctctttctttggcactggcttgcagttaccccatacctcttatcaccaatttgcagcaagtttttccccactctctaacrcactgcacaacccgctcagcaaaatgctctaaaatgctctatgcttgattataacaaaagtcaactttctatgtttatgaaaattgaatatgggaggcctcatggtataccacctgagaactaatggcctacggtttagaatcccagccccactcattcattcaacaatatgtactgagcacctactatctaaacacactgttctagatgcagggatacacctagtaaataggaaaaagtctcagttgctatgaaacttattgttctagttgagggagataagcaataaaaatgtacaca

SEQ ID NO: 64179 - DNA, 601 bp, Human
taacagtcaccaaatccagctgattctacctgaaatctctctaagcacatcctttgtctgcttgtttacagcagtatcttcaaaccttttaggctatgggccacttagacaacacagcttctaccacatctatacctggttatccaacaatgtctgttacccctgcccaagctcaggttcccatcacctctggaagacagaaatggcattcttccttcttgcagtcccacctcctgtcccactgactcccctcacagatccatccctggaaggctgcagaagtgccaccatgctttggctyctcactgtctcacttactgttggattccctcttttgaaactttgaggttgatttgcatttctgctgacagggttattcaggtcagctctgcactgaaaataagtaagcgtcctgaataaaatatgttcttaaacatcttcttgaaggcatgaaagagttggaagagggaggagagaagtcggcctgtcaagatcttagtgaaaactggaagcaggaagaataagttagtcatggaagccactttggctctaagggctttgatggcctcatgggttgacaggaacagaagacaaagactag

SEQ ID NO: 64180 - DNA, 601 bp, Human
cgccagaagctaacagcccccaaataacaataatgtaatggagagtgtgaatggtaagaaaatgacctaggtgagtcactgtcgattccttcctgttacctaacagtcaccaaatccagctgattctacctgaaatctctctaagcacatcctttgtctgcttgtttacagcagtatcttcaaaccttttaggctatgggccacttagacaacacagcttctaccacatctatacctggttatccaacaatgtctgttacccctgcccaagctcaggttcccatcacctctggaagacagmaatggcattcttccttcttgcagtcccacctcctgtcccactgactcccctcacagatccatccctggaaggctgcagaagtgccaccatgctttggcttctcactgtctcacttactgttggattccctcttttgaaactttgaggttgatttgcatttctgctgacagggttattcaggtcagctctgcactgaaaataagtaagcgtcctgaataaaatatgttcttaaacatcttcttgaaggcatgaaagagttggaagagggaggagagaagtcggcctgtcaagatcttagtg

SEQ ID NO: 64181 - DNA, 601 bp, Human
aataaaaatattcactattggctatttcctggctcaaatattcattggcatgtgttaaatctgtgagtatccgatgccagaactgcaagagaaagtgaattagacaaaaagattagcttctcctaacctatttttttaatgtccctaaaatttgctcctgtcctcctactttggcgcaacgtgccaaaaagaaagtgccttatggatttatcataatttcagaaacaatatctgtttcccaacagttcttctgatgccaaagcatttaactttccatctgggtgcaggcagaacctaattyatgaatgggttgtgttccaaacattcatttgtaagttggccctttgattctacaggaaatgtactccaaggcctaatgtagtaaaagcctgtggacttggtctaagagagacaggggacccctgagaagaaaacttctgttcctgttcctgggcacagaagcaagctagggccaatgctgaaaaaggtagctgctgagtagcgcagggagacaactgaacacactagatacctgggaatgtgcgaaacttgggaggggcacatggtcaggccagaagaggattagtaagaaaactcaaag

SEQ ID NO: 64182 - DNA, 601 bp, Human
agccatcttccaacctcagacctgatactcccacactgcccatgtgcgtacatctttggtcaaactgctgaaaatctctataaagagatttaaatgggttaaaagcatatgggaaaaaaggatatctttttattccaatctttgctgttcaatttagaaccctgaaagcagaagatgtgggaaagcagctcttagccacactgctagggttataatctggtataaccctttttgaaagcaacttggcaacatgtaccaagagccttaaaatattcataccctttgaccaagtaaattcccmaaaaagagaatctcttctaaggaaatcatcctaaataagaaagagtttcatacagggagatgctgacagcaacattatttgtggtggcaaaatactgggaccaatgtttggactattaaacttcattaaactatttaggttggtgcaaaaggaatagcagtttttgccactgaaagtaatggcaacaaccacaattacttttgcaccaacctaattattaagcagtgatcaaaaatttaaaataattgttaagaatacatagtaagattaaatacatagaatagtctcaatgagattttt

SEQ ID NO: 64183 - DNA, 601 bp, Human
tataaaacctgcacacatcctcccatatactctatatcatctctagtccatgtgtaagtacctaacacaatgtatggtcacagtaagtagctgttttactgtattggtgcttttacttatattatttttcatttttttcctttaatattttcgacccgtggttggttgaatctgaagattcagaagccttggatacagagggctgactgtatacagatttcttccccccactcatctcaccttagagcatgtcttgggttttttccctaattgtaagaagactgcatgcgcaatatttttstaagaaacctataaaaaggtgtaagtagaaagcaaaaaatcatctgtaatccctcctcagagggacataatattttaaaaccacactggctatgttcccactcaaagtatcagccatgtgtctggatcagtacaaccacctcagccaacatgtgtaacaactatagaatatttcaacatatgtcaacattgtattttatttagcccaaatataccatcaacttgtctactttcataaaagaactgtgtttttgtttttgtaggaaacacaggctataagggtctctcctcagctgacatg

SEQ ID NO: 64184 - DNA, 601 bp, Human
tcacgctgacgcagctaaattagaccatttgaatttttcatgtctggagacgccagaagcgcatttagggccgtctgttatgagaggtattccgcagctgaagaacgcgcacattctgtctcctgctccacagttacttagcacatacatgctcactcgtaaatagcaaatgagaccttatttgttttactggattaagttcttatacattaaatgtgatattctgatatgctcatgatgcggcatgctatgtgacactatactaatctgcaattcaagtaggcaagaataagtcagattaaaaaaaaaaaaaaaggatgaaggaaatgtcgacctcagatgaaagagaaacccttcctgagaccctgccatttgccacaacacgaagtgacctggaggacattatgttaagtgaaatacgccaggcacagagagaaaaatgttgcatgattttatatgtggactctttttaaaaaggtcaggtatgcatttaatcaaacaatggttatcagagccgaggtggagggaggcccaaatgaagagatggaggtcaaaagatacaaaatagcagatacagaggatgaacaagtttagaggtcta

SEQ ID NO: 64185 - DNA, 601 bp, Human
actaaaccccacaaaccatttgagagaggggactttaaacccctggattcctttcagggttctgaaaactgacatcagtaggcatcaaaaagacttttcttcctgttagttatactaggttgagaagtcactcaataattgaagaaagcaagctctattttcttcttattggatttttattttttaattaagagatggggttttactctgttgcccaagctggagtgcagtgttgcaatcaaagctcaatgcagccttgaactcctgggcttaagttccacctcagcctcctgagtactgrgaccacaggcatacaccaactaattagttaaaaaaatttttttttagtagaaacgaggtcttgctttgttgcccaggctggtctcaaactcctgacttctagcaatcctcccacctttgtctcccaaaggaatgggattataggtgtgagccaccgtgcccagcctctatttttttctttaatctaggaataaagtagagtatggtacaaagtaggtaacatttcaacattttaaatttctcacgctgacgcagctaaattagaccatttgaatttttcatgtctggagacgccagaagc

SEQ ID NO: 64186 - DNA, 601 bp, Human
tcagatcttgaaatattttctttatatctctcctggaatcgcccagcgcttccttgcccggaacgttcctggctacaataagcaccacatcggccaaatacccattagaaactgaatgattcctatctgaaatactcacaagaagcctggagcccattactttgtgtgtagaatgtagtctttttcccccccttaaatgcattacctcacatctgtctgtattacaatttagtatgccaacttccccactcacagtttcaggcctgtggcaaaccatctttcagtttattttccccactgscttgctgttttatgacttaaaaatacttgagagcaaaatgtaaatttaggcaatctcaaagacattactgattgggtcgttttaattaaaaaccagcattagtatctgtggtactaacagttaatactaggtacgctttgtctgaatcccttattttttctttgattgccactgcctctacttcttttgccaaagaaagttgtttaaaaaacttttaagcttatattccttctgccaaaagctaacacacaatgtgttttatcattattctttgtaatgcgcttgtttcattatactgtt

SEQ ID NO: 64187 - DNA, 601 bp, Human
acaatgtgcggtcatctaccatgtcacctgctgtcttctttacaacaagactgatctttcagatccttctttatttttgcgtagctgaggccatttctgaagccaaaaagaaaagaaaaagaaaaacaacaacaacaacaacaacaacaaaaacagctgacacgacagtacagtataaataaaaatgaagaaactttatgttggatcaagctgataaattactgttcaaccagcagcctctctagcaagggcagctatctgagctgaagacacctggactgctctctgactcaactcttaygagttctgctcataccaccgagtcaaggctttaacagtatttgcatttgccgtttttcactgtgatcttaagtcacagtttttcacagtgatcctaagtcttccatgctgtggtacagaccccaagttttcgcaactcagaggtgggccaagtgcaaggggacctgagtcagagccaggtttgatcctgaccgcagagctgacagtgtggacttagccgagtcacttactctgatctgtttgctcatctgtcaaatgtgaataatgacttgtccccagccttctcctcagtgctgggtac

SEQ ID NO: 64188 - DNA, 601 bp, Human
actgttctacttaagagccaaagttacttttcattaaacttttctcagtatttcaactactgtttctttttaacctagcaactatcaggcctactcatttcctctgccaggaggcaatggtagccctcaaacctcaagtatgcacaccttgcctttattttctagaaaaggccagcaatctaaaaattaggaaaccaccctgttctgatcatgctattcctaatatagtgttttattttactgataaaacaaagcattgctgacttacaaattattggacagtaacagtgtccatgaacckaaaaaaaaagtgccatcaacttgacacttgagagtttagctaacaaagtacacaaagaacaaaccacatggttggtgctccgtggtgggggtggcagaagcaggaacccgctgacaagcacatcacaggccctccaaaacctcagagtatctgttcttccattaaacctgcctcacttgtgaattcctccagactgagccagtctgaacttggctcctagactctctactcagggagggagaactagaacctgaggttagtcaggttcacacaccacattaacccttgctgggaacactt

SEQ ID NO: 64189 - DNA, 601 bp, Human
ttggatgtgacaccaacggcagaagcaacaaactagaggaagtggactatatcaaaatttacacctaatgctgcaaacaatactatcaaagtgaaaagaaaactaataaaatgagagaaaatatttgcaaatctgacaagtgacttttactcaaaatatatacagaactcttacaattcaataaaaagacaacctaattaaaaaatgggcaaaatatctgaatagctatttctccagaagatacaaaaatggccaataagtatatggatacctcctcaatatcatcagtcctttggaacaygtgaatcaaaaccacaatgagatactactctttcatacctactaggatggctataagaagaaggacagacaatatcaagtattggcatggatgcagtgaaattagaaacttcatacattgctagtaagaatgtaaaattatacagttgctttggccattcctcagaaaattaaacacagaggtaccatataacccaacaatttcactactaggtatgtacccaggaaaaataaaaacatgggtccacacaaaaacttctacacaaatgttcatagcagcattattcgtaatagccaaaac

SEQ ID NO: 64190 - DNA, 601 bp, Human
tgaggcaggagaatcgcttgaacccgggaggtggaggttgcagtcagtgagccaagattgcaccactgcactccagcgtgagcaacagagtgagactccgtctcaaaaaacaaacaaacaaaaacactgttgaggagaaacagtaaataagaaatgtcaataaacaagccattataagtaatgaaaagactctcctgaacaagcagaatggttcccttaaatgatcaatgtagtacaattctcctgacacagtccatgaatgagccctcacatccactctacataatgctcagagaagagsgtcaatggcaggaggtgctgaagcctgactagttcctggctgtcatccttgaacaacacagtgtttctctgacatttcccgacttggaagaaggaaactgatccacaaaaaaatcacataatttattgcacatttcctattccttaaatactttggaaactgtggctagtatttctcaacaaccattaacagggaaacagacacactgttgccatttctttgtccctgtgctccatgatggcacatggagctccttttcctttttgtcttttctttcctgtcttttcatcttttcggctc

SEQ ID NO: 64191 - DNA, 601 bp, Human
aacaaccaaacatttagccacagggacacaaactgatcatcttggacttccagcaaccagcagacactgtcttgtgcatggtgggtattcacaaagcattaactagccttcatatcaacactgttcttctctaataataaccccttttggcttgtatcatgttcttttggtgaattctccctccaaaaacactctttccgtatataccagacactgtgactcctaagaaccatgctgtggtgatcagagaagagacaagagacaagacacttgggagcaaaaaaaaaaaaaaaaaaaaaargaagaccagaccagctgtttctcctactcaaagttaattccagccatccagttacacattcagcaaatacttattgtacatctactttatgccagtcactatgttaggtgtagttctttaactcttagctttagctgacaataggtagaaatgttatattctttatagcactgaaaatatatttgaaccactaacgaattttgttttactaagaaatttccagccaggcacagtgattcatgcctgtaatcccagcactttgggaggctaaacgtgggaggatgcttgaggccaagattt

SEQ ID NO: 64192 - DNA, 601 bp, Human
tcatcatattggcatcatcccatcgggcatccagtaactactggctatgatgtaaatgcctttcccttcactgagtacccaagagacactgtggtaaatcctcatgtttcttagtgaaaagccagggaaagcgaacatatattatatacatataattcacacacccacgtccacacatatatatatacctttacatatatttatatatacacacacatatatcagtctaaaatattatagaaatagctaattcaacatactattgactgcctttggcaataaaccattatagaaagaaatrtgaataaataacaatgcagagaaagaagtgggaagaaagacctggtaagcctaaactactagtctcttctgggtggagagagtacacctgatgaatttttaaaaagagctggcacttattaatgacttgctctggtcagccactgctccgaggagtttgcctaaaccgtttcactgaatcctcagaatcacactcctagggtaggtcgctggaaggtggcagcctgatgcctggcactgcgataaacaagactgcccacctgggtcctgccacatgggccacatggagctccgaggctgt

SEQ ID NO: 64193 - DNA, 601 bp, Human
aatgaatcctttgcctttattttttaactagaaaatagatgtcttccagcttttcccagaaactaatacttgtaaaaagaggattttgaaaaaaactttgtaacaattttaaaagtcctccaaaaagttttagaagtaaataatactttcatgattgaaaggactcttagccacagaaaatcctgaagttttcagtgaacttctgttgtgtgtgtgtgtgtgtgtgtgtgtgtgtgtagagagggggagggagggagacagagagagagacagacagaaagacagacagagtctcactctrtcacccaggctggactgtaatggcatggtctcggctcactgcaacctccgcctcccaggttcaagcaattcacctgccttagcctcctgagtagctgggactataggcgcgtgctaccaatcccagctgatttttgtatttttagtagagacagcgttttactatgttggccaggctggtcttgaactcctgacctcgtgatccgcctgccttggcctcccaaagtgctaggattacaggcgtgagccaccacgcccaatcttaagtagtattttttaaactggtctttaaaattccctg

SEQ ID NO: 64194 - DNA, 601 bp, Human
aaaatgaatcctttgcctttattttttaactagaaaatagatgtcttccagcttttcccagaaactaatacttgtaaaaagaggattttgaaaaaaactttgtaacaattttaaaagtcctccaaaaagttttagaagtaaataatactttcatgattgaaaggactcttagccacagaaaatcctgaagttttcagtgaacttctgttgtgtgtgtgtgtgtgtgtgtgtgtgtgtgtagagagggggagggagggagacagagagagagacagacagaaagacagacagagtctcactmtatcacccaggctggactgtaatggcatggtctcggctcactgcaacctccgcctcccaggttcaagcaattcacctgccttagcctcctgagtagctgggactataggcgcgtgctaccaatcccagctgatttttgtatttttagtagagacagcgttttactatgttggccaggctggtcttgaactcctgacctcgtgatccgcctgccttggcctcccaaagtgctaggattacaggcgtgagccaccacgcccaatcttaagtagtattttttaaactggtctttaaaattccc

SEQ ID NO: 64195 - DNA, 601 bp, Human
aaaaataataatgtgttgactggcacagaagtccttcatcagagtcagaaaaatatttgccctgatcatgtaaaatgccttattttgccaggtgaaagtgggtactaacggtttcacatgatgcttaaaagagcaagatcttgatcaagtagcaaggaaattaaaataactagtgttcaattatattccacaaactagctttaaattaatttagtttctcaagtggaaaaaagaaagcaaccacagagttttgatgtgtgtattcaaacagagcacgttaagtcttgaaatattacataatttttttatgaataccaaattagaattatggtagcaaacaccttaagatttcactctaagtcctttggctttgaatgtgttgctttcatccaaaagattaaagtgggaaagtaatatctatgtggttttactcattcttcaacaaactgaagatcacttataaaatcgataatcgtaaaaacaaatttagcacctaacaaatgacgtgcttctcatgtcacattccatgagatacacatttatacaccaagacattaatctgggaggttataaaattaaaattctcttagaaaatgaatcc

SEQ ID NO: 64196 - DNA, 601 bp, Human
aatataaaagaaacttttagcccgatgactgcttgaatggttgaaaaaactcacaggcactcaccagaaaatggagaaatatactagcacagtatatctagagacaccacaggggcaaggaattaactaaaactccccccgccacaatggtgaggacacccaaagactatgatacaaattgtcccttcccataaaatctgataatgtagccaagctaggggaaagtaagagaactccaagcctgggcttacagagatatgcacacatctacatggggtaatgcagcaatgcagcccccacrcagttctgcaacgtctggtgtgtgtcgccccagggtgaggagaaagaggaggcaactgatgaatccaaaaatctggaattagatgcacattcttttgggctctgccactcctagtgacagtatggtgacctctggtacatcagtcatttgagcttagtgtcagcagtaaactgagaggatcctgacaattccagctgtatttaaattcttggctttccacttaactagctgtgtgatctcaaaggtcacgtctctgagactatttctttttctgcataaatgactctttgttgtgactgt

SEQ ID NO: 64197 - DNA, 601 bp, Human
ttctgaaatgttgtgctgtgagttttccaaaggccaacctctaaatttgatatttgtgcgtatgacaatagatttgattgaaaacgttttgcacataattaagggtacttgccttcagtgttcagctttgccctttaatatacagggtacatcactgtttatctgggagaaaaagatactcttgagctagcttaaaagcttatttgctgagtaaagtaatataaaagaaacttttagcccgatgactgcttgaatggttgaaaaaactcacaggcactcaccagaaaatggagaaatataytagcacagtatatctagagacaccacaggggcaaggaattaactaaaactccccccgccacaatggtgaggacacccaaagactatgatacaaattgtcccttcccataaaatctgataatgtagccaagctaggggaaagtaagagaactccaagcctgggcttacagagatatgcacacatctacatggggtaatgcagcaatgcagcccccacacagttctgcaacgtctggtgtgtgtcgccccagggtgaggagaaagaggaggcaactgatgaatccaaaaatctggaattaga

SEQ ID NO: 64198 - DNA, 601 bp, Human
attttccactcagttttgctgtgaaactaaaatggctctaaaaataaagctgatttttaaaaagtgaacaccacttcagttaatccacattgttagagtcaaatgttttaacttagaccatgtattcatctttgcagttgcaaagcacagtgtgacaaaaaccactgttaactccaagtgcctaaacattgatcagatggagttttctcatgaaagcaacacttatcctccaaattcatcttgtttttgattcagacttgtatatactagtctatacctatctgtgaggatgatgctgcctttttttttttttttttttttttaagagatggggtcttgttctgtcgctcgggctggagtgcagtagcacagtcatagctcactgcagcctcgaactcctgggctcaagtgatcctcctgcctcagtcttctgggtagctggaccacaggcacgcaccactgtgccaggctaagttttaaaaaaaattttttttgtagaaacaatgtctcactttgttgcccaggctggtctcaaattcctggcctcaaatgattctcctgcctcagcctcctaacgtgctgggattactggtgtgagcca

SEQ ID NO: 64199 - DNA, 601 bp, Human
cagtgtttataaatgcttactgaggacggacacggtggctcatacctgtaatcctagcactttgggagaccaaggcgggcggattgcctgagctcaggaattcgagaccagcctgggcaacatggtcaaaccccatttctactaaaatataaaaaattagccgggtgtggaagcgcgtgcctgtaatcccagctacttgggaggctgaggcaggagaactgcttgaacccgggaggcagagactgcagtgagctgagatcacgccactgcactccagcctgggcgacagagtgagactccrtctcaaaaaaataaaaaataaataaacgcttactgaatcctgaattttttttttcctgaaaggcaggcaggaaagaagatgcaagaatctaggtgatccatgtgctttatgactcacaggatcccgttaaacaaataccaagcacagccctatctcactttgcacaaaagatgagatttataccttgattcagcttgctaatattttccaagaacctaaccttaatttcaaatatagcctttccttacatttttctttaataatctgtacagcctcctaactctatgacatcaataaata

SEQ ID NO: 64200 - DNA, 601 bp, Human
ttggctgggtgcagtggctcatgcctgtaatcccaacactttgggaggccaaggtgggcggatcacctgagcaggagtttgagaccggcctagccaatatggcaaaaccccgtctctactaaaaatacaaaaattagctgggcatggtgcctgtaataacaataacatgagatgaaacacttaggagtaattctatattatttcattaaatgtgccacaggagttgagaggaggacggtagcaaggtctggggtcattgagacattaatgctccgtagagcagatcgataggaacttgccycttaagggttggtagattcttggtttgattcccccaagatgctaatgggggcagggcatggtggcaggcgcctgtaatcccagctactcgggaggctgaggcaggagaatcgcttgaacctggaagtggaagttgcagagagccaagattgcaccactgcactccagcttgggcgacagaacaagattccaaccctcccactccgcgcccctcctcccacccccaacaacaaaaaaaatagggtttgatttaatagcctaaagggcaggtctatcaggaatctcttcctagggctgtttt

SEQ ID NO: 64201 - DNA, 601 bp, Human
ccctctgcataacatgaacaggttggactgaatgcaccctggttccttctggctaacacttggattccataggaaaaagctagctttacccagtcttcagtcattttctttttcttttcctaggcacataccactgaatatactcataacacgtctttatggccacaaaaggattcaagcaccataaggactacagacaaaaggctttgatttggctgggtgcagtggctcatgcctgtaatcccaacactttgggaggccaaggtgggcggatcacctgagcaggagtttgagaccggcstagccaatatggcaaaaccccgtctctactaaaaatacaaaaattagctgggcatggtgcctgtaataacaataacatgagatgaaacacttaggagtaattctatattatttcattaaatgtgccacaggagttgagaggaggacggtagcaaggtctggggtcattgagacattaatgctccgtagagcagatcgataggaacttgccccttaagggttggtagattcttggtttgattcccccaagatgctaatgggggcagggcatggtggcaggcgcctgtaatcccagctactc

SEQ ID NO: 64202 - DNA, 601 bp, Human
ctctggcctcaggtccctctgcataacatgaacaggttggactgaatgcaccctggttccttctggctaacacttggattccataggaaaaagctagctttacccagtcttcagtcattttctttttcttttcctaggcacataccactgaatatactcataacacgtctttatggccacaaaaggattcaagcaccataaggactacagacaaaaggctttgatttggctgggtgcagtggctcatgcctgtaatcccaacactttgggaggccaaggtgggcggatcacctgagcaggrgtttgagaccggcctagccaatatggcaaaaccccgtctctactaaaaatacaaaaattagctgggcatggtgcctgtaataacaataacatgagatgaaacacttaggagtaattctatattatttcattaaatgtgccacaggagttgagaggaggacggtagcaaggtctggggtcattgagacattaatgctccgtagagcagatcgataggaacttgccccttaagggttggtagattcttggtttgattcccccaagatgctaatgggggcagggcatggtggcaggcgcctgt

SEQ ID NO: 64203 - DNA, 601 bp, Human
tgtcaaaccaccacccctctggcctcaggtccctctgcataacatgaacaggttggactgaatgcaccctggttccttctggctaacacttggattccataggaaaaagctagctttacccagtcttcagtcattttctttttcttttcctaggcacataccactgaatatactcataacacgtctttatggccacaaaaggattcaagcaccataaggactacagacaaaaggctttgatttggctgggtgcagtggctcatgcctgtaatcccaacactttgggaggccaaggtgggcrgatcacctgagcaggagtttgagaccggcctagccaatatggcaaaaccccgtctctactaaaaatacaaaaattagctgggcatggtgcctgtaataacaataacatgagatgaaacacttaggagtaattctatattatttcattaaatgtgccacaggagttgagaggaggacggtagcaaggtctggggtcattgagacattaatgctccgtagagcagatcgataggaacttgccccttaagggttggtagattcttggtttgattcccccaagatgctaatgggggcagggcat

SEQ ID NO: 64204 - DNA, 601 bp, Human
agctcaaggctgcggaatgtacccccaccagaatccaagaaacttgggtctgccttggctccgaggttgggactagtaatcttggtttgtcaaaccaccacccctctggcctcaggtccctctgcataacatgaacaggttggactgaatgcaccctggttccttctggctaacacttggattccataggaaaaagctagctttacccagtcttcagtcattttctttttcttttcctaggcacataccactgaatatactcataacacgtctttatggccacaaaaggattcaagcaccrtaaggactacagacaaaaggctttgatttggctgggtgcagtggctcatgcctgtaatcccaacactttgggaggccaaggtgggcggatcacctgagcaggagtttgagaccggcctagccaatatggcaaaaccccgtctctactaaaaatacaaaaattagctgggcatggtgcctgtaataacaataacatgagatgaaacacttaggagtaattctatattatttcattaaatgtgccacaggagttgagaggaggacggtagcaaggtctggggtcattgagacattaatgctc

SEQ ID NO: 64205 - DNA, 601 bp, Human
ggttgcagtgagccgagatcgtgccactgcactccagcctgggtgagaagagccagactccatctcaaaaaaaaaaaaaaagcaaagaaaaaagaaagagccaggccatggtaaactatatgagactctaggtagaactacacctggattttttttatacttgaagttctctttctgatcaagtcagtttgagttattttatgtcactttcaaaactgactttcaaaatagagtcctaaatgattcgccagttagattctaaactccctgagcttgaggaagcctcttccagttcccaacrgggccaagagcagtgttcagcatttaatgtacactttggctctagggccatattttattttgctttatatctgccccaacatctaatactgtgattgatatatcaaacatctgtgtcttactttgtagcactcaggccacaattggaacagaacattctcagaagcaccaaccgccccagacagctggtggagataactctgttggcaacgcagtactttttcctccctctgcaatgggatgccttcacctccagacatccatgggagacagctgggaataaccccaaagcacttaagat

SEQ ID NO: 64206 - DNA, 601 bp, Human
agaaaaatagtttcaaagaataaagaagaagatatggaaaaggtgaaaactcctcccctcttgcctcaggtggggggcagtacgtgggaggtaaggaaatgaaggaaggcagtgcatgacagccaagccaggccacttccttccttctcctccacctctttctacccagtgtcacactgcaggataccgtaagaccctgggccacttactctaaaacttcaacatctctttgtcttcctgacagtttcactggggaaagtgaactgtcagcaacaacaggctcaccttccactcatcttartctttctcttaatgattcaattcagcagatgcacactgggaaggcaggggaggcagacagaagaaaggaggtagggccctggtgctttggaatttccaaaattgctcagtccatcctacgcacctaaagttagtggagatttgggatcgggcatggtggctcacccctgtaatcccagcacttcgggaggctgaggtgggtggatcacttgaggccaggagttcgagaccagcctggccggcatggcgaaatcctgtctctactgtaatcccagctactcggaggctgaggcaggagaat

SEQ ID NO: 64207 - DNA, 601 bp, Human
tcgcggtatagcaagaaagttaatgttctcaacagagataaactcattctttattttaaattaacttctccaggcacagcctagctgctagcaggatgagatacatgaaccaacttctatactttctagaaatggtctatttccaaacaaaaagattacttcctaaactagatggagagtttcttctttttggaaatctactgggtttttttttttcccctaccttttactggctggctgttcctgctctagcctgcttctacatgtccaagtggtctggctcgagccacctcaggccacrgcctctcaagcctacctggttcaccaccggactttaaatctcatctggaagtgacagctcccagatttgtagctctagctcctacccactctctgagctccagacttccacgaccaatggctttcttaacatctccatttagagggctaaaaaggcactcttaccacaaagttaattatgccagaaaaccatgccctgagtctggatgagtggatgtctagtttctctccacctcctaagccccaccagctatctggactcactaagtctgtccaccaagcagacccttaactggtctcc

SEQ ID NO: 64208 - DNA, 601 bp, Human
ccgttttttagcctcagttttcttttttctgagactgggtctccctttgtcacccagactggagtatatagtgacatggccacagctcacagcaacttcgacttcccgggctcaagggatcctccagcctcagcctccggagtagctgggactacaggggcatgacactacacccagctaatttttgtagagatggggttttgccatgttgcccaggctgcctcagttttcataactataaaatggaagaaggaatatctgccctatgtagtccaccatgaaaatacagagcactctatamacaagagaacctatttgagctcaattttactgtgatattgtgaacaagctggacttctcgcttcaatatatactctcacttaggtgccactcgcggtatagcaagaaagttaatgttctcaacagagataaactcattctttattttaaattaacttctccaggcacagcctagctgctagcaggatgagatacatgaaccaacttctatactttctagaaatggtctatttccaaacaaaaagattacttcctaaactagatggagagtttcttctttttggaaatctactgggttttt

SEQ ID NO: 64209 - DNA, 601 bp, Human
ttttacagtcatatcacttaccgttttttagcctcagttttcttttttctgagactgggtctccctttgtcacccagactggagtatatagtgacatggccacagctcacagcaacttcgacttcccgggctcaagggatcctccagcctcagcctccggagtagctgggactacaggggcatgacactacacccagctaatttttgtagagatggggttttgccatgttgcccaggctgcctcagttttcataactataaaatggaagaaggaatatctgccctatgtagtccaccatgaaaatacagagcactctataaacaagagaacctatttgagctcaattttactgtgatattgtgaacaagctggacttctcgcttcaatatatactctcacttaggtgccactcgcggtatagcaagaaagttaatgttctcaacagagataaactcattctttattttaaattaacttctccaggcacagcctagctgctagcaggatgagatacatgaaccaacttctatactttctagaaatggtctatttccaaacaaaaagattacttcctaaactagatggagagtttcttctttt

SEQ ID NO: 64210 - DNA, 601 bp, Human
tctatctgccttcctcattagtccatcaactccttggggacagggactgtgtatctccccagaacccatccatgggatttggctcaaacatttgaccaataaaactaagtgtgtgtccaaaaatcttctaggctattccagaatcccaagtggcctgccttgtgggccactcccttagggacttcccaggtgacccagctctgatgatctatcagaggtatttacaagcaggtgtgaaggttttacagtcatatcacttaccgttttttagcctcagttttcttttttctgagactgggtmtccctttgtcacccagactggagtatatagtgacatggccacagctcacagcaacttcgacttcccgggctcaagggatcctccagcctcagcctccggagtagctgggactacaggggcatgacactacacccagctaatttttgtagagatggggttttgccatgttgcccaggctgcctcagttttcataactataaaatggaagaaggaatatctgccctatgtagtccaccatgaaaatacagagcactctataaacaagagaacctatttgagctcaattttactgtgatattg

SEQ ID NO: 64211 - DNA, 601 bp, Human
cacacgcaggctcatggttaacccgaacatcctgacttagctcacctccaagggaggggcatgctccctcagcggcaagaccaggaacggggtggacagctacataatgggacagatttactcagtaagagggatggccatacccacatcagtctcctcgctaaattacacagcacaggcaggtggaaggacctgcccccaggaaaaatacttatgtagattcattcttcagcaaacgatatcagccctacttttttcctctatttcctttatggccattcatatccctctcccatcccaycaggtacaaaagttcccctgtatcgctgcaagagaatggcaggaacacccagagttcatggttctatctgccttcctcattagtccatcaactccttggggacagggactgtgtatctccccagaacccatccatgggatttggctcaaacatttgaccaataaaactaagtgtgtgtccaaaaatcttctaggctattccagaatcccaagtggcctgccttgtgggccactcccttagggacttcccaggtgacccagctctgatgatctatcagaggtatttacaagcaggtgtgaa

SEQ ID NO: 64212 - DNA, 601 bp, Human
ttctttattgttttaagttcacacttttaaaatattaacttggctgtcaaatgaatcatcttccacataaaagggctgagtgagtggagttactgttgaacttgagaaaaacccctgagccaaaacacgtgtcaaacggccatctcttttccacctaagcgccaagttgcacccggcacagtgcaaggggccaagaccaggagaagaaaacatgctccctgtcctccaggagctaataaaataactagtgggtgacactgcagacacaaggaaggaagaagtctgaaagcattagcacacrcaggctcatggttaacccgaacatcctgacttagctcacctccaagggaggggcatgctccctcagcggcaagaccaggaacggggtggacagctacataatgggacagatttactcagtaagagggatggccatacccacatcagtctcctcgctaaattacacagcacaggcaggtggaaggacctgcccccaggaaaaatacttatgtagattcattcttcagcaaacgatatcagccctacttttttcctctatttcctttatggccattcatatccctctcccatcccaccaggt

SEQ ID NO: 64213 - DNA, 601 bp, Human
caacttatgaataatttaacatgttcctgtattccacgatcagatgggtctataatgtctgtttctttctcctttgactatagattttccagctccccaaaagtttctttattgttttaagttcacacttttaaaatattaacttggctgtcaaatgaatcatcttccacataaaagggctgagtgagtggagttactgttgaacttgagaaaaacccctgagccaaaacacgtgtcaaacggccatctcttttccacctaagcgccaagttgcacccggcacagtgcaaggggccaagascaggagaagaaaacatgctccctgtcctccaggagctaataaaataactagtgggtgacactgcagacacaaggaaggaagaagtctgaaagcattagcacacgcaggctcatggttaacccgaacatcctgacttagctcacctccaagggaggggcatgctccctcagcggcaagaccaggaacggggtggacagctacataatgggacagatttactcagtaagagggatggccatacccacatcagtctcctcgctaaattacacagcacaggcaggtggaaggacctgcccccag

SEQ ID NO: 64214 - DNA, 601 bp, Human
ttatctccaggaagaacagaaaactgattaaccacaatcagacattaaaaaaattccctggctcttgtggtctgaaacaggcacatttccttcacacgcttcaaggaaacaattgaatgtaactatttaaaacatactcccaagcttaatgagcaagaagcaactttgccagaccacaatgtctttaagagatcaatttggccaatgaagactagagaggatacacattcctgaaacagaaagcaattcagagatacttgtgatcatcagaacgtagcccaaagccatgccatttgcttgrgggcagaaagcacattctaggacatcagtatcatactttcaagaattaaccctctgatttcccataaaataccagtttttagagccagaaagcactaataaaaataatttactaatctgggcactggaatattttcactaatagttcaaatttgagtttagctatatgtcatcaatttataagaataaaaatttatccaaaacttcttgctgttgcatgcatttgtttaatggattctctagaaggcttcgccagattctaaatgttccatcatacatttattcaccagttatcaagcaa

SEQ ID NO: 64215 - DNA, 601 bp, Human
gcagaaaactcaccattagccctggaagcagagagctgggaaaaacaaaagaaaaacaatgtgtgaaaagaaataagatcttccaagaaaagcatttagaagataaaaataaaacatcgacaacatctcagccactggatctctacttttgttatctaaagaccttcctgaatcctttcctacgtctacccattcttcaaggctgttcagactttatttccttcctcctcaaagccttcctggaatattcaagccctgacttatcttccttccagtctctgtcctttcagagttaacacamaattcactctgtttaaatatacagttttctctcttctttcctgcaaaggttgtatcttaaaatatgctaagtaaaaagaaaaaaaaagtaccaaataatgagtgagaatatgtacagaaaatattcagacaaccaaaaaactcaattaaggacggtgtggggagagttaattccttaagtctgcttagtagttactctgtgactcctttattagctgacattaaatggccctctggttattacagtatcaaagaagaggaaaagtaatctgaagaatatttcttccatgggacaacttca

SEQ ID NO: 64216 - DNA, 601 bp, Human
aagttggctggagaatgagacaagaggaatagagaaagggagattaagatttccttggacttttgtctatagtcttacttttaaaaataattctcatggccttttgctgcatttttattctttcctttcacacaagagagcttatcaacagctctgacagctcatttcgtatttggtttctggttatcttgtactcatctaataggtggtagtggtggttttcagttcacacatttttcttacaaacagccttgctctctgaaaagacaggaagcagactagtatggatggcaaaaaaaamacaaaaatcaagaccacccttacttctgctgagaatagttgtttagaaggctaatttggttatcagagagtaaaagccacagtatacaacctgcgtttgtaacttgggagggacactttgtcttccctttctgaaggcaagccaaagtgggccccaggatctccagtggggagcactgttgtttgcacccacctgtggagtctgagagtcaggactgtcttaaagacaaagtttatctagttagatccttcttaagataggttggctgatatatccttttccttaattactactttctat

SEQ ID NO: 64217 - DNA, 601 bp, Human
ggtctcactcagggactcagacagggtctacactccaagctggtgagatctcagctcagggctcattgcagcctggacctcctggactcagttgatcctcccacctcagcctcctgagtagctgggactacaggtacgagccaacacaccagctaatctacttatttatttgtattaatttttttattttttgtagagacggggtctccctatgttgcccaggctggtctggaactcctgggctcaagagatccaccgatcttggcgtcccaaagtgctgggattataggtgtgcgccacygtgcccagcctaataatataattaactcaggtaaaccatttttaatttcatgatcaatctgcctgagaaaaggggtcagcctggcagtgcacagtaacagatgaacaaagaagactacatctgaaagacaactttcctacagacacaaggaagaaaacaggcttctctgctttctgtaggcaggtactttggtcaccaagaacccacctttggggatgtgatgtgcctctcgatgaagacattgcttgtccctaaagttggctggagaatgagacaagaggaatagagaaagggagatta

SEQ ID NO: 64218 - DNA, 601 bp, Human
taaaaatgaattagggccagccacgatggctcacgcccataatcccagcactttgggaggctgaggtgaggggattacctgagcccaggagtttcagaccagcttgagcaacatagtgagaccctgtctctacaaaacattttaaaaattagccagccatggtggcaggacctgtagtcccagctactcgggaggctgagatggaagcatcacttgagcctgggagtttcaggttgcaatgagatacgattgcaccactgtgctccagttctgggtaacagagaaagattctatttctttaaaaaaaaaaaaaaaagaaaagaaaagaaaagaaagaaaaagattagttttgaaggaatgaaaacaagtagaatactgtaaactttgttaaagtaacaagtggaaaatgtcttgaaaaacatgaagatagtacttaatttttttttttttttctgagacagggtctcactcagggactcagacagggtctacactccaagctggtgagatctcagctcagggctcattgcagcctggacctcctggactcagttgatcctcccacctcagcctcctgagtagctgggactacaggtacgag

SEQ ID NO: 64219 - DNA, 601 bp, Human
ttgtttcatggcaacttgccctaactggagaagaaaaagaactgcttcggttaatttccagatactcctagaaattcccaatccataagagtcagtaaattcgcaagacagttttctaagacttactgcctacccccttccccctatgctggggacttactaaaagagcaaagaaatattaaactatcaggtagaaccaaatcactataattggtcagaattgacttttaaaataccaaaattttgatcttttaaaattttgattctccacactaggttgaagcaactcattttgaaaackcaatttttttaaatgggtgacgatgacaaaaaaatattaatgctcacgtataacaccactagtgtgtctggttagttattaaaaatgaattagggccagccacgatggctcacgcccataatcccagcactttgggaggctgaggtgaggggattacctgagcccaggagtttcagaccagcttgagcaacatagtgagaccctgtctctacaaaacattttaaaaattagccagccatggtggcaggacctgtagtcccagctactcgggaggctgagatggaagcatcacttgagcct

SEQ ID NO: 64220 - DNA, 601 bp, Human
caaattctgattgtccccaaggaccacacttcccttgcagcccccctcaagtatttttttcttctgcgcaggaaccacagaaccagaagatggggtaggtgccttgtgctcctcctgaccaatcccacacccccattccctcctcctccctgaagcggtcatcccctctgaagcacctaccatcacattacaccacgcctctgcctcttggaaggctcctggccacttccccttcccttggagggtttatcatcctccagaacccagcctgccccaccatctgcagtgcaatggctctcastttttaaaacatttctagccctaatctctccactgaattctaaactcctgctaatcaccatccccagctggatctctaacaagcatccccaaaactaaacaacacgtaaatatgaagtcctgttctcccctggcctgcaaccagctcctgctcacccctccctctctcagccagtgggacctccacgcacagagtagcacctccatgcacagagtagcttgggcccaaactcccggagttgactctgactcccctctcaccctgcagtcaagtcttcagcaaatctgtgggctctttatt

SEQ ID NO: 64221 - DNA, 601 bp, Human
atagagttaagacaatgacacattcacatgaaaagatctagggcttggaaaagaccaacaaagtctctgtggtccaggtaagagaaggaaattggtcttgttcattctaacctccaacaatcttcagaccttcctagatagtaattcatgtattttagcttcattcctgccaagaagttttcttttgtcaatgtaaacatctctgattacatcttaagtctctttcctctagtctgtctgctgtggagatgaggagaagctcatcacgctcctgaatatgagacctgggattacctgcctmtttcattaagcaattttcaaaaggctccagcaccaaggaggaggagtggaaacacctagttctccctgtgggtgatggacacctcatcaggatggggacagactgaggacttggctcctggagctccagttttcccaactccaagtctcgggccccttcttcccacccatctcctcatccctctctcaccaattactaactcccttgtctacagtttgccagactacatcctatgggcaaatctggccgctggctgcttttgtcaataacgttttattggaacagagccaggcccattga

SEQ ID NO: 64222 - DNA, 601 bp, Human
ctgccactacagagtctgtctcagtaaatagatctacattaacacgctgacattgacataagagtgaatttttgttctgttatatagatttcatgtttacttaacatatacctgatcatttttttttctttttctttttttaaagatggggtcttgctctgtcacccaggctggagtgcagtggcacaatcatagctcactgcagccttgaactcatgggctcaagtgatcctcccacctcaatgtcccaagtagctgggactacaggtacgtgcaaccacactcagataggttttttttwaaaaaaaaaattttgtagagatgggttctgagatcagcccagctggtctcaaactcctgacctcaagtgatcctcccacctcagcctcccaaagcactatgactataggccatgagctgccatgagccccccatgcccggcctaccttctcttttgaatgcccagctcaccacccacatctcacccttccctgaaccccagatctacctggttaccacaggagtgatgattctatatgtctgtgaccctattctctggccatcacagggttctctactctgcagccagaattgttcaggg

SEQ ID NO: 64223 - DNA, 601 bp, Human
ccgttttggccgagttctttgcagcaatattataccatattctgcatatgttactgttaacctgtttggcatttactcgcttgtttcttataataggatcttttataagtccaaatttagaaaaccaattaagaggttattattcacattagaaatggagactgccttaaagaaggatgcacttatgtattcctgtccaaggtccaattcttctctctttctctctctccctctccatagcagaggtgtaaagtgttttaggaagcatacattttttttaatctatagagaaaccatttasgagggagcatacacaactatgacataaagcataaatcatctctaatgtcaccaaatacttactgacctttactaggctgtaaaatgtctcccctgtcaagtttcatcttaagtaaccactaaccttagtggcttgtgtccccaaagaaaatttccaatttctataaaacctgggtcttaggagataatgactgcactttaactgggatttcaaagatgtaatctacatcttttagagatctatatagtaacagaagactacgatggggtggagagagtcataggtgagcaacagaaacag

SEQ ID NO: 64224 - DNA, 601 bp, Human
aggcatgtccaaccccctcttccatcatggcctgaacacgtttttcaggttaactttggaacacccttggcctacaggaggggtccgttcagatggtttggggacctcagaattttgtttttggtttacataactctccttgctaaaaaaatccaaaacaacaattttctctcttatttccacatgatttgttgacagcccatcaaacagaacaatttaccagaaacttaataatgcttaaggattattaagctttaatatacaaacacttttaaattcactgcctctaaacatacactaytgaaaccttaaaaatgacaggatggctattaaaagcatgcttcatttaatattttacttttatgtggttaaaggtccaccatacttgcattcttttcaaaaatgtggaagcctaaagcactcactagacctatgattctaagacaactgcagtcatacctcgagtcatactgcaattggcagaggatgctagaatggaatgacaatttttatttcgaggaaagcaatctatgctaactataaaataagttgtccttttaaaagaaaacaaagttctgtattataattaaaaaaatcaaga

SEQ ID NO: 64225 - DNA, 601 bp, Human
attctctaagaaatagtgcagagtgagaaaagcgagatagagatgcgtttaatgtgctaccattgacttttttttttaaaaaaaaggttacacattcatgtgtttgtctatgaaactcactgagaaagcacaaaaaaagcacaaagatcaagtttaggtgtctggggtcgggggtgaagctcacctgtaatggtgagcttccgtactgtttaaattcttgatcacttgttattttcatagtaatgatggagagaaaaaccaaagtgctcacgaaggaagcgtctaactcaggggcagaccrcagctctaaggcaagggtcgcaagggtcttccacaagggcggtgtgctcctcggggagaagacagcagagcttctctatgtacattatactaaaaggctgcctttacacagcttgtctgacgaatgccctcctcagtccaatgtgagcgtcatgagctgtatattggaagggaggtacccccaggaacagtaggagcttagaggttggcggttggcaggggacgtccgtgcactgctcaggtccagtgcattgcaaccaattgtaggttacatgtgcccagttaagtggatttgcagatc

SEQ ID NO: 64226 - DNA, 601 bp, Human
gccgctgtcccctgctctgctgcaatcgcacctttggcctgggtcactccccgaggggacactggaggattcccattctggcggaaaggccctagaaatattaataattccgccagtgggcggcagcacaaaggctggcctcttccccactgtcagtggacgggcaccgccactccacatacccgggacaagtcgtctgtcttccagcacctcgttctaaaacctgactggagagcaacaaaccaccggacatgggaggaaagcctttagcatgaaggagactataacaaatctataattyttttctcaatgctatttaacatcatgcaatactaaatcgccaaatttagtacttcacaaagtactaaaaataactgagtcacagtaaggtgaatgctattattttaccaaaaaaagtatgcattatttcaaaaaaaagaaggatgaggggagaaaagagatggtgtgagagagccagcatcatctgccttggcagaaactcaaaagaaaatgcctaacatgacaaattcataaataatggcacaagcatattacctagcaaacaccggggcaaataattatgtatagctgtgtaaaccaa

SEQ ID NO: 64227 - DNA, 601 bp, Human
acgggaggagccagttaccatctgtgctctgaggcctgggccctctgccgctgtcccctgctctgctgcaatcgcacctttggcctgggtcactccccgaggggacactggaggattcccattctggcggaaaggccctagaaatattaataattccgccagtgggcggcagcacaaaggctggcctcttccccactgtcagtggacgggcaccgccactccacatacccgggacaagtcgtctgtcttccagcacctcgttctaaaacctgactggagagcaacaaaccaccggacatgrgaggaaagcctttagcatgaaggagactataacaaatctataatttttttctcaatgctatttaacatcatgcaatactaaatcgccaaatttagtacttcacaaagtactaaaaataactgagtcacagtaaggtgaatgctattattttaccaaaaaaagtatgcattatttcaaaaaaaagaaggatgaggggagaaaagagatggtgtgagagagccagcatcatctgccttggcagaaactcaaaagaaaatgcctaacatgacaaattcataaataatggcacaagcatattac

SEQ ID NO: 64228 - DNA, 601 bp, Human
ggggatcttgaggccagcctaatccaacatcctttccagagacagaaaccaatcaatcccctaagctagaggaaggtaaatttctgccacttgcaattgaagacactcaaatacttaatggatgtcaaataagaacttcactcatccaaatggcatgaccactagcaatcacacagcactctaagaaactgatcttgaaaacttcaaataaacattttactttttagtcagatatttaatatgctaaaataatttaatacttccctggtatctttctttccattcatcctgggataaggaygttctaaaactagagttccccaagtaagctgtgaaggcaaagcttccagaaggtgctagatgataccaagctggccagaagccctaaatctcatacctaaatctggctagccatggagaagatggggaggagtttggtatgtaatacaggtgtccctgggtaccccagataaccacatctactgaaaaagtaagcagtgagtgacagccgtgcattcagaaaatcaatcactgaaacacatcattaataaaacctgtaagacaatggagaaggggatggcatgtacagttcagcattttg

SEQ ID NO: 64229 - DNA, 601 bp, Human
ggaagacacacataacctctttaagtgtttcatttaggtggatgtggcagtgcagggacaaagactggaagaaaagccacagctccaatattctaatcaaaggcattgcaagttcctggtcttcttttgaaactgacacaggggacagggaagagatgctaaatgaagctaatatgcctgcagttgcctgtaaccatgtcttcagccacgtaaagttaagcatcaccattgatgcacagaaaagacgggataagacagataagagccacgtgcagatgacatcatttgaatctctggaccygggggatcttgaggccagcctaatccaacatcctttccagagacagaaaccaatcaatcccctaagctagaggaaggtaaatttctgccacttgcaattgaagacactcaaatacttaatggatgtcaaataagaacttcactcatccaaatggcatgaccactagcaatcacacagcactctaagaaactgatcttgaaaacttcaaataaacattttactttttagtcagatatttaatatgctaaaataatttaatacttccctggtatctttctttccattcatcctgggataagg

SEQ ID NO: 64230 - DNA, 601 bp, Human
catacaaatttggatttctggcttcttttaaaaatgggaagacctggcaccgggcccggcatcactcatctggtgctgagtagctgtggggatacaccctccagctgggcacagttcctgccactccctggagtctcctgcctggatgacttggcccattccagggctttagccaccacagggctctggtgcctgcacttgggagacattcccacaaattcaaatgaatcacaaaacaactttccagagatccacttaattcctggaagacacacataacctctttaagtgtttcatttakgtggatgtggcagtgcagggacaaagactggaagaaaagccacagctccaatattctaatcaaaggcattgcaagttcctggtcttcttttgaaactgacacaggggacagggaagagatgctaaatgaagctaatatgcctgcagttgcctgtaaccatgtcttcagccacgtaaagttaagcatcaccattgatgcacagaaaagacgggataagacagataagagccacgtgcagatgacatcatttgaatctctggacccgggggatcttgaggccagcctaatccaacatccttt

SEQ ID NO: 64231 - DNA, 601 bp, Human
agctaccttccaatatctagaaaagaaatgctttttttgacaagccaaataaagttattctgatatcaaaggtgagtaggaatgagaataaaagcacaaaggtcatcctttccagggtccataaactcaaaagcctaaattaattcacttcagcagatttttcaattaaacaagaatcattaagtcaatcttttgattaatggctacttgactaaaattaaaatgtcatcagaaatatttaaacttttgcttagaatcttactttaatttataacatagacacaaactctcccatctgtcmacttggtatctgcaagctcaatcagactcttacggacatccttgccggctggcccactgtcaacttcatacaaaagaatgtagtcatgttaaaattctacctcccatgaaccacagaatctgacataaaactactgaattcaggccaaaaatttataatctggtacagaggtaatactggcttttttaaaaattcaaacaaagacattgccaatgaaaacaagagcttacaacgtggtccattcaaaagggccccaggctcagggagtcaggagacctatgactgagccctggtcagcca

SEQ ID NO: 64232 - DNA, 601 bp, Human
taaccaccgcctcctgggttcaagcaattctcctgtctcagcctcccgagtagctgggactacaggtgggcgccaccacgtgtggctagtttttgtatttttagtagagatggggtttcaccatgttagccaggctggtctcgaactcctgacctcaggtgatccacccgcgttggcctcccaaagtgctgggattacaggcatgagccaacacgcccagctaatattcattttctaagaccatttctcaaaagttgatgtctatctgcagataagacaaaaatcaaagatccaagtataytttaattaacattttcttctgaaatctgagctaccttccaatatctagaaaagaaatgctttttttgacaagccaaataaagttattctgatatcaaaggtgagtaggaatgagaataaaagcacaaaggtcatcctttccagggtccataaactcaaaagcctaaattaattcacttcagcagatttttcaattaaacaagaatcattaagtcaatcttttgattaatggctacttgactaaaattaaaatgtcatcagaaatatttaaacttttgcttagaatcttactttaatttat

SEQ ID NO: 64233 - DNA, 601 bp, Human
agtcaagcaaagaatatgctcataaatcctgagaggcattattaatggcacttaattaattcagatatattcaccctaaacactatgttctcagactaatacataattagtaattggttttcattcagccaagaatatgcaaaaagtaccaaaaaagcctctcacatgtagaggagacactgagatacttaatctgattataatgaagacaattccctacaaattatgacatattgagatgaaacaggaagcaccccttgtgtggagcccctgttgggtataaaggctggcggaagtggcrgggggcctggagggggagctatttcatggcagcatgagcatgggggaagacaggagatgtcgagagtgggttgggaattatcttgaaaggcccgtgcatccctcctcaaaaatctcaagacacagattgaaaaagggctcactttatctcccaagatacatttctactacttaaatatgagggcctattttaaaacataattcaataacaaaaataaccagagcgagctaagcacaaagggttcaagatcaatgagggcccaacaggaagaagtgtaacgcataacttgatatgatgact

SEQ ID NO: 64234 - DNA, 601 bp, Human
tctgcactgccttgctgcccggccattgggcatcaaagctgcccatgctggggctccaaagatgacataaaataaagcagctttgttgtctgcatcaatagaaacagggtcaaacggggcggagagggctagtgcagagcgccaaaatgtccctgattatggtatgactcaagagtgggggcaggggagagagcagagggggagctgacatgtggcagggagagggaggaagccggggagagctcctcaggcttggctcagctttaccctaactcactgccacacttggcactaaccttayggctcatgctaggtgcacatgtgccaagacccacgtgaggcactccacacacagtatcttatctgatctttacaacccaagggggtagaggtgctattatcatgcccattacacagataaggaaattgaggcttagtgagattagaaaaggcccaagctattaaacagtagagctgtacctggaactcagtccaatcttaaatcttctgccaacataactcacatgagttacctggaatataaaattcagggagctggactggctgagcccaagatactttcaaattcctaacagccagt

SEQ ID NO: 64235 - DNA, 601 bp, Human
agttttgagcttgttaaacttcatgcgctcttgggacatctaagtgtcaatgtcaggtaggccgtggacaggtgggtctgaagttcccaggggcatcaggggcaagagataaaaatgtgtgtatctgtgcatcagacattagctccccagaggagtggatgaggtaacctggagaggggccggtgtgatggggaggaaggcggagaagcagtcttcaagaacgggaatgtttccaagcctggagaagaggatgagaaaggggaaaactgccatcgaggcaggaagtgaaaaagcacagggycacccaatgggagtgaagggaaaagggggttcaaacatgctatgggatgatcatgatgcttttgagaaggcagggactgggaaatgtcagccagattgaacggcacaggaggtccttggcaaccttggcagagttgtttcggtggagtgtagcaatggaacccagactaagttgagttaaggaaatgctggcactgcacagggctgatttctaaggagcctggcagggaaggacaggagcgagatgaagagggatgagggacagagggaggacctgacagagaagggacattccgtagca

SEQ ID NO: 64236 - DNA, 601 bp, Human
gcacaatgcatcttaagagaagagttcagttttgagcttgttaaacttcatgcgctcttgggacatctaagtgtcaatgtcaggtaggccgtggacaggtgggtctgaagttcccaggggcatcaggggcaagagataaaaatgtgtgtatctgtgcatcagacattagctccccagaggagtggatgaggtaacctggagaggggccggtgtgatggggaggaaggcggagaagcagtcttcaagaacgggaatgtttccaagcctggagaagaggatgagaaaggggaaaactgccatygaggcaggaagtgaaaaagcacagggtcacccaatgggagtgaagggaaaagggggttcaaacatgctatgggatgatcatgatgcttttgagaaggcagggactgggaaatgtcagccagattgaacggcacaggaggtccttggcaaccttggcagagttgtttcggtggagtgtagcaatggaacccagactaagttgagttaaggaaatgctggcactgcacagggctgatttctaaggagcctggcagggaaggacaggagcgagatgaagagggatgagggacagagggaggac

SEQ ID NO: 64237 - DNA, 601 bp, Human
acagaggagagcagctcagcagagggcggaggaggcagcagaaacgaaagaagcagagagactccggcatgctgaagtgctgaaatctatggggcttgatgatgacagactagaaatgtagggaaagatggagggaatgctgcatgcatgcgggggaagctggtgggtccaacgactggcacaatgcatcttaagagaagagttcagttttgagcttgttaaacttcatgcgctcttgggacatctaagtgtcaatgtcaggtaggccgtggacaggtgggtctgaagttcccaggggcakcaggggcaagagataaaaatgtgtgtatctgtgcatcagacattagctccccagaggagtggatgaggtaacctggagaggggccggtgtgatggggaggaaggcggagaagcagtcttcaagaacgggaatgtttccaagcctggagaagaggatgagaaaggggaaaactgccatcgaggcaggaagtgaaaaagcacagggtcacccaatgggagtgaagggaaaagggggttcaaacatgctatgggatgatcatgatgcttttgagaaggcagggactgggaaatgtcagccaga

SEQ ID NO: 64238 - DNA, 601 bp, Human
caggcccaggagcaccgggaagcggctgctgtagaattgcaccagacagaggagagcagctcagcagagggcggaggaggcagcagaaacgaaagaagcagagagactccggcatgctgaagtgctgaaatctatggggcttgatgatgacagactagaaatgtagggaaagatggagggaatgctgcatgcatgcgggggaagctggtgggtccaacgactggcacaatgcatcttaagagaagagttcagttttgagcttgttaaacttcatgcgctcttgggacatctaagtgtcaaygtcaggtaggccgtggacaggtgggtctgaagttcccaggggcatcaggggcaagagataaaaatgtgtgtatctgtgcatcagacattagctccccagaggagtggatgaggtaacctggagaggggccggtgtgatggggaggaaggcggagaagcagtcttcaagaacgggaatgtttccaagcctggagaagaggatgagaaaggggaaaactgccatcgaggcaggaagtgaaaaagcacagggtcacccaatgggagtgaagggaaaagggggttcaaacatgctatgggatga

SEQ ID NO: 64239 - DNA, 601 bp, Human
taatgcacgttataaatctgtagatacagttgggcacagcagctcatatatgtaatcccagcaatttgggaggctgaggcaggaggactgcttgagcccaggactttgagaccagcctaggcaacagaattcgtgtctaacaaataaaaaaataacaaaagttagctgggcgtggtggtgtgcacctgtagtcccagctacttaggaggctgatgaaggaagatcacttgtatccaggatttcaaggctgcagtgagctgtgattgtaccactgcactccagcctgggtgacagagtggawccatgtctgttaaacaaaaaacaaacaacaacaaaaaaaaaaacaaaaaaaagcagaatactcaaagcaatatataagtaagaatactcaaagcatacctagatacgctgtagttaaactaaagaaggccaaatgcaaagagaagaaaggaatggtggccagagagaaaaggcaaacacaacagaggaatgatagtgacagctgacagctagcttctcaaacccactgaacaaaaacaggaatctaacgtcatatagcttctccagttcactttactcaagcatcttatgatactaagtc

SEQ ID NO: 64240 - DNA, 601 bp, Human
aacatgagctcacagagacagcaacgactaattaatattttcaagactttagttactaagatgatcagatatagaattttttaagctgtgagaaattatacagaaatagaagatgaacaaaagatgattatatttgaaaaaataatgattcagaattttccacaattaatgcacgttataaatctgtagatacagttgggcacagcagctcatatatgtaatcccagcaatttgggaggctgaggcaggaggactgcttgagcccaggactttgagaccagcctaggcaacagaattcgtstctaacaaataaaaaaataacaaaagttagctgggcgtggtggtgtgcacctgtagtcccagctacttaggaggctgatgaaggaagatcacttgtatccaggatttcaaggctgcagtgagctgtgattgtaccactgcactccagcctgggtgacagagtggaaccatgtctgttaaacaaaaaacaaacaacaacaaaaaaaaaaacaaaaaaaagcagaatactcaaagcaatatataagtaagaatactcaaagcatacctagatacgctgtagttaaactaaagaaggccaaat

SEQ ID NO: 64241 - DNA, 601 bp, Human
cacaggaacttctcttcccacccaccaacccaccctccttccctctgccatcataatctctcttcctgccttcctcattcccacttcttatgtctgtctgatgctgggtccatggtggccaccggacggcagtggtgagggagagtcaatcctcatgccacctgtccctgcttcttgcccatccactctccctaccttccctccacaacctcatcccacagaccctttggtcacatgtccaggacaacttccttctgtaaagaaaatgttatctgagaaagaaagcttttaaatttttcakgtaaatatttgttggattaatggacgtgatttatatattgaactcatctgtgtgctctttacttcccttacaggaactaagtttaaaaataaagattggggtggggcatgaatttaccaaaagaagaacctccattcagggaaggaagaagacacgtggtcccaggactacaagagaaggaggtgggttggacatgagtcaagaacaaaagcaaagatgtgtttccaaaggacaaagggtaagatcaagttccagtgaatgaaagggacagctttggacacaattttgaaaaacctgaac

SEQ ID NO: 64242 - DNA, 601 bp, Human
gattgcttgaccccaggaatttgagactgcagtgagatataatttcaccactgcacaccagcctgagcaacagagcaagatcctgtctcaaaaaaaaatttcataatgatcctcacatgggagtgatttgaggttcaccctaatcattcagaattgtttccctctttgtgttcccacacaaccagataaattaaattatacatatgcacacacccctcccttatcatactttgcacactgaactatagcagtttgtatatgtgtcagtttttgtactctgagccccttgagggcagggccrtgtcttctatatcattgcatctctagctctcaatggaccacctaacatataataggtgcttcataatgacgtctaaaacaacattcaaatgaaggaggaatgttatcaatgcccaacatggcatctaattgtgccttatgaaaatgtaccttgggtctttattgttctaagatggagtcattgctgttcataaatcatcattttcaaagttctgtgtacaagagcagaggttcataactgctcaaaaatccaagcaatttacagcttcaaaaatttgaattataatgagaatatcacttt

SEQ ID NO: 64243 - DNA, 601 bp, Human
cactttgggagactgaggtgggaggatttcttgaggccaggagtttgaggccagcctggggaacatagtgagacccctgtctttacaaaaagttttttaaaaaatcagctgggcatggtaacctgcacccgtagtcccagctattcagaaggctcaggaagggggattgcttgaccccaggaatttgagactgcagtgagatataatttcaccactgcacaccagcctgagcaacagagcaagatcctgtctcaaaaaaaaatttcataatgatcctcacatgggagtgatttgaggttcaccctaatcattcagaattgtttccctctttgtgttcccacacaaccagataaattaaattatacatatgcacacacccctcccttatcatactttgcacactgaactatagcagtttgtatatgtgtcagtttttgtactctgagccccttgagggcagggccgtgtcttctatatcattgcatctctagctctcaatggaccacctaacatataataggtgcttcataatgacgtctaaaacaacattcaaatgaaggaggaatgttatcaatgcccaacatggcatctaattgtgcct

SEQ ID NO: 64244 - DNA, 601 bp, Human
ctctacgaagatacaaaacatgcacactcacacaggctactgacatgtctgacagcagaaattaacaggcagctctgctagcctgttaatttccacctggaaatgagagtattatataaaaccctcacatgctcagtctccttccaaagaaaagtaatatattttcctactgacttttataccggtatcatatgtatagaggtccccaatcaagagaacactttacttcagcatgaacattaaaaacttcttacacaaaatgaaaattactattatataatacttttattgacaaaaatayagatcccaattgacacagcaaaagtcatggcaaaacccatttcctactggaagcaaatgttacaaacgcaactcacctggaaatcttgatcatcaattccaaacctctcccgcaggttacggaagaccatcgggcagtattccttaaacttgaaatggctcggcatgttttctctgaaacagtcacagcgtggaataaagctcagagagagtcaatcagacttgcatctgccaccactgagttccacaggtagccaaagaagggttcagagttcactgcctaccaaaagcacaggtgtgc

SEQ ID NO: 64245 - DNA, 601 bp, Human
ttaaagagttaaaacagatgtttaaaagttagaatgaaggaccaggccagtgtggggaggagagcagcagtgcacatttttacgtggtgggaatcaagatgaagaggaagatgtaccacaggacacgcccaggatgttgggttcctggtgctgaccacagtgctatggtcactccacagtccagcactgcagtgcacaaagggtgccctttgacaaaaatgctgcagcaagagtctgaccaacttgaaaagcagcaaatcagcaagataaagattcctgagagtcctaagtagcctctacraagatacaaaacatgcacactcacacaggctactgacatgtctgacagcagaaattaacaggcagctctgctagcctgttaatttccacctggaaatgagagtattatataaaaccctcacatgctcagtctccttccaaagaaaagtaatatattttcctactgacttttataccggtatcatatgtatagaggtccccaatcaagagaacactttacttcagcatgaacattaaaaacttcttacacaaaatgaaaattactattatataatacttttattgacaaaaatacagatcc

SEQ ID NO: 64246 - DNA, 601 bp, Human
aaaatgatcatggctcaacagttatttaaagagttaaaacagatgtttaaaagttagaatgaaggaccaggccagtgtggggaggagagcagcagtgcacatttttacgtggtgggaatcaagatgaagaggaagatgtaccacaggacacgcccaggatgttgggttcctggtgctgaccacagtgctatggtcactccacagtccagcactgcagtgcacaaagggtgccctttgacaaaaatgctgcagcaagagtctgaccaacttgaaaagcagcaaatcagcaagataaagattyctgagagtcctaagtagcctctacgaagatacaaaacatgcacactcacacaggctactgacatgtctgacagcagaaattaacaggcagctctgctagcctgttaatttccacctggaaatgagagtattatataaaaccctcacatgctcagtctccttccaaagaaaagtaatatattttcctactgacttttataccggtatcatatgtatagaggtccccaatcaagagaacactttacttcagcatgaacattaaaaacttcttacacaaaatgaaaattactattatataata

SEQ ID NO: 64247 - DNA, 601 bp, Human
ttttcttaaggcagaggagattttcttaagacactgaagctatctgctgttaattcctttaaaaaaaaaaaaaagcacctagttcattttcaggtggcctctttaaatttagtaatggttctaaagtgatacagaattattaattttaacttcagagaaatgctttttactattctaataattttctgttaaagttaattatttttacagcagtaaatttcaagtccataattgtgatctaagttctctcttaaaaattaagccccaaggccaggtgcactggctcatgctctgggaggayggcttgaggccaggagtttgagaccagcctgggtaacatagtgagaccccaatctctaccaaaaaaaaaaaaaaaaaattagctgggcatggtggtgcacacctgtagtcctagctactctggacgctgaggtcggaggatcacttgagcccagcagtttgaggctgcagtgagctatgatcacaccactgtactccagcctgggcaacagagcaagaccttgtatcaagaaaaaaaaagaaacgccctaacaggagtgttggctcccacgcagttttaatagcagatgagcaaccacat

SEQ ID NO: 64248 - DNA, 601 bp, Human
cagtgcagaactcagaccgtaatgggttcattttggatctcatttgacagaattgattatgacaagaaatagaaagacttcatttcaataatgaattgaggaatctaacaagataagatagatgcatgggccctcaaaagtcagtttctgtgaaatgccagtggaattgttttattaaaacaaaacccagccaaacaaaaaaaggacgtggagagaaggaggaacacactggtgttcagcttttcttaaggcagaggagattttcttaagacactgaagctatctgctgttaattcctttaaaaaaaaaaaaaagcacctagttcattttcaggtggcctctttaaatttagtaatggttctaaagtgatacagaattattaattttaacttcagagaaatgctttttactattctaataattttctgttaaagttaattatttttacagcagtaaatttcaagtccataattgtgatctaagttctctcttaaaaattaagccccaaggccaggtgcactggctcatgctctgggaggacggcttgaggccaggagtttgagaccagcctgggtaacatagtgagaccccaatctctacc

SEQ ID NO: 64249 - DNA, 601 bp, Human
gaaatcccagacctcagggtgatcagggtttaagggggcagtggtaatggtagacacaggactgcggctatagtcacagaacaggcctcccaggcagcattcatcctgaaacacacctttaaagtatgacgatggatatcatgctggccaaacaatgatcagaaccttgatgacacactgattcaaccctgagcatattacaaacctatcatgcaatttaaaaatgccctaatgaattggaaaaagttctgaatctagaagcactggttacacacatgcgcgagcacacacgcgcgcacgcacacacacacacacacacacacacagaggtttacatatgtatgttacatggtactgtggtactgttattaacaatggatattctagaattgttctttgaatttgtctttaacaacaaggaaaagtcatttttaaaagatattccagaaatcaaaaccagaggaaagatacaaatgtttactgagaaagcaggaatgttttcatttttcatttcattatccttttcatttatcttaaaaactttttaagaagtttaaattcaccagtaggggtcaactgcataggttactacttaaccatg

SEQ ID NO: 64250 - DNA, 601 bp, Human
cttgtccagtctctctgggtataaacataagagaccatcaaatgagtataagagactggaaagaggggtgcagattttcatgaagaacattacaaatcaagatgctgggtttctgtaaatctcgttagcatctaatacagaatctggtatgcaatagtttttaaagaaagtgatgcttcaccctttcttctctctgcattccctaaaacggctagcacagagcctgacatgtggtaggtacaaacaaatactttgactggataattatgcatgaaatcccagacctcagggtgatcagggyttaagggggcagtggtaatggtagacacaggactgcggctatagtcacagaacaggcctcccaggcagcattcatcctgaaacacacctttaaagtatgacgatggatatcatgctggccaaacaatgatcagaaccttgatgacacactgattcaaccctgagcatattacaaacctatcatgcaatttaaaaatgccctaatgaattggaaaaagttctgaatctagaagcactggttacacacatgcgcgagcacacacgcgcgcacgcacacacacacacacacacacacacagag

SEQ ID NO: 64251 - DNA, 601 bp, Human
agcgtttaacctggagagaagcacccagtagcaaggatgactggctgtcagctctctgtcaaaagccacgaggcaaaacccaaagcaggtttgaggcgggaaacacaggctaacaggaagcctggggtcccaggtgggggcaggtggtggtaggaacagtaatttgctcagttcataaacaggacttgaaacagtgcaagaaatgcctgctgaccctgatgggctgtgagggagcttcccccagtctatcaagaggctgtccaatcagagaggggcctcccttgggtctcagcctcagtgygtctctgagcagggtggagtttccttccagggcagctaaactgtgaggacaaatggagcaaacccaacaggcaactactagtgataaaggaatgacagtgcttaggcattagaggagcaagcacaggggtgatggtgtaggttgagcattagagttggaccaaggaggagtcccacaagcacgactgtgccaatcctcaccacagctggacctctgctccaacctcattcagagttgtgacccagaatgcccaatgcaggccacaagcctcaccaggtatcctaccactacggtaagtca

SEQ ID NO: 64252 - DNA, 601 bp, Human
tcttgaactaatcacgtaagtcttgtataatttgttttttttttccattttgatggtcgtttgtatacattctgctaaaaatcatgtatgaaaagttttcatttttggttgaaagaggggccacttaaactttgccatgctcaaatgtgtaaagccaccctcgtataagggaacatgccaataccgtgcagaactcacgtgacagccatctcctcacggtggcacagtaatagatttagagacctgacagctggggggccggagagagcactgtgtccctctcctcatgttatggatgagkaaactgagacccaccaggggtgagtgagtatctcatggtcacagcatcagtcactgaagatccaagactcaaccaggcctcctaacttcccggaaatattcttttccccaaccctggctacctgtttcatggacttgaaatctggaaaccaatcactgccctgctgacagctcaggattatgattacatgcctcgaatcacacggcccaggagacaggagcaacttgtctggagaaggctgctttctgggtctgcagttgacatatctgagcgagcacagatggtcctctgaccccgcca

SEQ ID NO: 64253 - DNA, 601 bp, Human
ggtccaggattagtggagcccccagaagggggaaggaaacataaatgtcaatttaattagctcattcttaccgccaatcttttctctctctcataaaagtgtcctcatttagtaacagttacttttccctgcattttttaaacaaccaagcattttgcatatttaattctcttgaactaatcacgtaagtcttgtataatttgttttttttttccattttgatggtcgtttgtatacattctgctaaaaatcatgtatgaaaagttttcatttttggttgaaagaggggccacttaaactytgccatgctcaaatgtgtaaagccaccctcgtataagggaacatgccaataccgtgcagaactcacgtgacagccatctcctcacggtggcacagtaatagatttagagacctgacagctggggggccggagagagcactgtgtccctctcctcatgttatggatgaggaaactgagacccaccaggggtgagtgagtatctcatggtcacagcatcagtcactgaagatccaagactcaaccaggcctcctaacttcccggaaatattcttttccccaaccctggctacctgtttcatg

SEQ ID NO: 64254 - DNA, 601 bp, Human
ggctgaagtcagggctttgcgtcctccctccaactcacccttcccacctcccttactctgttatctgattatctgcaaagaaagacagctggacttaatggtctctaagcttcctgctcattcttctaattattattctgctgtcagtttgtagagacttagggaatggacgatgatttactattagtttatgggaaaaaaatctaataatcaacatgcacaaactgcaaaaatacactttcttcattggctattccttttcttctttctatacatttgatagtttcatattataaattaygaaattagttaaagtcacctgttctaaataaaaatactgataccataacccatcccaaaaaaaaaacaacagccaaaatcaactttgggaaaaactgtctcttatcgaataaattaaactagtttcaaccttttgggaaaaaacgtctcttactgaataaattaaacgagtttcaaactccaagcattcttcttccttgagatatgactcacatatcatatgactcacctatttaaagtatacaactcaacagtttttaatgttttcaccaaatcatgcaaccatgaccacaatcatttt

SEQ ID NO: 64255 - DNA, 601 bp, Human
gcagccagataaaattacccagtgaaatccacccaggctttggagagatctactctcattaaaaatcaaattccttgtcatggacacacttggagagttatatggtctgcaataaagtgacattatttaaattcaaaattgggggctgggcacagtggctaatgcctgtaatcctagcacttttggaggctgaggtgggaagatcacttgaggccaggagtttgggaccagcctgggcagcatagtaaggctctgtgtctacatagcattaaaaaattagccggatgtggtggtgcgtgcytgtagttctagctataaggaaggctgaggttggaggatcacttgagctgaggagttcgaggctgcagcgagccatgattgtaccactgcactccagcctagttgacagacagagactctgttaaaaaataaaaacaaacagacaaaattggggattctgcacctatcagttcaaaagtgacagtaagttatttcctaaaggcctcaataataacttacatgttaaaaggagaatttaaaatttcacaaggaagtttcagattgaaaattcccagcccacaaggtcttccttctattgctg

SEQ ID NO: 64256 - DNA, 601 bp, Human
acactggattaggatatcagccatgtcttcaccctgggatataaaaccttaaaaattcgaatcttgattctgtctcaaatcaccattttaataatccacgtgagtagccccaacccacactatctgaatatttttaaggttcatgaacatgaaataaccaatgaagttaggaacactgtgtcaaaacatagaatgtacctttcatatcactatgaatataaaaatacataaatcaagtgtattaaaagccttatctgataaggaggaaatcaaaagagttcatgcaattctatacaaaacrcctgatccttggaatgattctaaggcctggaaaaatccaactcattatttcatatttattttcacaatattcctgtgagagaggaaaagctagatccatttttcccacctcaagataaagaaactagtgtacaatggagccaagcaatgtgcctaagattcctgtctaaagctttctatgaactaaccaaaaagggcgatttacaaagataagactaaacttctgtcatcataatcatagactttttgtagcctttaaaataaagtaaaattgtttatgtatttttattatcatttactt

SEQ ID NO: 64257 - DNA, 601 bp, Human
aagtacattataattacagacttaccggcactcatgcctttcccattatattctctacacctctagttcgattaaaatgggaaactttatagttcagaataataattcatggcatttactttactaattaaagaagggtttaataatactatgtaccagtaccaggacaatgtacagggttttttatttttattttttgagacaggttctcactgtgttgcccaggctggagtacagtggtgcgatcttggctcactgcagccttgatctcctggactcaagtgattctcgtgcctctgcytcctgagtagctgggattataggcatgtgccaccatgcccagctaatttttttatttttagtagagacagggttttgccattctggccagggtgatctcgaactcctggcctcaagtgatctatctgcctgccttggcctcccaaagtgctgggattacaggcatgagccaccatgcccagcgcaacatatgggtttataaagggctggaaacgtaaaagcaaataatgtaggaactccttagctcagatactacctcttccccagtttgtgccttttctttcaatttcaaaggcattac

SEQ ID NO: 64258 - DNA, 601 bp, Human
aggtctacagaatggtgtttaccctgtgttttactggcatgcagcacgtaaagtctagcgtattaagtacattataattacagacttaccggcactcatgcctttcccattatattctctacacctctagttcgattaaaatgggaaactttatagttcagaataataattcatggcatttactttactaattaaagaagggtttaataatactatgtaccagtaccaggacaatgtacagggttttttatttttattttttgagacaggttctcactgtgttgcccaggctggagtacartggtgcgatcttggctcactgcagccttgatctcctggactcaagtgattctcgtgcctctgcctcctgagtagctgggattataggcatgtgccaccatgcccagctaatttttttatttttagtagagacagggttttgccattctggccagggtgatctcgaactcctggcctcaagtgatctatctgcctgccttggcctcccaaagtgctgggattacaggcatgagccaccatgcccagcgcaacatatgggtttataaagggctggaaacgtaaaagcaaataatgtaggaac

SEQ ID NO: 64259 - DNA, 601 bp, Human
aaatttattagatagactgagaatgataaaaatgactttcaggatgaaaatgcctacattaacaagagtttaattcttaattacatttttctttcctaaaacatgaacaagatctcctttatactacttcccacttagaacaaaaaggaagaaaatcaaagtgaatttccccttgtggggttttaaatgctagcccccaaaaagcaattattgctctttgttagtggtcttacttttttcttgcaatcactaatttgcaaaagggtatttctttcaaataaaacaagaactctaggaactstaagattgcagattatctttgggcataaaatcaaagtgggaacaatcaagtttatgaaagccaggtggagcagaccaagtggaacagaccttaaactctgtcaaactgacaatacgtgtaaaacaacttttgggggatggggaatagtaaaggagaactgtattcagcacaggatagaattccagcagcctcagtttcatagatcgttttcttatgcacattagataggacagtataacgtcctctcatgggccaatagggtgaatcaaaagctgcatagtcagtgcatctcaaacttaa

SEQ ID NO: 64260 - DNA, 601 bp, Human
gcaggggtttacgcaggccctacctatgcctgaagagaaaagtggcccatgagcaaatcttcatcttccaggattctcacctcaccaccctggcatcccctgtggtggatcacacgttctgcaatagcacaccttgatctgaaggcaagcaggcgcacctgccagatgcagagtccaggccaccaagtaactgaatttgctttccttagcttattagaaaacttgagagaaggaaaaaaaaaaatctacataatccccaatgactttaaatagcaagacttggcagtgttcagttattctkaagacaactaaaatttattagatagactgagaatgataaaaatgactttcaggatgaaaatgcctacattaacaagagtttaattcttaattacatttttctttcctaaaacatgaacaagatctcctttatactacttcccacttagaacaaaaaggaagaaaatcaaagtgaatttccccttgtggggttttaaatgctagcccccaaaaagcaattattgctctttgttagtggtcttacttttttcttgcaatcactaatttgcaaaagggtatttctttcaaataaaacaagaac

SEQ ID NO: 64261 - DNA, 601 bp, Human
gtgtgggattcaaaggcaaacatgctttctctctttaacttgctctctgaagtgggcattcaaaggcctcagtggccaaatgctgtcaagttaagggaacacagataccttcagaggggcaggtgatagatagctctgcccatgaatttgcaaaagaaagagtgcctttctgtctagtatattccagtctctttatcctttccttcctttctagatgaaatcaacaggactgaaccacctgaggtagaatcaattgcagcagtgcaggggtttacgcaggccctacctatgcctgaagagraaagtggcccatgagcaaatcttcatcttccaggattctcacctcaccaccctggcatcccctgtggtggatcacacgttctgcaatagcacaccttgatctgaaggcaagcaggcgcacctgccagatgcagagtccaggccaccaagtaactgaatttgctttccttagcttattagaaaacttgagagaaggaaaaaaaaaaatctacataatccccaatgactttaaatagcaagacttggcagtgttcagttattcttaagacaactaaaatttattagatagactgagaatgat

SEQ ID NO: 64262 - DNA, 601 bp, Human
ctactttacctccagtgattacaatggaattatgctcggggatgaaaagggggcaagaagcagaccaacacccaccttctaaaatcagagagcttgctccgtagcagattgtgaatggcgtgggccctgctggggccaggacagaagaaccagtgacagcaaaataggattcggaggtgtaaatagatacatactcagaggtcaacacctaatctctggcacaggcaaaaacttctgcaaagttgccaaatcttaagctgaatgattttaaaatcagagtagtgataactgaaactattayacaagagtatttaggttaaaagtgttatacaaataatgaatgacctttatagcacaagcatgcctaaaggttaactgccaggaatctggccactgtaattttagaacacagggttagaggagatgtttatgtgaaatgtgttcttcttgttctctaactatatatttaaatctctggccttggtgagaaatcgctacgcatgttaatcttcttggagtttcaaataaagatcaagaaaaattacctggtggtatttcttcaggatgttgtgcatttcggccacgtcttcactggtaatag

SEQ ID NO: 64263 - DNA, 601 bp, Human
aaccttagcactttgggaggccaagatgggagaactgcttgagcccaagagttcaagaccagcctgggcaacatagcaaaactccacctctataaaaacacaacttaaaaaaattggccaggcatggtggtgcatacctgtggtcccagctacttgggaggctggggtgggaggactgcttgagcccaggaggttgagcatgcagtgagctgtgatcacgccactgcacttcaacctggcaacagagcaagaccctgtctctaaaaaacaaccaagaccagaagtcacatgcttagtaagygacctggctgggatttgagcccaggattgtccaacgctggacttcatgctcttatactccatggtgaaggaggcctctcacagcgcgggctgggccttgggaacatgtgctctaccagagaagcttgtgctggaatttactccaggagagacagattgctgctcccaaggatggtctactttacctccagtgattacaatggaattatgctcggggatgaaaagggggcaagaagcagaccaacacccaccttctaaaatcagagagcttgctccgtagcagattgtgaatggcgtgggc

SEQ ID NO: 64264 - DNA, 601 bp, Human
tcaggacctgcggcactttattttgaatacccattgtgacagccaatttttacctttgggggattgggagctatttaagttaaaaacaccgtgtgactctgctatgaatggaaagtttgtgtcccccaaaatgcttacgttgaaaccctaatccccaagtgatggtattaggaggtgggacctttgagagctaattaggtcatgagcttagagccctcattatgtgatcagtgcccttattagaagtgacagaagagtgcttttgatcctatcccacccaccatgaccctgccaacacacrtgaggctacagtgagaagctggctgtctgcaaaccaggaagaacctgaccatactggcaccttgatctcagacttcaacctctagaactgtaagaaatagatttctgtcatttaagctacccagtctacggttttttatgacagctcaagctgactaaggtcctaaaagcaacaatgtgtgtatgtgttttaaacaccagttgtgaagatgattcctgggatgttgcaacagcagacatgttcataccatatgactacaatttctccaagtgacttagttgttacgttatttttatacca

SEQ ID NO: 64265 - DNA, 601 bp, Human
atgttaggttacaataactaacccagagaaaacatttcaaatcgtgatttttgtaaagtcaaaggatgctaaactcaaagttgtcatcaagaagttggtacttcaattctgtgtcacattttattagcatggtatcatggccattttttagaacaatatgctctcatcagtcatgagatatcacttcgctttgaatgttctgagacaactgaaagaaagtataaagagaatgcataagtatgatatcaatttccagaggggaaaaaatgaaaaagtagacagtttaaaaggtgaagagttmaaagctgcaacctgtaattcaattcattcagataacagagcctcatgtcttccccctcacaggtagcatcctggcactttaaaatttcctgtagaataagaggcagtagcataagcagtgtagaacaaatttcaaaaggaatagatattataaaagatttattagatattaaatgaatttagaggctaatgattttagaaaacaaactagaggcagtaccaagtttcaagaaacagaatatagctcaaagatttttatagacttcactgcaagcaaaatgcaattgatcatatttgcaaa

SEQ ID NO: 64266 - DNA, 601 bp, Human
gcatcttccttcatgaacacctgccaacctgagcagggtcccagacctgccctcagtgagcctagcaggggtcaccccgaatagatcagtatcaaataagctgtgtgaatgttgagaccttttatgaggtttctgtggaattctctgatcatgtaattaacactgttactcttcactgctgctgtatttttaaaaacctcttctatgtgagattttgctgagatgtatatgagtggcatgtccacctttaatggtcaacgtttgtgtcacctatacatttccttgttcttaatttgctttygtttaaatgtaatttaaaaatggacaaattagcaaaacggtgctgcaactgtggctgtatttatacatggcctatactgataattagcagcctatacggacaatttttttttaagttctctaacattcttgtatgtttctcagcttgtggcaaggatgttgttttatcaggtcagatgtccctgtgtccgctctgtggggaactccttagagtcaaccctgttgcatcttagtaccaagaccacttacatttctccttggcaacagactcaaagtatcaagcatgctggtcatcttggca

SEQ ID NO: 64267 - DNA, 601 bp, Human
tcaactgatatgcacctgaacgatctgcattacttgtctagattcggaaggttcagaagcccagagagttccaaggcaaaagcaacaacaagcaagaagaaacagaagaaatgatgatcactactgaagctagagagagaaagtttcttagatacaaaccctaaaagtactctaggcccacagaaagtaggaatgaaggcctgacatatacctcaaatacctctgagcatctcaaaccacagggatagaaacacaaagcttgacaggcctccctgggtttaccaatgacaggcctgtgtcyggtcacacagaatcacatgaggacatgccaggctgagcccaccacccagtaatattcatcaaaatctcgtctggaagtggcatacaagaagaacagcctgaagaacattcaaacagaagccagaatgggagagggctaggcagccggtgtgcattatagcctttctctgtagaacagcatttactaaatgtaaactacacactggtgtggcctttgctaattgctgcgggtgtgatgtttgactcggcggactgcatcttccttcatgaacacctgccaacctgagcagggtcccagacc

SEQ ID NO: 64268 - DNA, 601 bp, Human
gagggctacaaatgacgccatcggcaagcttcggggcactcattgggccacaggaactcccaagatgacaaataccttcccctgtttctaagagagaagcaagacgtgtccgcagtttacaatggcagcagagggtctactgggagcttgtgtttagtctcataatctgatacttacacaggactgagaatatccaagtactttccaaattttaattgatcactcctccggaaaaatgaacaaaagggcccaagagcagattcagaactgagtgctcagaatgttctgttgttccagaacwcaggagctgccctgtcactcaccgggggcacatgagcatcacctgggggcctggtagaaaggcggcctccacagactccccgacagcccctccagacccagccagtcagagccctgatgaaagtctaagaagcactgacacaatgtggaaccttttctcttttggtgctataaccctctccactcttttttgtatttagcttttatggtccctattttctcagttttgctctaccgaagtctcatcctttgaatagtaacaccaacgtccctaaccttcgggaaaggataagcagatgta

SEQ ID NO: 64269 - DNA, 601 bp, Human
cggacactgaggacattagcatggtgggggagtgggcccaggggctcccactcctagcaaaacccttgaagggtgctgacagggtccagggctgggaatccccaccctcctcttttgcagaaacaaaactctcagaaaaagagcttccgtaaattagggtcagaggccttcccaaacattgcagaggtgaagatgaagctaagagttcagtaagactctcagacactaaggaaagcaagtgtagccacagagatgggacgcccagattccctccagggaaggtcatgctgcccagctgagsgtgtgcggtctgcagaaggcctgcaggggcagctccttctaggtctgccttccgagggcagcctgtcattttggcccaacataggagcctctaggggcatgttccatagtgccccgccaggttagctgaggcttgactgggccagcatggcagtctgacttctccctctgcccaatctcacttctttcctcttccctacataagctttgatcctgatcaacatcttgaccccaaactgtgtcatcatctggttgggcaagtcactgtgtgtgagagttggcagaccatgacaacaaattc

SEQ ID NO: 64270 - DNA, 601 bp, Human
aataagggttatgaagccctgatttgttgctattctcatggagaatgaaatgccattaagagattcacagctgactgaaggttgaagcagaaagggttctaagtgatgtactgcaatagataaatatttatatctccgcacgatagtgtgaacctgggctccggctttcaggaattgctgttattatcatgtttcactcattttttaaaaaagcttgaagtgacaatttaatatagcatcaaattagtacttcaatgtaaagtcttgtttcatttaatgtttttgaaaggttaaattatckgtaatccttactgtgccatgggctatgtttagagattattcctacaatatacttcacatgaaagaaaaggaaagggaaaggaagggaaggaaaaggaagggaaaggaagggaagaaagaagcctgaaattatggattgctctggtgtacaatgaccaaataaataaataaatgatacaacttcctttgagtggatgtcttggtatgtttggggataatgatctgtaaatgtcagttaatataatttgatttcaaatcgtcttgaagtaaaaaaaaaaaaaaaaaaaagtaaggatgacta

SEQ ID NO: 64271 - DNA, 601 bp, Human
ttgagtccaggagtttgagaccagcctaggcaacatgagaagaccccatctctacaaaaaaaaataaaagaaatgagccaggtgtggtggcgcatgcctgtattcccagctacttgggaggctgaggcagtaggatcacttgaggctgcagtgagctgtgtttgcgccactgtactccagcctgggttacagaccaagaccctgtctcaaaaaagaaaaaaaaaaaagtctacttataaatgatgtcgtcaacaaaggtaaagtttctcccttcctaattctccctcagaactttttcctstactactgtgggcttgttagaaatgtaatgcaatgataaattagagtcatggaattaggctttcaaaaacataaaacgtaacagccaccagacctaggtttcctttgcccttaggcactcaccgagaataataagggttatgaagccctgatttgttgctattctcatggagaatgaaatgccattaagagattcacagctgactgaaggttgaagcagaaagggttctaagtgatgtactgcaatagataaatatttatatctccgcacgatagtgtgaacctgggctccggctttcag

SEQ ID NO: 64272 - DNA, 601 bp, Human
atctgaataggtgctgaaaatctactctcaaacttcataaaagtgaacctgattatcaccaattcttcttatacttgctatatgtagctaagtcaatcacacttattctttggggtcagctttcctattctcagtgttaaattcactgcattgcattttaaaatgttatttttgcccagttacttgggaggctgaggcaggagggttgctttagcccaggagtttgagatcagccagggcaacacagggagatcctatctctaaaaaaaaaaaaaaaaaaaaaaaaaaaattaaaatattmcttttattaagtaccgttcacttctgcactgtcatagctgggcacctcttgctcttgtcacttcccttcattacttaccacataatagcttccgttaattctaagagtgctgtcagaaactttcctatttttgctggctttttaaatttttctcatctgtaacatgcatttccaacactaacagttttcacttttttctgtctttttttaaaaaacaatctgcttacagctgggcatggtggctcatgcctgtaatcccagcactgggaggttgaggcaggaggatcgcttgagtccagg

SEQ ID NO: 64273 - DNA, 601 bp, Human
tcacaactgtgagcacatttttcttcaaaacttaaatatcatagacaaattaacaaaataacttgtaagcgaatgcttcaaaaacagcaagaagaggctgggcatagtggctcatgcctgcagtcccggtaattcgggaggccaaggcgggcggattacttgagcccaggagtttgagatcaacctggccaacatggcgaaactccatctcaacaaaaagaaaataaaagaaagacagtgagaagaagagcatgtactgggggtaccacaatgccatgcttttaacaacctattatttgamccggtcattctcttctttgtaagagtttaaagcatcctatctattacccttttgtaaaacactgttggctcaaccacaagacaatctgaggaacctttgcctcctctcttccacatgtttaacttccagattacaagaatgccaaagttacaatgcagtcccttggggccactgtttaggaaaggtgcatttctttcactttcaaccacggtctacaagatgtggctacaaggcaatccttccccactggcaaaaggacgtcatcaacacagttgtccctttctgcgatggtaatgtctc

SEQ ID NO: 64274 - DNA, 601 bp, Human
cttcttcactgtgtacaggctacctgatccacaccgtttgtttacatttctatctgcgtctcgataacccccaaacttatgattctcagtccacaaccctttcttttgagttgcacatccacataggattcatctagtgtaatacagcttcctgccaaatgtaagctccacgaaggtggcaagcactacccttagcaggacctcatgtgtaaaaaccatttcatatacaactgttgaataaatgaatccagcaaataattaaaaaaacccaagatgtttcctacagatgcctactctctcygctctctttataattaacaccatgacccttacctccaggtgttacaaatatgaaaattctagattttgaaagcagaaaaaaaacctgtcatttatgatgaaagggaagccccagatttttctcacgatggccatgacaaatgaagaactttacacaataagtaggaaaaaaggcatatgtcgggcatgaaaggaggaaaagagggtaccacaaaataacggtttaaggatgttaatcttaaaaaaaaaacaaggcagtcacatggttaacttgggggagaattcggaaatggtcacagtt

SEQ ID NO: 64275 - DNA, 601 bp, Human
ggtttgcgagccagaaaggtgtgtgtgtgtgtcctggcgcctccatttacgagctgtgagatcttgggcaagttaccaaatcactccacagtttagcttcattttccagaaaaagagcctaattcctaccttgaaggttgttttgagggttacaggtaagagtatgtcaaaatacttcacacggtgctgtgtactatactatactgaagatgataatgattattttcattcaaaactctgttaagaaattttaatgttacacctgttttgtgctcccaactgacatacagacatgtactgrgtggggtctgctccgaggcagttatttttgaggcccacaagacacagtccctgccccaggggacacaccgattttggttttgctgctcaacccctcactgagctcccatcacgaactacctttacagaatcccgccattcctctctgattcaagttgctgtgcagagccacagaaagctatgtctcacagcgacaaagaaccattattcatgctacaaatatggtcaagaaatcttttgaatattatacagcaaatcattgactagttgtccccccttaggaaaaaacacccatacagat

SEQ ID NO: 64276 - DNA, 601 bp, Human
ttttgctaatgcaaaacaggcagtaaatagccactgggtgaaaagaaaatttctcacatctgatctagagaaatgaaaaggggttcttggcctctgtagaaaggtggttggatgggccttcaaacatggagactgaggaagtctagtctccacgtgcagtagagagaacgtaggtttgcgagccagaaaggtgtgtgtgtgtgtcctggcgcctccatttacgagctgtgagatcttgggcaagttaccaaatcactccacagtttagcttcattttccagaaaaagagcctaattcctamcttgaaggttgttttgagggttacaggtaagagtatgtcaaaatacttcacacggtgctgtgtactatactatactgaagatgataatgattattttcattcaaaactctgttaagaaattttaatgttacacctgttttgtgctcccaactgacatacagacatgtactgagtggggtctgctccgaggcagttatttttgaggcccacaagacacagtccctgccccaggggacacaccgattttggttttgctgctcaacccctcactgagctcccatcacgaactacctttacaga

SEQ ID NO: 64277 - DNA, 601 bp, Human
tcctcatctccttcaagtctgctccaatgtcatctttctcaggggaaccttccctgacaggactatttaaaaccctccccctctttaattctgtctatagcacttaccacttctgggtatgctctatgactaacttatcacttttacttactgcctgtctttacccaccagaatgtcagctccccgagtgcaggtttggtttgttcatcccatcacttccagcatctagaacagtgcctggtatgcagttggctgaatatttaagtagatgtgatatctctaacatgtgccagtgtttttyggtgaggccagcaagcacttattgcctcacaggaaggaatacactgctacttgtctggtagctttaagtgctgagcggctcctaagcatttctgatgatcaatgacaacatttacaatgtagaagagtaagcttgagttactttacaaaaattcataaaatcagtctcacctttaagtcgtatttcctatacacagacaaacggtggctgaatacatttcttgtaactatcacatatatttcaactccatcaacattaagccggtacatgcccaagaactggggaagaagggtgatccca

SEQ ID NO: 64278 - DNA, 601 bp, Human
caataaaaatgtatttataaaattggcccagccagccgcggtggttcatgcctataatcccagcactttggaaggccaaggtgggtggattgcttgagctcaggagttcaagatcagcctgggcaacatggtgaaatcctgtctccaccaaaaaatacaaaaaattagctgagcatggtggtgcgtgcctgtggtcccagctacgtgggaggactgcttgagccagtggggcagaggttgccatgagccaagattgcgccactgcgctccagactgagcaacagaggaagactctttctcaaaaaaaaaagaaaagaaaagaaaaaaaagtccctcaagtaggatttggaattcaggcaagtcatagttttccaacccctaacttgaacattctcccctgaattggtgataccagaagccagattatgtcactccactctcagaatttccaggggcccccctttatctccaagcctttgaaatggtctctgtacttacagttccctctgccagcaatattcttcctcagctcatttcctcatctccttcaagtctgctccaatgtcatctttctcaggggaaccttccctgacaggactat

SEQ ID NO: 64279 - DNA, 601 bp, Human
caatcaatggatttcgatgaagagtacaaaaagttcattgatatgatttcagatttcataatgtaactaagctttgagaaattacctcttgtcaagctttggtgtagtatcaaagaagaatatctacaattatccaaaaaagttgttaaaacatgctttaacaactttccaaacttcattattgtgtgagttcagattttcttcacatacttcagcggcataacaccacacagactgacagcggaatcagacaggacattccaactatctcacattaagtcaagacattacggagatttgyaaaaatgtaaaacaatgctacttgtctcattcatgtttttgcttttggaaaatagttatttttcataaaaatgttaacatgtaatgtttttctcatttttaaagaaactacatattctaatatttcttatattaatttttaatactgtaaatatccacagacacaactcacatctgcaaaagctttcgagtgtcctcttgtaagagcgtgaaagcgttgagaccaaaaaacttgagaaccaaatgtcagagaccagagtttggcaaacttttctgcaaacagtcagtgggtaaacgtttt

SEQ ID NO: 64280 - DNA, 601 bp, Human
aatatgtaaaagacttttctgatgacattggtggtaacactgttatgactttttgatactgtataatgaaatgtgtcaatatttggaagagtcaaataactcagtgaaccaatgtgttccaaatggcaagtgcatgccttggcaaaatcacacattcaaacaatgcatgcaaaccaatcaatggatttcgatgaagagtacaaaaagttcattgatatgatttcagatttcataatgtaactaagctttgagaaattacctcttgtcaagctttggtgtagtatcaaagaagaatatctayaattatccaaaaaagttgttaaaacatgctttaacaactttccaaacttcattattgtgtgagttcagattttcttcacatacttcagcggcataacaccacacagactgacagcggaatcagacaggacattccaactatctcacattaagtcaagacattacggagatttgcaaaaatgtaaaacaatgctacttgtctcattcatgtttttgcttttggaaaatagttatttttcataaaaatgttaacatgtaatgtttttctcatttttaaagaaactacatattctaatatttc

SEQ ID NO: 64281 - DNA, 601 bp, Human
acgaaaagagctggtgctggcaagggccctggaggatggctgggatttccccaggggcaattccaggggcacaaaatggcttgcttgggcgaagactttaagacaggacaggacaagggtgtatttgggaagtggatccagtgtgtggggacttcagaggttaggagacaagcctagaccatttccttcacttagactagcatttctctaagcatggttcagaaccctggggtcccaagaccaaaactatacaaagccaaaactatttttataataatactgagaaattatttgccttttycagcgtcttgatatttgtataaataatgcaaaaacaatggtgggaagaactgctagcagtttagcataagtcaaacagtggcaacagtgggtattagtagtgtttgtgatttaaaaaaaaaaaacaatgaaaaaaaccagcaccatctaagaaacccagcgtcatttcagaaacctctgaagccacacatcctggtttttgtgacttgtgagctgtgtacgagttgctgaacttctggctaagatggtgtgtcatacaagtaggcatctagtaaacacatgaaagcataacattaaatgt

SEQ ID NO: 64282 - DNA, 601 bp, Human
agccctgactctgtcttgctcacctgtgtttctgtggttcttgtccacctgctggaagttagaaaacctgaccatcacttacttgagcagtaacttactcaacactggatcagccccacactttactccttgtatcaactgccagaaatagtcagtcctgttatcttaaagagtcccactagctggctgcagtgggaccacaggagcgttaagtgcctctttccccacattacgtccttctgtgggcacatcctcacctgctgacttttttctgcaatgctcattgttttctcccgtcttaagagttactgatgaacactctttccttgcttgctatacatcagtcccccacagccactctctgaccccatttactttggagattccttcaaagacacacagttatttgtacctcttttgtgccaggccctatgctgagtgcagaggtacaaagtggaggaaaacatggcccttgatctcagcagtttgtgctcttactgcagtggtgttcaaaactctgccttagagctctgggttgtctagcatgacctgagtctacctcggaggccgacggggaggctttaggggtagagtccaagca

SEQ ID NO: 64283 - DNA, 601 bp, Human
gcggaatgggcttctcatccctccctgaccatggctctctgtccggcctgtgtcccctctctgcaggtattcctggccactggccgcttctctagccctgactctgtcttgctcacctgtgtttctgtggttcttgtccacctgctggaagttagaaaacctgaccatcacttacttgagcagtaacttactcaacactggatcagccccacactttactccttgtatcaactgccagaaatagtcagtcctgttatcttaaagagtcccactagctggctgcagtgggaccacaggagcrttaagtgcctctttccccacattacgtccttctgtgggcacatcctcacctgctgacttttttctgcaatgctcattgttttctcccgtcttaagagttactgatgaacactctttccttgcttgctatacatcagtcccccacagccactctctgaccccatttactttggagattccttcaaagacacacagttatttgtacctcttttgtgccaggccctatgctgagtgcagaggtacaaagtggaggaaaacatggcccttgatctcagcagtttgtgctcttactgcagtggtg

SEQ ID NO: 64284 - DNA, 601 bp, Human
gctggtggcagcagaatggggaacaggaagaaccacaatagcaggggtgggagactagaaataaagagtaaaggtgattgggagtatgtgatcatgcccccaggacatggggagacatacagcaaggtacttaccttttctttgtcactagcttctctagccactgtagagccctgaaacacaaggcaataataaaaacatgcgcatgggaggcattgggtttcacacgcagaaaatatgaaaatggctccaggcggagcagagagccagctcagcacccactctgcttcgcagcccatgyggaatgggcttctcatccctccctgaccatggctctctgtccggcctgtgtcccctctctgcaggtattcctggccactggccgcttctctagccctgactctgtcttgctcacctgtgtttctgtggttcttgtccacctgctggaagttagaaaacctgaccatcacttacttgagcagtaacttactcaacactggatcagccccacactttactccttgtatcaactgccagaaatagtcagtcctgttatcttaaagagtcccactagctggctgcagtgggaccacaggagcgt

SEQ ID NO: 64285 - DNA, 601 bp, Human
cagcctgagccaggcgcccttgctatgtgctctagagctccctgagtgtcctgtccaagtgttcaccccatgataacataattttctatttgaggtctgcatcccctgctagatctttctgtgtgtcttgttattttagcccctgaagctaggatagtagccacaaaaatattcacaaacacctctgaatgaacaaacaaaagtagatttgcaaatctataaaattcaactcaaaactgctatcagtctaaaagaacaactttcaaacaacaattttgagctctgttttcaaatggaatasttaagaaaaaggcacttcccaaggtgacaagaaggcataactaagagtatagatgtaccctttatataagcatgtgttgacttgagttagtttaggtttacatccaggaagctacttcctaaattcctattcaaaccaatccttcaagttgactctctctataatcttgcacagtaaactaaatgtggctcaaatactacctaaggtccaataagccaggaaaagagaaaaagagatgcagtcttcttatccttaatttcttaggcaaaaaatacttgtatcatgtcttaatagttggaa

SEQ ID NO: 64286 - DNA, 601 bp, Human
ctttcagggaggattcccacactcttttttcagctgagagccactgtgcagcctctcatgcctactggatatctctgttctgacgccgcactgactgttgggggaagtcagggaccccaaacggagggaccggctaaagccatgacagaagaacgtggattgtgaagattttatggacatttattagttccctaaattaatacttttgtaatttcttatgcctgtctttactgcaatctctcaacataaattgtaaagatttcatggacacttatcacttccccaatcaatacccttgtgmtttcctatgcctgtctttactttaatctcttaatcctgtcagctgaggaagatgtatgttgcctcaggaccatgggataattgcgttaactgcacaaattgtacagcatgtgtgtttgaacaaatacgaaatctgggcaccctgaaaaaagaacaggataacagcaattgttcagggaataagagagataaccttaaactctgaccaccagtgagccgggcggaacagagccatatttctcttctttcaaaagcaaatgggagaaatatcgctgaattctttttctcagcatggaacatc

SEQ ID NO: 64287 - DNA, 601 bp, Human
tcttctccacacactcctcctgggggacctcacccactttcctgtctctgccaaccatcctttcagggaggattcccacactcttttttcagctgagagccactgtgcagcctctcatgcctactggatatctctgttctgacgccgcactgactgttgggggaagtcagggaccccaaacggagggaccggctaaagccatgacagaagaacgtggattgtgaagattttatggacatttattagttccctaaattaatacttttgtaatttcttatgcctgtctttactgcaatctctmaacataaattgtaaagatttcatggacacttatcacttccccaatcaatacccttgtgatttcctatgcctgtctttactttaatctcttaatcctgtcagctgaggaagatgtatgttgcctcaggaccatgggataattgcgttaactgcacaaattgtacagcatgtgtgtttgaacaaatacgaaatctgggcaccctgaaaaaagaacaggataacagcaattgttcagggaataagagagataaccttaaactctgaccaccagtgagccgggcggaacagagccatatttctc

SEQ ID NO: 64288 - DNA, 601 bp, Human
gggtggatcacgaggtcaggggatcgagaccatcctggctaacacggtgaaactccgtctctactaaaaatacaaaaaaattagccaagcgtagtgacaggcgcttgtagtcccagctactagggaggctgaggcaggagaatggcatgaacccaggaggcggagcttgcagtgagctgagattgcaccactgcactccagcctgggtgacagagcgagactccgtctcgaaaaaaaacaaaacagtttggctctattaatacatttcatttcatctattacagtttaacaaacgtttctrgagtctacaaaacactgctgtatcagagagagaaggcatggcatgatctctaccgagccatgaatgacgactttcccctgggttcgttctagacgtgcttctcttctcgacacgctcctcctgggtgacctcacccacttccctgtctctgctgaccgtccttccagggaggattcccaagccctttgttttcagctaagacaccctgtgcaccctctcatgcctattggatatctctgttctgacgccaccctgacatttcaaatgcctcctctctctctagtctgggtgatgtatccc

SEQ ID NO: 64289 - DNA, 601 bp, Human
gtttttaagagttcggcttggccgggcgcggtggctaatgcctgtaatcccagcactttgggaggccgaggcgggtggatcacgaggtcaggggatcgagaccatcctggctaacacggtgaaactccgtctctactaaaaatacaaaaaaattagccaagcgtagtgacaggcgcttgtagtcccagctactagggaggctgaggcaggagaatggcatgaacccaggaggcggagcttgcagtgagctgagattgcaccactgcactccagcctgggtgacagagcgagactccgtctygaaaaaaaacaaaacagtttggctctattaatacatttcatttcatctattacagtttaacaaacgtttctagagtctacaaaacactgctgtatcagagagagaaggcatggcatgatctctaccgagccatgaatgacgactttcccctgggttcgttctagacgtgcttctcttctcgacacgctcctcctgggtgacctcacccacttccctgtctctgctgaccgtccttccagggaggattcccaagccctttgttttcagctaagacaccctgtgcaccctctcatgcctatt

SEQ ID NO: 64290 - DNA, 601 bp, Human
cccgccgccctggccacctcacttcaatggcagcccagatgaccagataggggtagtaattaattataatttgttacaatttaaagaccacaaaagaaatgctgaaaactggtttcgaaaagcatttttagacgtaagggtattaatgattaatcctctcgaaccctcagttggtaataggtaaaacgtcggagacggtgacagtcacttaattgctggtgcaattcacagtgcctgagaatcgacaaggcggctttttgtagcccattatcaaagtgtcaacaatgattattgccaatayagttacacaaatgccaattgcagggcagctgttttctttcaaatgggtttcaggaagaaggctgtatgttaaaagggatcttcttattgtgaccctatggctccattacacatactttactttacctaataaaatcagacatgagttttgagaagaactgtgcaggatgatgaacaaaatgcatatttgtgtaaatccccaggactctctctctcaagaacatgggctttttaaagagtcaggtcaaatcccccagaaatcaagtgagtccagttatgttttcttttacttccccaggtc

SEQ ID NO: 64291 - DNA, 601 bp, Human
ttccccatcaatcatagcaatcaccttaatctatatctggaatagagaagattttagtgatggtcaggccaggacttctccaagtggggccgactgctgaaccacatctctggaggaaggtccaggaaagcttcatttgaaacaagagattctcaccaacactacagcatgaggagcaatgacgcaagcaaatcctttaattttacaaacgaggacaaagtcagatgacctatactcaaaccccattaatgcagccctgtgcccccagggctgggactcagatcccctaaccctctgtttsgagtccttcacccaaatctcccttttataaaatgtctctggtccagaaggtagatgttactggtgccacctttaaggtctgagaaagaagccctgcttctgccctagtgggaaactttcccctgcactttgggtagtaggattggtgtccctaactaacactggctggcaaagggaaatgattcccttctatctcggaagaaaaggaattttacagaaggcggttaaagcattagctgaattgagggcctaaaaagcttgacaacccccctttaaccgatgatccgcccacagtggaaaa

SEQ ID NO: 64292 - DNA, 601 bp, Human
gaaagagaatatacctcaacatacttgtgaaacagtgctgtaagtaagccgcgcaaaactggagaagcgttaagttataactgttagggctggcaagacctagctgttggcaattttccctcaagctaatacgtaaaaagtaaaatttattccttttttaatactgtcatattttatgacaactctatgtggtaatgtcaaaggtgacggtttggtcttcctccacaaactgggatatgacagctgaactgcatacaagacctacaaaataggacctacgggatggcttcgttccagtcgkaacagaagattctggtgcgcagatatctatggtgataatctaagaaatgtcaaaggctgaacactcaaggagtttgctaactcctctagatctctggtttaatactaccatgttaaagatcattatttaattaagaattacacatctgtagcagcttggtttaaattcagaccacatactgaattttggaagtcttctctccaccccaactttttctagaaccaactacgagttgttagcgtgaaaacattcccatacctaacagcagtgctccacgtgtgcttgggatactctgagttg

SEQ ID NO: 64293 - DNA, 601 bp, Human
ttaataacttctaattttcacagtgaaaacagtgagaatgtgcacatctgtgactagcatccagatgtgaacatcttataatttttattttgaatctgtttatgtatgaatgtggaaagagaatatacctcaacatacttgtgaaacagtgctgtaagtaagccgcgcaaaactggagaagcgttaagttataactgttagggctggcaagacctagctgttggcaattttccctcaagctaatacgtaaaaagtaaaatttattccttttttaatactgtcatattttatgacaactctrtgtggtaatgtcaaaggtgacggtttggtcttcctccacaaactgggatatgacagctgaactgcatacaagacctacaaaataggacctacgggatggcttcgttccagtcggaacagaagattctggtgcgcagatatctatggtgataatctaagaaatgtcaaaggctgaacactcaaggagtttgctaactcctctagatctctggtttaatactaccatgttaaagatcattatttaattaagaattacacatctgtagcagcttggtttaaattcagaccacatactgaattt

SEQ ID NO: 64294 - DNA, 601 bp, Human
agaaaaagggtggttttgcacaaatagtacatatgccaacctcctttaactacataagcagaatgtctatacaagttcatggtttgagaaatgatctaagaggtcattaataacttctaattttcacagtgaaaacagtgagaatgtgcacatctgtgactagcatccagatgtgaacatcttataatttttattttgaatctgtttatgtatgaatgtggaaagagaatatacctcaacatacttgtgaaacagtgctgtaagtaagccgcgcaaaactggagaagcgttaagttataaytgttagggctggcaagacctagctgttggcaattttccctcaagctaatacgtaaaaagtaaaatttattccttttttaatactgtcatattttatgacaactctatgtggtaatgtcaaaggtgacggtttggtcttcctccacaaactgggatatgacagctgaactgcatacaagacctacaaaataggacctacgggatggcttcgttccagtcggaacagaagattctggtgcgcagatatctatggtgataatctaagaaatgtcaaaggctgaacactcaaggagtttgctaa

SEQ ID NO: 64295 - DNA, 601 bp, Human
gcaaacaggattttggcactaggttttaatgcaaaggataatacatatcatagtactctgtgattaaaggacttgtatttcggaatgaattttttgtttgatatgctcatttggcaacctatttattattttttaagtctaattgtaagcctcaatgtcaaagactgctgccgggtgtccttttgatacgctgtcactgtgacactcagagctgaatgctccacataaaaaatacgtagtaattattgttttatgttagaactgcttgtgttcctgatttacttgtaattccaagctcacycaaatgaaaataaacttgcaaaaaagaataaaaccccttttgccgtgcttgcaaaaatcttcataaaaatcagcatctatggaactgaaaacataattcacaagtatttctataagggaaggaattttaggtaatccttatgttggagctaggataaaaataatttgatggagtaacatatttggtatcaattctggggtaataagagatgctggagatttataataaaatcagttctgcttcttggaacatctaagccacaaatttgatacatcaaaaggcaaattagtggatacggat

SEQ ID NO: 64296 - DNA, 601 bp, Human
atttcatgaggttctgtaatttgatgcataactgctgtcattcatatggagttgagcaatattggatattctaaggtttagtaaagccagaagttatatgaacattttattttagtgagattttaaaaaactatctttcagatgacacaaaatttttaaaaatcacaaatttcaaactatagtttgaaacattaaacagaattcaaactaaaatatcattggatttttaatgatcattctaaactttaattatacaacaagagccaacagtatgggtaaatggccattaataactggaaayagaaaatacatgaacctaaaatgcacagagccaaaatctttataatatagagccaagtttttattttagtctggatggaaactttactgggaagaagaaatgcacccagtcacacttgagtgtctaatgcaaacaggattttggcactaggttttaatgcaaaggataatacatatcatagtactctgtgattaaaggacttgtatttcggaatgaattttttgtttgatatgctcatttggcaacctatttattattttttaagtctaattgtaagcctcaatgtcaaagactgctgcc

SEQ ID NO: 64297 - DNA, 601 bp, Human
tataatgggtaattaataatactgtacctatgtaatagggttagtgtgtaaatcaaatgacacaaagcacatagtgcctggcaatagtaacttgctatgtctatttcttctaaaatagggtctttaaacttaggataccttctagttgatacctggataattaaaaaaaaaaaacaatttatgatgtcggtaatctaaacctgggggtccaatcttttagcttccctgggccacactggaagaagaattgtcttgggccacacatagaatcagtgaacactaatgagagctgatgagcttaaaaaaaaaaaaaatcacaagaaaatctcatcatgttttaagaaagtttacggatttgtactgggccacattcaaagccgtcctgggccccatgcagcccgtgagcgacaagctttatttaaacgatgtttaaaatttcctttgtttttaggttttatctgctagttacaaacatgtcacatgaattctctacatactgtcttcaaatttggaagacacttttgtcactgcacactgcacacaaacctaccatacatgagggcaaagttagtatttcatttcactacacaggacccacggg

SEQ ID NO: 64298 - DNA, 601 bp, Human
tgggaccggggattcccagcggatgacagcaggtgctttcttgtgtttggtgcctaaatgagagggctgctaaactggcatgcgtttgctttaaaccagatcatgtaacatgagacaccttcatgtctgacttccctaaggtagagtatgcaggtttttgccttgattgaagatttaaatagatggtttaaaaagctcctaaaacccaacagggctgatatttatacaatgagtctggcctctccactgactgttcttacctcaacatccttttttagtttttccaggaagaccttcttgytgttgtcatcaatataaatcttttggccctcattaatgaaatcattatctttcagagttggcagttctttggcctaaaacaaatgagaaaaacaatgacaaaggcgcttgaagaaaacctaaaaaaaccacatacaccttccaaccctggacactgaagtttgcccctttcaccgcccccaccccgttcaccaccacaggggtcttacccaaacaataaaataggagaaggcttgaataccaccggggggcgccagtgagccccaatctctggaagcattcgcaagagcagtggggtggg

SEQ ID NO: 64299 - DNA, 601 bp, Human
taaaataatgtaaaaaattttattaaactaatttatgatctaaaaatattaactactaataacttggtcagtgtgagtttcttgtaataaaaagaactgttagaagattaaaaataaattatactgcttccgccttcatgggaaatacaaatgtatgacactcattctgtggctttcgtcattttctttttctttttttttttttggtttaatgacataaaaagacaatcttcccacaaagcctctctctaagtagcagatccgtactggtgtgccatgaagtgtacacaaatgaatgaamgcaacagctaagaaaagctgagtttagtagctgcctaaattctaattcccactgcattgttttgtaactcaacgaagtccaagaaaataacctttttttggccgggcttggtggctgacgcctgtaatcccagcactttgggaggcagaggcgggtggatcacgaggtcaggagatcaagatcatcctggctaacacggtgaaaccccgtctctaataaaaatacaaaaaattagccaggcgtggtggcgggtgcctgtagtcccagctactcaggaggctgaggcgggagaatggcgtg

SEQ ID NO: 64300 - DNA, 601 bp, Human
agactgtctctaaaaacaatggcaacaagaaagtagatacttacacccttcacaaataaccaatatataggttctaatccaagtatgtatactataaataatccaagtatgtatactataaaggtaaaataatgtaaaaaattttattaaactaatttatgatctaaaaatattaactactaataacttggtcagtgtgagtttcttgtaataaaaagaactgttagaagattaaaaataaattatactgcttccgccttcatgggaaatacaaatgtatgacactcattctgtggctttmgtcattttctttttctttttttttttttggtttaatgacataaaaagacaatcttcccacaaagcctctctctaagtagcagatccgtactggtgtgccatgaagtgtacacaaatgaatgaaagcaacagctaagaaaagctgagtttagtagctgcctaaattctaattcccactgcattgttttgtaactcaacgaagtccaagaaaataacctttttttggccgggcttggtggctgacgcctgtaatcccagcactttgggaggcagaggcgggtggatcacgaggtcaggagat

SEQ ID NO: 64301 - DNA, 601 bp, Human
cacagataaccctaagggctacttaccataattgctaaaaccatattcttctcagtatcaaggatttgctgattaatcaataaaaatccaagagtatgtttactaaggatacttatcagttggatcaaacagatcccaaagcaagggggaaatgcttaactaatacattttattagtaaccactcacaactgaggaaaactaaacattccttaatgaaagactggaggaaaatgttagaagagaaaagcaaacacttgtatcgttttgtttgtttgaagtagatgcttacaggctaagcasagtggctcatgcctgtaatcacagcactttgggaggctgaggtgggaggattgcttgaggccaggagttcaagaccagcctgcgcaacaaagcaagaccctagtctctacaaaaaaaaaaaaattcaaaaattagccaggcaccgtggtgcatgcctgtagtcccagctactatggaggctgaggcgggaggactgcctgagctgggagttcaaggctgcagtgagctatgctcatgccaccccactctagccaacacagcaagactgtctctaaaaacaatggcaacaagaaagtagat

SEQ ID NO: 64302 - DNA, 601 bp, Human
tcctcatacaccgatctgtgtgtgtgtttgtgtgcagaaaaagactcacctgtgttacgtgcaaagctatgtggatgaaaatacccagcatggcataggaatagaacagggctgctgttacagaaaaacagcaactagaacctcagatgaaaattagttttcctaaaatctagatttcttgagctgtaatacactcagatctcctactcgaggcattaaggaaaaacagcaacaacaacaaaaaactgcaatgaaactccaatgggtcagtcagctaaattagaaagcatggaactgatgmaaacagaaaactcgattaaattctagcctcattatcaagatcagatgtcaagctacttcaccataattacctgcttaaaaatttaatgatggttctgcataaatttcaaaactaaagacactgttatcagctattgagaatatttttaaatgaaaggatgttttacaccctgcctccatttcaacgaaacagctaagtgcttgagccatgtatgggattagactatagagtcctctaatcaatggtattattagagacaacaaaagagctaagaggatccttctgtaattcaactgtaaa

SEQ ID NO: 64303 - DNA, 601 bp, Human
aaggacttgggctcgatgtgctccataaatgctgccacccatcccactactcccaccgccctatcccctctcacccatctccatggatggggggctataaacctcagacaactgaaatgccctgtgagggggtactcctggatgccacagagggagaacagttttgcatcatgtgagtcaatgagaggagagaccagggttgattcttcagggccgtgatcagaattgacaaaacacagggcagaaggcaaaagtgcttgtcactcctcatacaccgatctgtgtgtgtgtttgtgtgcaraaaaagactcacctgtgttacgtgcaaagctatgtggatgaaaatacccagcatggcataggaatagaacagggctgctgttacagaaaaacagcaactagaacctcagatgaaaattagttttcctaaaatctagatttcttgagctgtaatacactcagatctcctactcgaggcattaaggaaaaacagcaacaacaacaaaaaactgcaatgaaactccaatgggtcagtcagctaaattagaaagcatggaactgatgaaaacagaaaactcgattaaattctagcctcattatc

SEQ ID NO: 64304 - DNA, 601 bp, Human
agccaccacaacaggcctcaaactttactttaaatctgttctgaggtagagtgaatgaagtgtggcaatacatctgagatttttcgtgggctggaagctcgcagatggaaagagaagacagaaagggggcgtgggcttcactgcggggtctgcttccggctcactgcaggaaaacagtatatatttgttctttaagttttaagaacataagatttcaaagtgtgaagatttttcagtctttatttaggtcccctgcttttcttcctttccagcttctcagaaaccacctgctggacctcasatctgcctctttttccctcagaatatcccttctcatctaattccttactaattgagtccttgctgtgacaaatctttgagctacaatcttccttgagatctttacgagtctaagactatccttcacaatggttctcaactgatttatttaactctactaacacaccgtgttctaccacatcaccatctcccaacatatctgtgaagtagaattaaaatgccagtcagccctgtttaacggttatatcttaccacttgttaaaaattataatcctccttcgaagcaattatcagaaaacaa

SEQ ID NO: 64305 - DNA, 601 bp, Human
gagactgcatgaggcaacagctctgcaaaggaagcgcaaggtgaccatttaagacgattaccttaacaggaaggtctactggttgaccttcaagtatgttttagttacagaagtcagggctgtctgtgattaacttgccaaagggcagagagggaaggggacaactgggactggccagccgcactcaccagggtgagcctccagggcccagcctcccctggcaccccatctgggttcctcgccacaccgggcagcccagagtaattttcctgggcctcaggcctgtggtcagaccgcttaytgtcgtcttccagtgaggaagaaataaaggtgcagtcaactcctagcacaacccaaaaaccatcagcatgatgcaaaatgcatctctaggtaagaagctgttctgaggcacccaagaagactgagaaaattgcagtcacaatgggcattgcacatgttttctttttgtttaagagatgggatcttgctctgttgcccaggctggagtacagtggtatgatcacagatcactgtagccttgaactcctgggctcaagcaatcctcctgcctcaccctcccgaggagctggattacagaggt

SEQ ID NO: 64306 - DNA, 601 bp, Human
ttgtctgagactgcatgaggcaacagctctgcaaaggaagcgcaaggtgaccatttaagacgattaccttaacaggaaggtctactggttgaccttcaagtatgttttagttacagaagtcagggctgtctgtgattaacttgccaaagggcagagagggaaggggacaactgggactggccagccgcactcaccagggtgagcctccagggcccagcctcccctggcaccccatctgggttcctcgccacaccgggcagcccagagtaattttcctgggcctcaggcctgtggtcagacygcttattgtcgtcttccagtgaggaagaaataaaggtgcagtcaactcctagcacaacccaaaaaccatcagcatgatgcaaaatgcatctctaggtaagaagctgttctgaggcacccaagaagactgagaaaattgcagtcacaatgggcattgcacatgttttctttttgtttaagagatgggatcttgctctgttgcccaggctggagtacagtggtatgatcacagatcactgtagccttgaactcctgggctcaagcaatcctcctgcctcaccctcccgaggagctggattac

SEQ ID NO: 64307 - DNA, 499 bp, Human
atacatgggcctgtggatgtggaagagaactgggcactccggggtatagggacaggtgacaagatccaaggcagggggcaggctctccgtgtgagacagcagccaggctcagcagctggacgagagtgcaaggattcaaatccaaggaggggtgaattcagggcctgttctgagcctgtactctctgctctctatcagctacctctggaggctgccttaaagcagctttcccctctccttttcttcgcaaccctaggaggaaggtaacgagttaaaatcagctggcatcggaggccctccwcacatgactctgcgctgtgggtctccggagggttaggtggccagcagcagcacacatggcactgctgtgatcatggaacctgctttcccgtcagaatgacctgtgggcctggggtttcagaagcctatttgaaaaatactgcattgtaagtacccagttgtcttctccaatgcttgaggggtatggtgggggtggggg

SEQ ID NO: 64308 - DNA, 601 bp, Human
cccaggcttgaatgcagagagaatggtcccccacagcagcttaacacagcgttcctttgctgacagtaatgttttcttcttgcaaactacctgtgattttatgccgtgtggcacactatggaggcgaacttgtggcttatggggagatgaacatggagccatattggctaggataggagagatgaacatggagccatattggctaggatacactccaatttcacaggatgtataatatgggaacagacatttacaaagcatttgtccagacaactcttgtatctctggcaaaaccccatcmgcaaggcagtaggatttctgtatgaggtgaaaaaacaggagctccaaaagtgtccccttgaggtcatacaagtgggaagggtcaaacgaggattcctcgccagttctctctttgccacactccatggttttcaaccagaggtgagcatcagaatgaccatggagtcttctgaagacccctccctcaccctcctgaactggcctcagaaatgacggaatgggggtggtgcacctggtgcggatgtttgtttaaaaagagtactcaaaaatttctgttggggggaagccaccaggcacactt

SEQ ID NO: 64309 - DNA, 601 bp, Human
tttccttttattgtgaaagactgtctaccatgtactttgactaaaacactcacgtaaaaacatggctgcaggatacgtctcaaaatatgacaaacgttatttcacctatactgtgactttacatgtaaacttcaaaaatcacatgctgtacatcaaatttttagattcaaaagatatccctgttttcctaataatgtaaacagtaaaactgagggtttcagttaaagggataattcgtaacaaaatcccattgttgaaacaatggtcaaacataaacatcttataattcagatctgcattyggtaacaggagaattgagagttttgatgctttgctggttttcccacagtgggagatgtagataccattgccccaaactatgcacttttcaggtaagctttacttttattttgtagcattaattcctatattgcaacgtaagggtgaacaatgaaggctccaggcaagaaaagagaagtaagcagttttcctggacatattggccgaggtgaaaaatgtatagagaatcactggggcatcagctgcttgttgcgggaggggtgggggctctggacaccagggggtcctgacaaggctgggg

SEQ ID NO: 64310 - DNA, 601 bp, Human
tgttttcttttctgaaactgcccacaaaaatcatatcatgttttaaacaaggagtttcaaaggcatggctttagcgcagcatgtaagtggataacctactctaagcaagactaatatttaagctcaatgccttttggaaaatgcaggagagttggtagatacatgatctaggttggaaatttataacttgattaaaaacaatcagcacagtttagggcaatgaactttcataaaccagactggggcgaaatctctttttaaaaaaatcaatcattaggttgataaatgtacatttggaggaaaaaaaatccttttccttttattgtgaaagactgtctaccatgtactttgactaaaacactcacgtaaaaacatggctgcaggatacgtctcaaaatatgacaaacgttatttcacctatactgtgactttacatgtaaacttcaaaaatcacatgctgtacatcaaatttttagattcaaaagatatccctgttttcctaataatgtaaacagtaaaactgagggtttcagttaaagggataattcgtaacaaaatcccattgttgaaacaatggtcaaacataaacatcttataattc

SEQ ID NO: 64311 - DNA, 601 bp, Human
gtagagacagggtttcaccgtgttagccaggatggtctcgatctcctgacctcgtgatccgcctgcattggcctcccaaagtactgggattacaggcgtgagccactgcacccggccctttttttgtttttttcctgagacagggtctcatggtgtcacccaggctggagtacagtggcacaaacatagctcactgcagtctcaaactcctgggctcaagtgatcctcctgcctcagccttgcaagtagctgggactataggcacgtgccaccatgccctgctaatttttttatttttttrtagaggcagggtctctatgtattacccaggctggcctcaaactcctgggctcaagcagtcctcccacctcagcctcccaaactgctgggattgtaggcatgagtcacctcacctggcctccagtttgctttccatggtcattaaccatttgcacactgaggctctgctctgaggttagctgtccagagtacttaagataatttaattgccgaagggagtgtcatgtatgaatatttgagtctgtggagtcttaaaaatatccagcgacaccataaacagctcattagccagcagaacctt

SEQ ID NO: 64312 - DNA, 601 bp, Human
cagctaattttgtatttttagtagaaatggtgtttctctatattggtcaggctggtctcgaactcccaagctcaggtgatccgcccacctcgtcctcccaaagtgttgggattacaggcgtgagccaccgcacccagccagtgttagtgtattttatgtgtagtccaagacaattcttcttccagtgtggcccagggaagccagaagattggacagcccactatagagtctatagtgtgctgtgttgccaggtggttttgtccaactgtaggctaatgtaagtgttctgagcacatttaargtagggaaggctaagctataatgttcagtaggttaggtgtactaaatacttttttttttttttttttttgagttggagtgttgctctgtcgcccaggctggagtgcagtggtgcaatctctgctcactacagcctctgcctcccaggttcaagccattctcctgcctcagcctcttgagtagctgggattataggcgtgtgccaccacacccagctaatttgtatttttagtagagatggggtttcaccatgttggccaggctggtctcaaactcctgacctcaagtgatctgcccgcct

SEQ ID NO: 64313 - DNA, 601 bp, Human
tgctaccacacctggctaatttttattttttgtagagatgaggtctatgttgcccaggctggtcttgaactcctggcctcaggcaatcctcctgcctcaacctcccaaagcattgggattacagatgtgagccactgcatctggcaactttttcttacactgaacaagccagtattggggccggggtctcagacactgtgactgatgctgtttatttacctgtttgcatccagcattgctgacaaggcaagagtaagtaactgctgctcactgacatttgggtatgcacagcaaagggctycatgtaatctgatggttatgcccatgaaagctcattaagagagctcagatactaggcccagaggatcagggcttcttaggtgtgcagggacacttggtgaaaatggttgtatcagttagctattgctatataacaagccatccccaaacagtaactaaacagcagcgatttgttattgttctccatcttttgggttcgttgggttctttgtagatcttgctgagcttactcatatggctgcatacagtgtacagctggactgtcctggggtggaagctccaagatggtcttacccataca

SEQ ID NO: 64314 - DNA, 601 bp, Human
tcactgtgttgcccaggctggtctcaaactcctggcctcaagcaattctcatgccttggcctcccaaagcattgtgattgcaggcatgatccagccttgctaattttaaacagtaggaggcatttaggattggagtcgaggtgggttaggttggcctctggacggctgtgaggggacagcctttctgggcctcagtttcctcttctgcaaggtgaagctcctgcgtggggagttgtaagggggaataagacctagcacgtcaggctgtgagcacagaccggaggggatgacagatggcaaygattgctgtatgcacctcgcccgaaaatctaagccttcattcatgcagcactccaatgctccttggcctccaaaaatgcttcctgttcccggcttgtgacatctttctttggttgcgtatgttctcccaagtgattttctctttaacagcaattatgtgagtgtcactttattctcacacaaagaatcttgatgttctttattttatttaatcttcacgatactcctctgaggtgtggattttgttattccctccctcttataactgaggaatgaaagtgcaacttggagttcagggact

SEQ ID NO: 64315 - DNA, 601 bp, Human
ttctttttttttttttttttcttgagacaggttctcgctctgtcccccaggccggagtgcagtagcgtgatctcaactcactgcaacctccaccttgtgggtttaagcaatcctcctgcctcagcctcccgagtagctgggattatagacacacaccaccatgcctggctaatttttgtatttttagtagagatgggttttcaccatgttgtctaggctggtcttaaactcttgatctcaagtgatctacccacctcggcctcccaaagtgctgggattacaggcgtgagccaccacaccwggcctttcttcatatttttaaagtaaattcccttttattagtttctcttttctccttctggacttcctgccatccaatattggacccctaatttattatctttttgcctattgttcatctctttgtcctttttcttttttcttttttttttgagatggaatgtttctctgtccccaggcccggagtgcagtggcacaatctcggctcactgcagcctccgcctcctgggttcaagcggttctcgtgcctcagcctcctgaatagctggactacaggtgtgcaccaccacacccagctaat

SEQ ID NO: 64316 - DNA, 601 bp, Human
cacaccaccatgcctggctaatttttgtatttttagtagagatgggttttcaccatgttgtctaggctggtcttaaactcttgatctcaagtgatctacccacctcggcctcccaaagtgctgggattacaggcgtgagccaccacaccaggcctttcttcatatttttaaagtaaattcccttttattagtttctcttttctccttctggacttcctgccatccaatattggacccctaatttattatctttttgcctattgttcatctctttgtcctttttcttttttcttttttttttgagatggaatgtttctctgtccccaggcccggagtgcagtggcacaatctcggctcactgcagcctccgcctcctgggttcaagcggttctcgtgcctcagcctcctgaatagctggactacaggtgtgcaccaccacacccagctaatgttttgtatttttagtagagacggggtttcaccatgttggccaggctggtcttgaactcctgacctcatgtgatccacccgcctcagcctcccaaagtgttggggttgtatacgtgaaccactgcacccggcctcttttgtttttctttaa

SEQ ID NO: 64317 - DNA, 601 bp, Human
ttcctgccatccaatattggacccctaatttattatctttttgcctattgttcatctctttgtcctttttcttttttcttttttttttgagatggaatgtttctctgtccccaggcccggagtgcagtggcacaatctcggctcactgcagcctccgcctcctgggttcaagcggttctcgtgcctcagcctcctgaatagctggactacaggtgtgcaccaccacacccagctaatgttttgtatttttagtagagacggggtttcaccatgttggccaggctggtcttgaactcctgayctcatgtgatccacccgcctcagcctcccaaagtgttggggttgtatacgtgaaccactgcacccggcctcttttgtttttctttaagattttctgcttcctttattacctgtttcctcctgttgatttgcttagatctcgccttaaatgctacaagcctttctcagaaatgtgtgggaacatttgactggttggttttttaaattttttaaaatttagtttttgacacagggtttcactctgtcaatcaaactggagtatagtggtgcagtcttagctcactgcagccttggacctcct

SEQ ID NO: 64318 - DNA, 601 bp, Human
aatttctctgtcacccctctccttggggcaagggacacctggcacccctctggtaagtttgcttaagagagtaaacctcagggcagctgctagatgctggtaagaacctggggtttccattttccatacagacttccaagcagtctccctgttatcagcccccatccccagattccatgctgtgcctaattcctgaaccttcctggggttctctggggcaaacggagaacttgctccacccccacctccctgcatttcagtgtcacccgcttcctccccatgagatcgttgaccgctcctktacttgcctctgtctttacctgttgtgatttggggtgacagttggagctctccctgcatccaggttggagaacgtgcttgtacttctcattcttggtgtttggcatgacttttgagaggagtaggagaaaaatgtcatggctctgccatcttgaagtcactttgatcctcaaaagtacttcatactctttgtagtgacctagtggaggtgggtcatttaccccagtgtacagaggggtccaagacaggcctgctgatgacataggacctcagttaaagaggttttgttttccttttattt

SEQ ID NO: 64319 - DNA, 601 bp, Human
tggccaacatggtgaaatcccgtctctactaaagatacaaaaaattagctgggcatggtggcacgcacctataatcccagctacttgggatggtggggtagaattccaaggtcagtgacacactggcaggacacactgggggcctcacaaaggaggggctcagcaggagagcccacccttcactcctgcctctggctcttctccgcaaagcccaggcatttctctcttttttttttggaactgtctttttgagatagggtctcactgcagcctggacctcctgggctcaagcaatcctccygtctcagcttcccgagtagctgggactacaggcacgtacccatcatgcccgactcattttaacatttttgtagagatgaggtctctctaagttgtccaggctagtctcaagctcctgggctcaagcagtcctcccacggtggcctcccaaagtgctgagattacaggtgtgagctaccacacctggcaaaagttcttatttttactactctggttgaatcacaagtattttctgtttggtcatttgtaaaatgcagctattctgggtatcccacaggagtgctgtaaggacaggactgaa

SEQ ID NO: 64320 - DNA, 601 bp, Human
aaacctcttttcttggctgggcacggtggctcgcacctgtaatcccagcactttgggaggctgaggagggtggatcatctgagatcaggagttcgagaccagcctggccaacatggcaaaaccccgggtctactaaaaatacaaaaattagctgggtgtggtggtgggtgcctataatcccagctactcttttgggaggcttaggtaggagaatcgcttgaacccaggaggcggaggttgcagtgagccgaaattgggccactgcactccagcctcggagacagagtgagactccatctcaaaaaaaaaaaacaaaaaaacaaaaaaaaacttattttctttataaattacccaacctcaggtatttctttatagcaatgaaagaatggcctcatataccaagcattcacccattgttgacctggccctctgtcccctctctccccaggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggaca

SEQ ID NO: 64321 - DNA, 601 bp, Human
gtggcctgagcctcatccgctgagagctggccaacccctcatcgcctccttcccgcagcgctcacccttcatgttgcgcatgtgtctgtaggagctcccagcgcacagcttgaatgtcgctagcagcattgtttcctggcaaatgtggcagtggtggggtcgctgccgctgctgctgccgccgctgctgctgcctcttctctcaagggtggttcttcgtccttcctgagcccctcaagcttcgcctctgagtcccgcagctgcagcctggacctggtgttctgcgtcttaaatgtcccccrctgaaggctgtgcatcatcatcaggagataaaaacgccatcactcactgtgcaaaggaaggggtcaaggatagagcgattgcctcacactgctgctttggccgtttgtggggagcttggggcgggggagggtgcaggggagagtagggaggacagggccaggcgagggatggaggggagagaagcaggggcagcttagatgaaggcacacagtggttttcaagactttaaagtgcagatttctagcccttgtcttcagaaactccaggctcagctgatctggaattgaggctcagaaacc

SEQ ID NO: 64322 - DNA, 601 bp, Human
atctgattgcatgaatctgtgcttctgtgagtctgtgtgcttgcatgcataagctactctgtgtgcccctggattctgggccagggaagccctgtccatctagtgaggacgacaacaccactgccagctgcagatctaagcatggcttctcgctctaaaggtagctaattcaatccagtgtaattggaaagatcgtgcctagattgacttgtgtacccttcagtggcagcaggggattgattcaaatgaccttggatgcgaatcagctctacaaaagtggcctcttgtagctggtttctgycccttcctggctattcaatgataaccagtcttccgtcttatctctttaccttgccctcctgtcttactcccctatctctcttctccgtctttttttgcctgtgggagtcaagtctaatatttactctgccactgtgggcaagactttcctgtgtacccctgctacaagacttgtccagctctgaaggaaggcaaagtcaggaatagttcaagaaagatggccaggcatggtggtgcacgcctgtggtcccagccactcaggaggctgaggcaggagaattgcttgaacccaggaggcaga

SEQ ID NO: 64323 - DNA, 601 bp, Human
cctgacagtaccttgggcatccagtctgagatcaggcttagctgaaaaagctgcaggagtatgaagttcggctgtaatttgatcatcatttttgggaataggcattttgaggtttgtcttgagaattcttacttgagcgctttcattatcttatagggaggcaaacttggtcgatgtaagcggtggcttggagacagaatcatctaatggaaaagatacactagtaagtatttttagttgtttgcaagacaaaatagggtttgttttagttatttcttcttcttcttttttttttttttttgttgcgacggagccttgctctgtcgcccaggctggaatgcagtggcgcgatctcggctcactgcaacctcctccccccgggttccagcgattctcctgcctcagcctcccgagtatctgggattacaggcatctgccaacacacctggcttcttttttttgtctttttagtagagacggggtttcaccatgttggccaggctggtctcgaactcctaacctcagttgattctcccgcctcagcctcccagagtgttgggattacaggcgtgagccaccgcgcccggccttgtttttacat

SEQ ID NO: 64324 - DNA, 601 bp, Human
acgtggcctctttttagtttattttttccaaaattattttgaaaagtttcaaggtggaatgtagtgacaccatcacggctcaccgaagacttgacctcctgggctcaggtgatcctcccacctcagcctctcaagtagctgggactacaggtgcacaccaccacacccagctagtttttatggtttttttagagacagggtttcgccacgttgcccaggcaggtagaactcccgtactcaagtgatccgtccgcctcagcctcccaaggtgttgggattacaggtgtgagccactgcaccyggcccatttcttcttagatttaacagttaacattttgctacatttgttttatgtccccatatatctgtttttcccttaagctatatgaggctacattgtgggtacactttacccaatattctgttatacaaccacagtgccataatcataataaaaaaatttaacattggtgcagtactactaatttacagttcatatttgtagtttctcaggattatttttgtgttaataatatcctcctctatagcttctttctccatccaggatctggtcaggatcacccattacatttagttgtaa

SEQ ID NO: 64325 - DNA, 601 bp, Human
catttggttaaggtgattctgctagctttctccactgtaaaaaactaccgtctttcccttatacttaacaaatgtcttaggcaaaaatacatcgagtctatctatgcaaatatcttgtttgtttttaaacttatgttcactaattttagcacccatcagtggatattgtctgcaacaattatgactgtgttgtatgatgattttcgatttcctctttcccttttctgttaattgattatttatatcagtatggactcatatatatttactttatttcagggagtataatccaatactttgrttattttgttgtttaaattattccagctttggcaagtaggagcttcttcaagaagttggttcttgtgttctttcgataagccgtgtctttttttaaaaaaaaaatttctttactttgaggcatcaaaaggtgttcctggccaatcttatattttctgtgccccaggcctacttctttcaccgagccctggttcctttgattggagcatgttgtttaggaataacatctaggtgctcacttccatatatcacatataccaaaattagaatgataaagagaagatgcatggcccctgtgcaa

SEQ ID NO: 64326 - DNA, 601 bp, Human
taaaaatgcggctattggggccaggcacagtggctcacgcctgtaatcccagcactttgggaggctgaggcgggtggatcacctgaggtcgagagttcaagaccagcctgaccatcatgaagaaaccccttctctgctaaaaatacaaaattgcgggcctggtggtaatcccagctactcgggaggctaagacaggagaatctcttcaacctgggaggcggaggttgcagtgagccgagatcgcgccattgcactccagcctgggcgacaagagtgaaactccatctcaaaaaaaaaaaaatgcagatattttcttttataaccaaaataattccttgctatcatccaaattcagttcataatcagatttccttgattgtcttaaataccggttcatctcctgagatatttattaattacaaaaggaaaattgtcatttagcagtggagaaacctggcaggcatcatcttaatcaagtgaccagggtgaacatcactattttgatagcatatatgatgcactgaggggcacaacattacctcattggagttcctgagtaagaataacaataaccttgaccttaaaatgaggaaacgccagg

SEQ ID NO: 64327 - DNA, 601 bp, Human
taagtaacctaacaactttctcttttttgttgctttctcattccttgccagtatcttatgctgagatttttaaactcctcaactaatatttcaaacacctgacctgatatttgtgatttttaaattgttttattggactaatgtttttgtggcaattgtccccaagaacctcaaataagttgcaggccttcttttaatctctgtcaccgcagctccccagttaaagatctcagatgaccggctgactgtggttggagagaagggctactctatggtgagggcctctcatggagtacggaarggtgcctggtattttgaaatcactgtggatgagatgccaccagataccgctgccagactgggttggtcccagcccctaggtaagctggggccttaatatggacatcacagcagatagagaggatagaccatctggccaagggctaaggcttcaaggctgttgggtttaccagattgtgggcatagaattcagttcctgagggttgagctggtttgctattcccgggatatttttgtaattctttgcttgtgagaaagtttttaagcaattttacaaaattgaccaaaaaacataaaaaga

SEQ ID NO: 64328 - DNA, 601 bp, Human
atgtttatctggtgttttattttgaaacagagtctcattctgtcgcccaggctggagtgcagtggtacgcagtctcggcatactgcagcctctgcctcccaggttcaagcaattctcctgcttcagcctcctgagcagccaggattacaggcgtgcaccaccacgcccagctaatttttatatttttagtagagacggggttgcgccatgttggccaggctgatctcaaattcctggcctcgtgatctgcctgcctcagcctcccaaaatgctgggattacaagcgtgagccactgcgctyggccacatgtgtgtgttttaattttgaagacaatatatgcctagattctctggaaggataccaggacactggaacagtgattacttttggcaggggaaactgggtataagggacatagaaagagagactctcgttttatatgcttgtatatcttgggaattcttcttttctaaccatgtttaatacatatatatgttaagaaattgaaattttttaaattaatgtcatatatttctctggaagtgaatagttaaatagactcttaagaaccagtaagaaagaggtgacccagagaccacc

SEQ ID NO: 64329 - DNA, 601 bp, Human
catactgcagcctctgcctcccaggttcaagcaattctcctgcttcagcctcctgagcagccaggattacaggcgtgcaccaccacgcccagctaatttttatatttttagtagagacggggttgcgccatgttggccaggctgatctcaaattcctggcctcgtgatctgcctgcctcagcctcccaaaatgctgggattacaagcgtgagccactgcgctcggccacatgtgtgtgttttaattttgaagacaatatatgcctagattctctggaaggataccaggacactggaacagwgattacttttggcaggggaaactgggtataagggacatagaaagagagactctcgttttatatgcttgtatatcttgggaattcttcttttctaaccatgtttaatacatatatatgttaagaaattgaaattttttaaattaatgtcatatatttctctggaagtgaatagttaaatagactcttaagaaccagtaagaaagaggtgacccagagaccacctgtgggaacagatgggaaactaggacggggaagaaggtgaccttcaaaatattttcatagaataagggattgtaggct

SEQ ID NO: 64330 - DNA, 601 bp, Human
gggtgggggagtgctgggggagaaaggcaccgtggtaatgtttttcaaaagggttgatagcttctgggctcagaacaagaaacaggcttcacaccccaccccccccccaccaccaccaaaaaagtgtctggctgcctcatagggggtgtgtgttctatatgaacccccatctacaaggtccataaaattcctccgcaaacatgggtcgtagcctcacttttctcccaaccccaaacataacggtaggggaagcgaggtgcagaggggtctgggccagagaagcatacgcatcgctgccgartgaaccacaccggacaaaaaccctcatcccttcccccacctctaggaaccagattgggaccgaacggtccttccgcccccatcccacacctcggcttaacgaccgtgggttgtcctcccgttccccaaacttccgaccctttcagagaccgtccaagtcataagatcaccccttctggaaaggggagtcgtttttcgctctcagctcaagcagattcagccatttggtgacgacacctccttaaaacctattccaagagaagctaacctagccctccacgtcctccgcagttcatctccc

SEQ ID NO: 64331 - DNA, 601 bp, Human
aaaaatacctcgaaaatgagcatttctgcaggcatgtttggaaaagcaggcagtgaagtacgcagtccaagtggctctcaatctggatgaacctcattaaaaagctgacactcagctatgactaagagtaaatgcaacagatatttcaagcagctcgtcactgatgcagttcataaccctcccagctggagtcaggccccagcagcctcccggtccccaaacaccctgcactcggagggtcggggcagccccggagcttctcctaacccactgggggtaggatatgtaaacaagtcattarggaggcaggccatcggcaaagacggccggcaatagcagaggctgctgaacctcggtcaccgagaggaaggtggatgacccgggcgtgggggtgattacccagaccaaggcgcgtcccacggggccctgctacttcgcttttaaacaagcctcagggaggaaaccgggagcccgggccaagggaggaaaatggccactttctgctaaacagtctcaaggctagatagtattccaaaaaaagcgctggtccggaggtgcaaagggtagggcacatctgcggaggaaacagtcaccttaatta

SEQ ID NO: 64332 - DNA, 601 bp, Human
ttctgtttaaagtagatgcaaccttaggaggaaaaacaaatatcctagcccaagtctgacatttcatcctctctggaaacaccagaatcttctctaaagctctgcatctgggctcccactagtccctggtgcgttcaggccttttacaaagctctggggaagacaaatgtaagacacaaatttcccaggaggaaattaaactatcaagtgatgtgaggccctttcagaataagacatttgaatcaattctaactccttttcctccagcagcaacaggctcaaactttgctaggatgttctrtaactaacagccattttgacgaaagacactttagaaacgaaggcaagaaaaaagcctttgtagaagccggctgctaaacccccaagttcataccagcaaatctctcattttaggagtcttgtttcaggtcaatactgaaaacaaagagcacaccactaaaagcaaaacccatggattttccttggtctctaaggcttgaatctgcctacccagtgttcaattcaattttcttgccctctggagtccaccaggaataaagctagcccagcctgagggatgcaccgatgtatctaatcctct

SEQ ID NO: 64333 - DNA, 601 bp, Human
tttttctttgagatggagtcttgctctgtcactcaggctggagttgcagtggcgcaatcttggctcaaccaccgcctcccgggttcaaacgattctcctgcctcccaagtagctgggattacagacatgagccaccaagcccggctaatttttttatttttagtagaaatagggtttcaccatgttggccaggctggtcttgaactcctgacctcaggtgatccacctgccttggcctcccaaagggctgggattacaggcatgagccactgtgcctggctttttttttttttttttttttaaacagggtcttcctctgtcccccaggctggaatgcagtggtgcaatcacagcttattgcagcctctgcctcctaggctcaagtgatcctcccacctcagcctcctgaatagccgggactaccagtaagcacgagcatactcatctaatttgtgtattttttggtagacacagggtctcaccatgttgtccaggctcatctccatctcatgggctcaagcaatccgcctgccttggcctcccaaagtgctgggattacaggcatgagccactgtgaccagctgctcatgttctatttcta

SEQ ID NO: 64334 - DNA, 601 bp, Human
atttggtaattggcagcagaaggacaggaacttccaacctttccaaaggcatttctcactctccatcttcatgtcttatattctagacctgtggcccacacagtggccactgcacacttgaaatgtggctggtgctaacggatatgctataagtaaaaagtatacaccgcatcttaaaaacttgttatgaaaaaaatgtaaagtatctcatcaataatttctatattgattacatgttcaaatgataatattttggaaatatagttacattaaataaaatctaaacaaacaagttaattaraaaacaaatattggccaggcgcggtggctcacgcctgtaatcccagcactttgggaggctgaggtgggcaaatcacgaggtcaagaggtcgacaccatcctggccaacatggtgaaaccccgtctctactaaaagtacaaaaattagctgcgtgcagtggcgcgcgcctgtagtcccagctactcaggaggctgaggcaggagaattgcttgaacccgggaggcagaggttgcagtgagccgagattgcgccactgcactccagcctggcaacaaagtgagactccgtctcaaaaaaaaa

SEQ ID NO: 64335 - DNA, 601 bp, Human
actcctgggctcaggagatccacctacagtggcctcccaaagtgctgggattacaggcatgagccaccacacccagcctgggtctttttattcttgtccgctggagacagtatgaattcacacccttccacttatgatcttgccaccctgggatagtcacttaaccgttctaagcctcggtttcccacctagaggaagccacatcacaggtgattatgaggctcaaatgggtggtgtgggtgactgtgcccattctctcctctctaaagtaccaaccaaatgtaaagaattatgcatttgkatttcagatataatattaagatatttataattctctttgtgtagtgctttgagtcactccttaatagcactctcaggagatttggtaattggcagcagaaggacaggaacttccaacctttccaaaggcatttctcactctccatcttcatgtcttatattctagacctgtggcccacacagtggccactgcacacttgaaatgtggctggtgctaacggatatgctataagtaaaaagtatacaccgcatcttaaaaacttgttatgaaaaaaatgtaaagtatctcatcaataatttc

SEQ ID NO: 64336 - DNA, 601 bp, Human
caggcctgtcacccagaaacgcacacctgaccaagaaaacccaggtcccttgctaagtgtcagaatactgaacaagttctcaggttccaatgggaaagagtggtgtcatgttgagatggttaagcttgcttcgacttggccactctgtccccagaaaagcctgccgcctcctcccaggtgtgggctggctgcagaccgccctctctcagctccctggtcaatgcacttcaaattcatctgccagcttccctcttgttctttcccaaaaaaggtacaaaaagtctcttcctctcctaccccyctggccctcaagtttgacatctgtaaaacaaggatgttaagaaaacctggcctcctggcaccaactcctggaataagaagtcagcatacaccccatgccacccgcctgcaaaaaacacagtgacacaggccactagtccaacatgctgtctgggaccctgccacctcctgcttcacctcagtttctcattctactaattaatgaatttttccaatcccttagaaacaacttccttccttcactgcttgacagatagatgtaacctgcagccttgcaggtgtacacagcagcttcctccaa

SEQ ID NO: 64337 - DNA, 601 bp, Human
aactgaggctcaaagaggttaagtactttactcaaggaaatgtagctagcatgtaatagtgcctcaaggtttttggatattagagaacagggtgggaggaagtaaataagggattgatcaagcctgactccatctgatgcaaactcaatttatccaaaccaagtagataagggtaaatccaaggtaactctggtaacaaaagaggcttgatttgcagttccattggtcaaagatagacccttgtgccagggcatgttggctcatacctacaatcccgggactttgggaggctgaggcgggmgtatcacctgaggtggggagttgagaccagactggccaacatggtgaaattcctcgtctactaaaaatacaaaaattagctgggtgtggtggtgcacgcctgtaatcccagctactcaggaggctaacgcatgagaattgcttgaatttgggaggtggaggttgcagtgagccgagattgcatcactgcactccagcctgggtgacggagtgagactctgtctcaaaactaactaactaaaagaaagacccttggaagcagaccacagatgggccatctaggacactgcatggggcacat

SEQ ID NO: 64338 - DNA, 601 bp, Human
ctacaacatcccctgtagtctgacccaagttctacacgcaaattctaaggtcattctctccccattgcaccaccagctgcattttatacatcacctatgttaaagtgtgacactagggtcctcatcagatattctttcctcagaaagagaaaagcataaattaccccccacaaacatgtcatctcaggtaaatggatgtcaccagccttcatgaccccaacctctgatgaagtcagttatgtttataaccagaccagaaccaacccaggtatcttgagagtttctcctacaggaagggagktctttgctccacttgggaaggagccttccctgttgaccacatcacctgcaaccatatcacctccctcccagcccatcctgttcccaaggcccaggagtccaggctgcccccagccagcaccttaccttgttcaggcaaggtcggggacggcctagcggtgcagagtgtggctgtgaccagcacagcccagaagaggaggcacttccagctccacatcccagttctgcagttagaggttggtgacaaggctccacatctccatggatactccacagtgagctcgatcctccttttcaaact

SEQ ID NO: 64339 - DNA, 601 bp, Human
tgcttcatctggattaccccacttaaccctttattatttatccctgttttacagatgagcaaactgtgacgtatggtgtttgagtagtttgttgaagtaaataatgcagctatcaagtggcagagcaggatgcaaacacaggtgcacctcactctttcctcccagccatccacactgagctgccaaattaactttctgaaagctgatagtgtcactacttgctaaaaacttttcaagtttcccagcatctacccatttaagtctagttttcttttcttgctttttttttttttttttttttagacagagtttcactctgtcacccaggctgaagtgaagcggtgtgatcatggctcactgcaacctctacctcccaggttcaagtgatcctcccacctcagcctccctaatagttgggactacaagcatgtgccaccacacctggctaatttttctattttttgtagacacagggtctcatcatgttgcccaggctggtctcaaacttcttggctcaagcaatcctcctgcctcggcttcccaaaatgttgagattaccagcataatccacgcctggcctaagtatagttttctttttctt

SEQ ID NO: 64340 - DNA, 601 bp, Human
tctgtctcttaaaaccaaccaacaaacaaacaaacaaacccagctgatcttaaactcctgggctcaagtgatcctcctgcctctgcctcccacagtactgggattataggtgggagccaatgtgcctttgaaaattaagttgatttttaaaaaatggtcatttaatgtcagtcttcctgggtacatggctcctaagagccccatccacctctcttactccctttcttctgttcacagggccggtactttgtcctcatcaagatcttcagcccccaggttccagcctccaccctgccccagmagcttccgtgaagccccctcctctactagcacccccaccctggccctaaagttccttatactcatcccgtcgggctggctcacaagcagccaggcccgagatccacttctcccttcttgggctgcaaaaaaaagaaagtactttaggctccattataaattcacattctcaaacctcaactagctccttgctactcttccactcctttatcgctgtctacaattggcggattcaaatctaaactcccctcaaacctcccactctgactcactccctttacactctcatctcagtctccag

SEQ ID NO: 64341 - DNA, 601 bp, Human
agccagatctccccttagaatgtcctgggcacagcagttctctgttctgtcacaaagctcatgagagacaggctatgtgaaagcaccacactcacactgagacgggggcttactccaccaaacagagacctggggcttgttctccaagtgcaggggctttccgttgctgtgtcccatgaaacaacatgctcctcgccatgtgccgtctcccctggaggcccagggaaagggacccacaacggccattgactgctcatggcctacggaccaggcaatgtcctatgagctctgcagacatgcktatttgatattcacaatgaccttatgagcacacattcattatcaatatattttataaaagggcacaaagaggaacttccccaagagccaatagtcagtaaggtgtggagccaaaatcaaaaccagggcagtccaaggaaaatgtgtgcccacccaggcttgcacatgaaggttcacagcagtcttattacaatagcccaaactgttatacctaaattaagttggtttggccaggtgtggtggctcacacctatagtcccagcactttgggaagccgaggtgggcagatcacttgaggtca

SEQ ID NO: 64342 - DNA, 601 bp, Human
aaaaaaaacacagaaaaaagaaaaagagaaaaaatggggtaattaatttggagataggggaaggcttcaaaagggaggtggcccttaagttaagctttaatctaaacccaagctaaaccttaaactaagatttgagcaggaattataaaaagtgaaaaggaagaaaaggacaggaacagatatttccagctaagggactaggataaaacaatgtataaagtatacattgtatttacggaaaaaggaagagacttgcttgactagatgaatgaataaatgaatgagtgaaaaaaaatcagtsaatgaatggaccattagccagaagctagtttttgatcctagagaaaagtgaggaagggctaagctctgaattcaatgttcactgttggttaactcctagaaacctccgtgttgctgtttctgacctctttctctgcccaacctcgtaaccactaagtctactctttgcggaactccttgaccctctcacccacttcaggctccctgtgtctccatgtccagggcctgggaacacaaatggcacagcccccaccccaccttttacacaacccatcccgggaggctcagccacgccacagca

SEQ ID NO: 64343 - DNA, 601 bp, Human
gaggcagaagaatcgctagcacctgggaggcagaggttgcagtgagccgagatcgcgccactgcactccagcctggatgactaagcgagactacatctcaaaagggcatggtggctcatgcctgtaatcctaacactttaggaggctgaggccagaggatcgcttgatcccaggaggtcgaggctgcagtgagccatgatcactccactgcactctagcctgggcaacagagcgagactaggtctcaggagaaaaaaaaaacacagaaaaaagaaaaagagaaaaaatggggtaattaatwtggagataggggaaggcttcaaaagggaggtggcccttaagttaagctttaatctaaacccaagctaaaccttaaactaagatttgagcaggaattataaaaagtgaaaaggaagaaaaggacaggaacagatatttccagctaagggactaggataaaacaatgtataaagtatacattgtatttacggaaaaaggaagagacttgcttgactagatgaatgaataaatgaatgagtgaaaaaaaatcagtcaatgaatggaccattagccagaagctagtttttgatcctagagaaaa

SEQ ID NO: 64344 - DNA, 601 bp, Human
ccctcaaacctcagtttactcatctgattatggtcataaaacctatgcctatggaatcattgtaaaaatgggaaaatgtcaagcatgcagagtgtggagatgatatttattattattacttttgagacagagcgttgctctgtcgcccaggatggagtgcagtggtgcaatctcagctcactgcaacctccacctcctgggttcaagctattctcctgcctcagcctcctgagtagctgggactacaggtggccgccatcatgaccggctaatttttgtatttttagtagagaagggtttygccatgttaccaaggctggtctcaaactcctgaccttaagtgatctgcctgcctcggcctcccaaagtgctgggattataggtgtgagcaactgcacccggctggtatttattattatattttaaaagacatttactggtataatcttttgggggatatttggtatagtgatgtaatagtgataaaatcaaaacttaaaacaaatggaactatccttggatacatggacagattttatttgtaagaatatgttctattgaatgcaaactattgaaaataacctaaatgcccaaatgtaga

SEQ ID NO: 64345 - DNA, 601 bp, Human
cctcccccatgcctccaaggcaaactgactcagccctctcccacctttttttttttttttttttttttaaagaggaagtcttgctatgtagccaggctgcagtgcagtggcacaatctcggctcattgcaacctctgactccctggttcaagcgattctcccgcctcagcctcccgagtacttgggattacaggcgcccgccaccacacccggctagttttttgtattttagtagaaacggggtttcaccgtgttgcccaggctggtctcgaactcctgagctcaggcaatcagcccaccwtggcccccaaaagtgctaggattacaggtgtgacccaccacaccaggcctaggtgatcctcctaccttagcctcccgagtagctgggattacaggcgcccaccaccacgcccaggtaattttttgtattttttgtagagatggggtttatgccatgttgcccaagcgggtcttctgagctcactctatctgcccacctcggcctcccaaagtgctgggattacaggtgtgagccactgcgcctggcccttcttcattatttataaaaaacactagtagcctcaaaaaaatgttaatgtcc

SEQ ID NO: 64346 - DNA, 601 bp, Human
atgaaaggctcaactcatctattatgacttgaacccaagtctatctgtgtttgcaaaggctgtgctgttgcacctagacctccacccagaaacatgttttggggctgacattttaatagaaacatagagaggaaaacatactatttcggagacattaagactgtgactagcaactgccccggataccctgggaagcttctaaggccatattgggtgggtcctattttgggaaaagaagttggggcatctgcacgataatagaaagctcccaggatctggtaaggaccacttaggtggactstaagttggggggatctaaacactcaggttggaccggggcagggggagtgtcttctcctgcctttattataatataaatcacatcctaaactcaaagcaaagtccaactcgtcatcacctgtgacagtgcataagaaagaacatcttccaccaagttgttaaagtggtgtgtgtgtgtgtgtgtgtgtgtgtgtgtgtgcaggggtcccactgctggaggggagctcagactctcccaccactggcccggagcccaggcctcccagccatgtgtctgcagctgcgacctgtcatgcacttc

SEQ ID NO: 64347 - DNA, 601 bp, Human
attgctctggaaagagggaagttcattcactcatccaagaagagcaaaggtagatgccctgcggctatggaggagggccgtccaagctcacagttcctagaagtttgtgtcaccatttcacatttagcaccagaatccagccttggcagattcagggaaggaagccaaggacacagctggtggtgaagacagaaactcctgtgtgacaactgccccctaggacacagtttagggtcaattaacatttcctgaacaacttgcaaatggaaagagccatccccaatgaagactgaaaaatgaraggctcaactcatctattatgacttgaacccaagtctatctgtgtttgcaaaggctgtgctgttgcacctagacctccacccagaaacatgttttggggctgacattttaatagaaacatagagaggaaaacatactatttcggagacattaagactgtgactagcaactgccccggataccctgggaagcttctaaggccatattgggtgggtcctattttgggaaaagaagttggggcatctgcacgataatagaaagctcccaggatctggtaaggaccacttaggtggactgtaag

SEQ ID NO: 64348 - DNA, 601 bp, Human
ttactaaaggtatttcctgaggagaaaggccgagcacacaggcccaggcagcccggctaatcctgacaggaagccatggccattcagcagcccaggggcttggggcccagagttttgttttgtttttattaaaaaaagatttcggccttttgtgcgtcccacctcgtcactgtaatttagtgccgagccgcctgcactagccaaagccacagccaggaccctgcacccgccccgagaccccccaaaaacagatccccccgagctgggcagcaagacacgtgtagaatcccacttgggaatygcaggcgccaagagctattggcctggagagttgtgtgtggatcttaaaagacagagggactctgggtgtcgtaaaggataacgcagcctgagaactgagtttggggctcaagcttctatgcacggattcatctgatgcctccttcaaatctgtacttttttcccctagggattttgccacctttctccaatcagcaccagtgtcccccacctcctccctacctctcacaatggggagttcactacctcactgggagaagggctgtaattaagtgattaacaaaggaatgcacccaagagt

SEQ ID NO: 64349 - DNA, 601 bp, Human
tcaatttgtaagttgagggatagaacagagccaccaaagatatcccagggaacacacctctctgcagagactatgaatgcagggcattcatgccacatggacaaacacacctgaaaatgtattttgaaataccgcttcaccagcccggtcccacagcagccactctggtctggaagttatccatccccaaaccccacaacttaacaggaacccagtgaagaataacaacacatttgcatagcactttgtaatttaccatgtgccttcccatatattatctagggatccataaacatctgartaaacagcaatactactactggccaatatttccagcacgctcactatatcccataggctgcacaaagcttttaacacagaccctcccatttcatcctcataggaaacttatgaggttgatcctactatgatttctatcctatggatgcggaggcttactacataccagcatagttctcagcatgtgttaacttagaatcttgtgaagtatttaagagttagaattattatcttcgggcccagtgcagtggctaatgcctgtaatcctagcactttgggaggccgaagtgggtggatcacc

SEQ ID NO: 64350 - DNA, 601 bp, Human
gacaaatggagaatgtcaggaccaagtacaggcaggtctagcacaggctctgacgtcatgaaacataaagaaaagtatcagcagtgagagcagaggttggacaaaatgacggggaagggaaaagagaggatttagatgagaagtgaaatgtctggggggaacagaagagaatgaagtgcttacaggcatggctgtaccctggtctgaggggcagtgggagatgaggccaggctgtacagctggccaggaacagaaggttcatgggagaaaacagtaacaaataatgatttcaatttgtaakttgagggatagaacagagccaccaaagatatcccagggaacacacctctctgcagagactatgaatgcagggcattcatgccacatggacaaacacacctgaaaatgtattttgaaataccgcttcaccagcccggtcccacagcagccactctggtctggaagttatccatccccaaaccccacaacttaacaggaacccagtgaagaataacaacacatttgcatagcactttgtaatttaccatgtgccttcccatatattatctagggatccataaacatctgagtaaacagcaat

SEQ ID NO: 64351 - DNA, 601 bp, Human
ctttttttttttttttttataacaaccgctaatcagtttattaaaatagttgactttgagcatctgcaatggtgacttccacctcaattcctggctcaacactgatggaagtcaactgcttaacaatctcagaaggactgtgcaagtcagtgggtagcttgtggattctcatctggaaacgatcccatgtctctgaaccttcaccacaaggagattttcttatagtgattctcaaagtcttggcaggcattcaaactggtcccttcacttagacattcttttcctttcctcctctgaatcmagtcagcacacaccttctccagggattttacgctgcggatcattagagggattcgaatttggtgaatggtcacctccagcttcacaggtgttttctggtatctttaaaagccttggtgcagtgcggcttcctggctgacttgttcggaacagcgatgagtgaggagcaggaatgggcagactgcaactctgcaccacttatgactgcatctttctcaaagagctgtattgcttctttttgtttgtttgtttttttgagacagaatttcactcttgttgcccaggctggagtgcaatggcg

SEQ ID NO: 64352 - DNA, 601 bp, Human
tccactctccctccccgtgccccatccttctctgtccctgggtgggagcactggacccaccggggtgtctgcacctcacaagatctgataccaccaagagcacctgtccctcccctgaccagtgcctcttcccgcacgcgttcaagaaggcccgtggcccggacacacctgagttcaccatcctgggctgttacccatctcctgagcacacccctctgcactcacgaggggaaatgaactttctatttccttttaggatgttcaaatgtactcctggcatcttccacctctcacctaccasccacatcccgcccacagccttggagaggacttttctcaccatttgttcaccctaagagactcagtggagcgactgccgctccccgatgcataaggctctgaaacagcatgttctccctcagcccctgctgtggctcacggctgccccagtggccacagggcccctgatttttttctgtccagctctcactactcactcttctgtctcagcctagctggtgacttctcctccagggcggtgctgactcccagtctgggttaggtgccctccccctcctggcacctgtcacactgaagggca

SEQ ID NO: 64353 - DNA, 601 bp, Human
atcatcatcctccgaggaggggagagcatctatgggaagaagaaggggcactgaggttcctcctagggacccctagatttcaccaaggctagtgcagttccagatgaacacggacaccctccccatggggatcccagtcccactgctcccttagtgatgatctcttggtgggatggaaactgtttaagaacagttcctgtgcgtgtttgcttccttccccgaagcactgcccccactgcctggaagccttcacactgggtggttccatcagggtcagctgttcctatttaacttaattccrtcctacattcaaaggcgctttctcaacttgtggtgccacctgggtgtgctggagccaggcaacctgtattcttctttggacggctgactatagggaaacccaggcaggtctagacacactgtggctagatgctatttccaaaggatgggctaaacaccccacagtcagaatttttctagcatgtgtctactaaggtttgggggctgccctccttaatcagagcagatagggcacccaccaccccagcagctgccaacacctctccccaataagtatttatttcttgtaagaacacgcttg

SEQ ID NO: 64354 - DNA, 601 bp, Human
cagaatctcctttttaccttttttttttttaaaggcagggtctcactctgtcacccatgctggagcacaagggtgtcatcatagctcactgcagcttcgaattcctgggctcaagtgatcttcccacctcagtagcctcagttaactcagctggtactacaagtacatgacactgcactaggctaatttttaaatttttttatagagacagggtctcactgtgttgcccaggctggtctcacactcctggcctcaagcaatcctccagccttggcctcctaaagtgatgggatcacaggcktgagtaatcccatcatgccacctggagctcataagccactgctcctggccacaatctccttcttagaccatatcatcataatcaagaagaacactggctgagagattctgtacccaatgatctctagggagtgagtttcagaactcctagaaggaaaaggttgcggtaatagctccaagaggctcaatgttcttcccagagtctcctgtgatgccctgaagttggcacaggtgtgcagttctgcattagcaaggtgtctgacctctctgagcctatgcgcctgtgctcctgtgcagggct

SEQ ID NO: 64355 - DNA, 601 bp, Human
gggacaccctctcttcaggccctaagccatcaggatcctcctccccaaggcagtcatcatatttacagtcacagtaagtcgctcatgctttaatggagaaccttctaattcagttgcacccccagacctcagcacaacctgctcctccttaaaaaaccagagtcactttgactcctgctattcaaagtgtggtccacgagcagtgctaccagcatcccctaggagcttgttagaaacgcggaatctcagatcttaccccaacctcttggatcagaatctcctttttaccttttttttttttaaaggcagggtctcactctgtcacccatgctggagcacaagggtgtcatcatagctcactgcagcttcgaattcctgggctcaagtgatcttcccacctcagtagcctcagttaactcagctggtactacaagtacatgacactgcactaggctaatttttaaatttttttatagagacagggtctcactgtgttgcccaggctggtctcacactcctggcctcaagcaatcctccagccttggcctcctaaagtgatgggatcacaggcgtgagtaatcccatcatgccacctggagct

SEQ ID NO: 64356 - DNA, 601 bp, Human
cctggcctatggccccttctcttaatcaccactcactcacaacttcagtctgaagtaccatttgtaacacagcaaaaccgtgtccccgtgagtcctcacatggatccacacaaagccaaggaacacacagaaggcagagagggaacccacagacaccaacacaataccaaaccaaaccagcctcccaggccgggtatttttccatggctctgggcactagaaatacagtagggtggcaaggacagtccagtactggcttccccgcctgccccagcagcttggggcctacatcaaatccccwgcacagggtcccatccatctccccattaccttttgccacaggtctggtgacagtgagccacgcagactggttagcttcaccaatataattggaaaccttacacacatactccccgctctgggcctctgtcacattgaacagggtcagcacctccgcatccgagctattaatccccgaatgctggaacaaaccaacgacacaccagtcagttgggcaaagctgagatgtggccacgcacgttgctcccgtgtaactttcaggcaggcccagggagcgaagggagatgttaagtgagattta

SEQ ID NO: 64357 - DNA, 601 bp, Human
ccacatggggctgggctcaaaccaggccagcccttacacaccaaacactgcactcaacactcacagacagtttcattttatcttcataacaattctacaacaggtattgttatactttattttcttttgagacagggccttgctctgtcgccccggctggggtgcagtggtgtgatcatggctcagtgcagcctcaaactcttgggctcaagctagcctcccacctcagcctcccgagtagctgggactatcggcacgcactaccacacccagctaattttttaattttttttttttttttaaagacggggtttcaatatattgcccaacctggtctcacactcctgagctcaagcaatcctcccgccttggccactgcacccagctgatattattattattttgtatttgaagaattttaagatgctaagtagctgcctgaggctacgcagaaagtggcagtgcacagatcggaccctgcatcagtctgaccccaaggccacctggctacactggtgctcctgactctgcagttcccagagagcctaagacaacacacagggcacacagggccagtgctcagtgcatccacaacgccacc

SEQ ID NO: 64358 - DNA, 601 bp, Human
gcgtctgcagcgatgcatgctcctaggtcctgcctcccagcacagcaagtccacatggggctgggctcaaaccaggccagcccttacacaccaaacactgcactcaacactcacagacagtttcattttatcttcataacaattctacaacaggtattgttatactttattttcttttgagacagggccttgctctgtcgccccggctggggtgcagtggtgtgatcatggctcagtgcagcctcaaactcttgggctcaagctagcctcccacctcagcctcccgagtagctgggactaycggcacgcactaccacacccagctaattttttaattttttttttttttttaaagacggggtttcaatatattgcccaacctggtctcacactcctgagctcaagcaatcctcccgccttggccactgcacccagctgatattattattattttgtatttgaagaattttaagatgctaagtagctgcctgaggctacgcagaaagtggcagtgcacagatcggaccctgcatcagtctgaccccaaggccacctggctacactggtgctcctgactctgcagttcccagagagcctaaga

SEQ ID NO: 64359 - DNA, 601 bp, Human
cttgtcggcactcacgttggttgtctttttatagtagtcgatgtggtgaatgtcccgtgcgaggccaaagtctgctatcttcatcacattgtcctctgtcaccaggacattcctggctgccaggtctcggtgtatgcactgaggaaggaggaagggagagcgggaggcggggaggtgagggagctggaaggctctgggcggccgccacccatgcaactagccgacttgtctcatagaacttctgccacactgctctgccccccgaacctttgctttccctcttctaacattctctgccagmtccaggcttctcatcacagcaagcgctcctcccttccttccccaaagactggccccttatgcctctgctgcgtctgcagcgatgcatgctcctaggtcctgcctcccagcacagcaagtccacatggggctgggctcaaaccaggccagcccttacacaccaaacactgcactcaacactcacagacagtttcattttatcttcataacaattctacaacaggtattgttatactttattttcttttgagacagggccttgctctgtcgccccggctggggtgcagtggtgtgatcatgg

SEQ ID NO: 64360 - DNA, 601 bp, Human
actccttgcttctcagatgaaaccaccagcacagggcggccttgtcggcactcacgttggttgtctttttatagtagtcgatgtggtgaatgtcccgtgcgaggccaaagtctgctatcttcatcacattgtcctctgtcaccaggacattcctggctgccaggtctcggtgtatgcactgaggaaggaggaagggagagcgggaggcggggaggtgagggagctggaaggctctgggcggccgccacccatgcaactagccgacttgtctcatagaacttctgccacactgctctgcccsccgaacctttgctttccctcttctaacattctctgccagctccaggcttctcatcacagcaagcgctcctcccttccttccccaaagactggccccttatgcctctgctgcgtctgcagcgatgcatgctcctaggtcctgcctcccagcacagcaagtccacatggggctgggctcaaaccaggccagcccttacacaccaaacactgcactcaacactcacagacagtttcattttatcttcataacaattctacaacaggtattgttatactttattttcttttgagacagggcctt

SEQ ID NO: 64361 - DNA, 601 bp, Human; identical to SEQ ID NO: 64330

SEQ ID NO: 64362 - DNA, 601 bp, Human; identical to SEQ ID NO: 64331

SEQ ID NO: 64363 - DNA, 601 bp, Human; identical to SEQ ID NO: 64332

SEQ ID NO: 64364 - DNA, 601 bp, Human; identical to SEQ ID NO: 64333

SEQ ID NO: 64365 - DNA, 601 bp, Human; identical to SEQ ID NO: 64334

SEQ ID NO: 64366 - DNA, 601 bp, Human; identical to SEQ ID NO: 64335

SEQ ID NO: 64367 - DNA, 601 bp, Human; identical to SEQ ID NO: 64336

SEQ ID NO: 64368 - DNA, 601 bp, Human; identical to SEQ ID NO: 64337

SEQ ID NO: 64369 - DNA, 601 bp, Human; identical to SEQ ID NO: 64338

SEQ ID NO: 64370 - DNA, 601 bp, Human; identical to SEQ ID NO: 64339

SEQ ID NO: 64371 - DNA, 601 bp, Human; identical to SEQ ID NO: 64340

SEQ ID NO: 64372 - DNA, 601 bp, Human; identical to SEQ ID NO: 64341

SEQ ID NO: 64373 - DNA, 601 bp, Human; identical to SEQ ID NO: 64342

SEQ ID NO: 64374 - DNA, 601 bp, Human; identical to SEQ ID NO: 64343

SEQ ID NO: 64375 - DNA, 601 bp, Human; identical to SEQ ID NO: 64344

SEQ ID NO: 64376 - DNA, 601 bp, Human; identical to SEQ ID NO: 64345

SEQ ID NO: 64377 - DNA, 601 bp, Human; identical to SEQ ID NO: 64346

SEQ ID NO: 64378 - DNA, 601 bp, Human; identical to SEQ ID NO: 64347

SEQ ID NO: 64379 - DNA, 601 bp, Human; identical to SEQ ID NO: 64348

SEQ ID NO: 64380 - DNA, 601 bp, Human; identical to SEQ ID NO: 64349

SEQ ID NO: 64381 - DNA, 601 bp, Human; identical to SEQ ID NO: 64350

SEQ ID NO: 64382 - DNA, 601 bp, Human; identical to SEQ ID NO: 64351

SEQ ID NO: 64383 - DNA, 601 bp, Human; identical to SEQ ID NO: 64352

SEQ ID NO: 64384 - DNA, 601 bp, Human; identical to SEQ ID NO: 64353

SEQ ID NO: 64385 - DNA, 601 bp, Human; identical to SEQ ID NO: 64354

SEQ ID NO: 64386 - DNA, 601 bp, Human; identical to SEQ ID NO: 64355

SEQ ID NO: 64387 - DNA, 601 bp, Human; identical to SEQ ID NO: 64356

SEQ ID NO: 64388 - DNA, 601 bp, Human; identical to SEQ ID NO: 64357

SEQ ID NO: 64389 - DNA, 601 bp, Human; identical to SEQ ID NO: 64358

SEQ ID NO: 64390 - DNA, 601 bp, Human; identical to SEQ ID NO: 64359

SEQ ID NO: 64391 - DNA, 601 bp, Human; identical to SEQ ID NO: 64360

SEQ ID NO: 64392 - DNA, 601 bp, Human; identical to SEQ ID NO: 64330

SEQ ID NO: 64393 - DNA, 601 bp, Human; identical to SEQ ID NO: 64331

SEQ ID NO: 64394 - DNA, 601 bp, Human; identical to SEQ ID NO: 64332

SEQ ID NO: 64395 - DNA, 601 bp, Human; identical to SEQ ID NO: 64333

SEQ ID NO: 64396 - DNA, 601 bp, Human; identical to SEQ ID NO: 64334

SEQ ID NO: 64397 - DNA, 601 bp, Human; identical to SEQ ID NO: 64335

SEQ ID NO: 64398 - DNA, 601 bp, Human; identical to SEQ ID NO: 64336

SEQ ID NO: 64399 - DNA, 601 bp, Human; identical to SEQ ID NO: 64337

SEQ ID NO: 64400 - DNA, 601 bp, Human; identical to SEQ ID NO: 64338

SEQ ID NO: 64401 - DNA, 601 bp, Human; identical to SEQ ID NO: 64339

SEQ ID NO: 64402 - DNA, 601 bp, Human; identical to SEQ ID NO: 64340

SEQ ID NO: 64403 - DNA, 601 bp, Human; identical to SEQ ID NO: 64341

SEQ ID NO: 64404 - DNA, 601 bp, Human; identical to SEQ ID NO: 64342

SEQ ID NO: 64405 - DNA, 601 bp, Human; identical to SEQ ID NO: 64343

SEQ ID NO: 64406 - DNA, 601 bp, Human; identical to SEQ ID NO: 64344

SEQ ID NO: 64407 - DNA, 601 bp, Human; identical to SEQ ID NO: 64345

SEQ ID NO: 64408 - DNA, 601 bp, Human; identical to SEQ ID NO: 64346

SEQ ID NO: 64409 - DNA, 601 bp, Human; identical to SEQ ID NO: 64347

SEQ ID NO: 64410 - DNA, 601 bp, Human; identical to SEQ ID NO: 64348

SEQ ID NO: 64411 - DNA, 601 bp, Human; identical to SEQ ID NO: 64349

SEQ ID NO: 64412 - DNA, 601 bp, Human; identical to SEQ ID NO: 64350

SEQ ID NO: 64413 - DNA, 601 bp, Human; identical to SEQ ID NO: 64351

SEQ ID NO: 64414 - DNA, 601 bp, Human; identical to SEQ ID NO: 64352

SEQ ID NO: 64415 - DNA, 601 bp, Human; identical to SEQ ID NO: 64353

SEQ ID NO: 64416 - DNA, 601 bp, Human; identical to SEQ ID NO: 64354

SEQ ID NO: 64417 - DNA, 601 bp, Human; identical to SEQ ID NO: 64355

SEQ ID NO: 64418 - DNA, 601 bp, Human; identical to SEQ ID NO: 64356

SEQ ID NO: 64419 - DNA, 601 bp, Human; identical to SEQ ID NO: 64357

SEQ ID NO: 64420 - DNA, 601 bp, Human; identical to SEQ ID NO: 64358

SEQ ID NO: 64421 - DNA, 601 bp, Human; identical to SEQ ID NO: 64359

SEQ ID NO: 64422 - DNA, 601 bp, Human; identical to SEQ ID NO: 64360

SEQ ID NO: 64423 - DNA, 601 bp, Human; identical to SEQ ID NO: 64330

SEQ ID NO: 64424 - DNA, 601 bp, Human; identical to SEQ ID NO: 64331

SEQ ID NO: 64425 - DNA, 601 bp, Human; identical to SEQ ID NO: 64332

SEQ ID NO: 64426 - DNA, 601 bp, Human; identical to SEQ ID NO: 64333

SEQ ID NO: 64427 - DNA, 601 bp, Human; identical to SEQ ID NO: 64334

SEQ ID NO: 64428 - DNA, 601 bp, Human; identical to SEQ ID NO: 64335

SEQ ID NO: 64429 - DNA, 601 bp, Human; identical to SEQ ID NO: 64336

SEQ ID NO: 64430 - DNA, 601 bp, Human; identical to SEQ ID NO: 64337

SEQ ID NO: 64431 - DNA, 601 bp, Human; identical to SEQ ID NO: 64338

SEQ ID NO: 64432 - DNA, 601 bp, Human; identical to SEQ ID NO: 64339

SEQ ID NO: 64433 - DNA, 601 bp, Human; identical to SEQ ID NO: 64340

SEQ ID NO: 64434 - DNA, 601 bp, Human; identical to SEQ ID NO: 64341

SEQ ID NO: 64435 - DNA, 601 bp, Human; identical to SEQ ID NO: 64342

SEQ ID NO: 64436 - DNA, 601 bp, Human; identical to SEQ ID NO: 64343

SEQ ID NO: 64437 - DNA, 601 bp, Human; identical to SEQ ID NO: 64344

SEQ ID NO: 64438 - DNA, 601 bp, Human; identical to SEQ ID NO: 64345

SEQ ID NO: 64439 - DNA, 601 bp, Human; identical to SEQ ID NO: 64346

SEQ ID NO: 64440 - DNA, 601 bp, Human; identical to SEQ ID NO: 64347

SEQ ID NO: 64441 - DNA, 601 bp, Human; identical to SEQ ID NO: 64348

SEQ ID NO: 64442 - DNA, 601 bp, Human; identical to SEQ ID NO: 64349

SEQ ID NO: 64443 - DNA, 601 bp, Human; identical to SEQ ID NO: 64350

SEQ ID NO: 64444 - DNA, 601 bp, Human; identical to SEQ ID NO: 64351

SEQ ID NO: 64445 - DNA, 601 bp, Human; identical to SEQ ID NO: 64352

SEQ ID NO: 64446 - DNA, 601 bp, Human; identical to SEQ ID NO: 64353

SEQ ID NO: 64447 - DNA, 601 bp, Human; identical to SEQ ID NO: 64354

SEQ ID NO: 64448 - DNA, 601 bp, Human; identical to SEQ ID NO: 64355

SEQ ID NO: 64449 - DNA, 601 bp, Human; identical to SEQ ID NO: 64356

SEQ ID NO: 64450 - DNA, 601 bp, Human; identical to SEQ ID NO: 64357

SEQ ID NO: 64451 - DNA, 601 bp, Human; identical to SEQ ID NO: 64358

SEQ ID NO: 64452 - DNA, 601 bp, Human; identical to SEQ ID NO: 64359

SEQ ID NO: 64453 - DNA, 601 bp, Human; identical to SEQ ID NO: 64360

SEQ ID NO: 64454 - DNA, 601 bp, Human; identical to SEQ ID NO: 64330

SEQ ID NO: 64455 - DNA, 601 bp, Human; identical to SEQ ID NO: 64331

SEQ ID NO: 64456 - DNA, 601 bp, Human; identical to SEQ ID NO: 64332

SEQ ID NO: 64457 - DNA, 601 bp, Human; identical to SEQ ID NO: 64333

SEQ ID NO: 64458 - DNA, 601 bp, Human; identical to SEQ ID NO: 64334

SEQ ID NO: 64459 - DNA, 601 bp, Human; identical to SEQ ID NO: 64335

SEQ ID NO: 64460 - DNA, 601 bp, Human; identical to SEQ ID NO: 64336

SEQ ID NO: 64461 - DNA, 601 bp, Human; identical to SEQ ID NO: 64337

SEQ ID NO: 64462 - DNA, 601 bp, Human; identical to SEQ ID NO: 64338

SEQ ID NO: 64463 - DNA, 601 bp, Human; identical to SEQ ID NO: 64339

SEQ ID NO: 64464 - DNA, 601 bp, Human; identical to SEQ ID NO: 64340

SEQ ID NO: 64465 - DNA, 601 bp, Human; identical to SEQ ID NO: 64341

SEQ ID NO: 64466 - DNA, 601 bp, Human; identical to SEQ ID NO: 64342

SEQ ID NO: 64467 - DNA, 601 bp, Human; identical to SEQ ID NO: 64343

SEQ ID NO: 64468 - DNA, 601 bp, Human; identical to SEQ ID NO: 64344

SEQ ID NO: 64469 - DNA, 601 bp, Human; identical to SEQ ID NO: 64345

SEQ ID NO: 64470 - DNA, 601 bp, Human; identical to SEQ ID NO: 64346

SEQ ID NO: 64471 - DNA, 601 bp, Human; identical to SEQ ID NO: 64347

SEQ ID NO: 64472 - DNA, 601 bp, Human; identical to SEQ ID NO: 64348

SEQ ID NO: 64473 - DNA, 601 bp, Human; identical to SEQ ID NO: 64349

SEQ ID NO: 64474 - DNA, 601 bp, Human; identical to SEQ ID NO: 64350

SEQ ID NO: 64475 - DNA, 601 bp, Human; identical to SEQ ID NO: 64351

SEQ ID NO: 64476 - DNA, 601 bp, Human; identical to SEQ ID NO: 64352

SEQ ID NO: 64477 - DNA, 601 bp, Human; identical to SEQ ID NO: 64353

SEQ ID NO: 64478 - DNA, 601 bp, Human; identical to SEQ ID NO: 64354

SEQ ID NO: 64479 - DNA, 601 bp, Human; identical to SEQ ID NO: 64355

SEQ ID NO: 64480 - DNA, 601 bp, Human; identical to SEQ ID NO: 64356

SEQ ID NO: 64481 - DNA, 601 bp, Human; identical to SEQ ID NO: 64357

SEQ ID NO: 64482 - DNA, 601 bp, Human; identical to SEQ ID NO: 64358

SEQ ID NO: 64483 - DNA, 601 bp, Human; identical to SEQ ID NO: 64359

SEQ ID NO: 64484 - DNA, 601 bp, Human; identical to SEQ ID NO: 64360

SEQ ID NO: 64485 - DNA, 601 bp, Human; identical to SEQ ID NO: 64330

SEQ ID NO: 64486 - DNA, 601 bp, Human; identical to SEQ ID NO: 64331

SEQ ID NO: 64487 - DNA, 601 bp, Human; identical to SEQ ID NO: 64332

SEQ ID NO: 64488 - DNA, 601 bp, Human; identical to SEQ ID NO: 64333

SEQ ID NO: 64489 - DNA, 601 bp, Human; identical to SEQ ID NO: 64334

SEQ ID NO: 64490 - DNA, 601 bp, Human; identical to SEQ ID NO: 64335

SEQ ID NO: 64491 - DNA, 601 bp, Human; identical to SEQ ID NO: 64336

SEQ ID NO: 64492 - DNA, 601 bp, Human; identical to SEQ ID NO: 64337

SEQ ID NO: 64493 - DNA, 601 bp, Human; identical to SEQ ID NO: 64338

SEQ ID NO: 64494 - DNA, 601 bp, Human; identical to SEQ ID NO: 64339

SEQ ID NO: 64495 - DNA, 601 bp, Human; identical to SEQ ID NO: 64340

SEQ ID NO: 64496 - DNA, 601 bp, Human; identical to SEQ ID NO: 64341

SEQ ID NO: 64497 - DNA, 601 bp, Human; identical to SEQ ID NO: 64342

SEQ ID NO: 64498 - DNA, 601 bp, Human; identical to SEQ ID NO: 64343

SEQ ID NO: 64499 - DNA, 601 bp, Human; identical to SEQ ID NO: 64344

SEQ ID NO: 64500 - DNA, 601 bp, Human; identical to SEQ ID NO: 64345

SEQ ID NO: 64501 - DNA, 601 bp, Human; identical to SEQ ID NO: 64346

SEQ ID NO: 64502 - DNA, 601 bp, Human; identical to SEQ ID NO: 64347

SEQ ID NO: 64503 - DNA, 601 bp, Human; identical to SEQ ID NO: 64348

SEQ ID NO: 64504 - DNA, 601 bp, Human; identical to SEQ ID NO: 64349

SEQ ID NO: 64505 - DNA, 601 bp, Human; identical to SEQ ID NO: 64350

SEQ ID NO: 64506 - DNA, 601 bp, Human; identical to SEQ ID NO: 64351

SEQ ID NO: 64507 - DNA, 601 bp, Human; identical to SEQ ID NO: 64352

SEQ ID NO: 64508 - DNA, 601 bp, Human; identical to SEQ ID NO: 64353

SEQ ID NO: 64509 - DNA, 601 bp, Human; identical to SEQ ID NO: 64354

SEQ ID NO: 64510 - DNA, 601 bp, Human; identical to SEQ ID NO: 64355

SEQ ID NO: 64511 - DNA, 601 bp, Human; identical to SEQ ID NO: 64356

SEQ ID NO: 64512 - DNA, 601 bp, Human; identical to SEQ ID NO: 64357

SEQ ID NO: 64513 - DNA, 601 bp, Human; identical to SEQ ID NO: 64358

SEQ ID NO: 64514 - DNA, 601 bp, Human; identical to SEQ ID NO: 64359

SEQ ID NO: 64515 - DNA, 601 bp, Human; identical to SEQ ID NO: 64360

SEQ ID NO: 64516 - DNA, 601 bp, Human; identical to SEQ ID NO: 64330

SEQ ID NO: 64517 - DNA, 601 bp, Human; identical to SEQ ID NO: 64331

SEQ ID NO: 64518 - DNA, 601 bp, Human; identical to SEQ ID NO: 64332

SEQ ID NO: 64519 - DNA, 601 bp, Human; identical to SEQ ID NO: 64333

SEQ ID NO: 64520 - DNA, 601 bp, Human; identical to SEQ ID NO: 64334

SEQ ID NO: 64521 - DNA, 601 bp, Human; identical to SEQ ID NO: 64335

SEQ ID NO: 64522 - DNA, 601 bp, Human; identical to SEQ ID NO: 64336

SEQ ID NO: 64523 - DNA, 601 bp, Human; identical to SEQ ID NO: 64337

SEQ ID NO: 64524 - DNA, 601 bp, Human; identical to SEQ ID NO: 64338

SEQ ID NO: 64525 - DNA, 601 bp, Human; identical to SEQ ID NO: 64339

SEQ ID NO: 64526 - DNA, 601 bp, Human; identical to SEQ ID NO: 64340

SEQ ID NO: 64527 - DNA, 601 bp, Human; identical to SEQ ID NO: 64341

SEQ ID NO: 64528 - DNA, 601 bp, Human; identical to SEQ ID NO: 64342

SEQ ID NO: 64529 - DNA, 601 bp, Human; identical to SEQ ID NO: 64343

SEQ ID NO: 64530 - DNA, 601 bp, Human; identical to SEQ ID NO: 64344

SEQ ID NO: 64531 - DNA, 601 bp, Human; identical to SEQ ID NO: 64345

SEQ ID NO: 64532 - DNA, 601 bp, Human; identical to SEQ ID NO: 64346

SEQ ID NO: 64533 - DNA, 601 bp, Human; identical to SEQ ID NO: 64347

SEQ ID NO: 64534 - DNA, 601 bp, Human; identical to SEQ ID NO: 64348

SEQ ID NO: 64535 - DNA, 601 bp, Human; identical to SEQ ID NO: 64349

SEQ ID NO: 64536 - DNA, 601 bp, Human; identical to SEQ ID NO: 64350

SEQ ID NO: 64537 - DNA, 601 bp, Human; identical to SEQ ID NO: 64351

SEQ ID NO: 64538 - DNA, 601 bp, Human; identical to SEQ ID NO: 64352

SEQ ID NO: 64539 - DNA, 601 bp, Human; identical to SEQ ID NO: 64353

SEQ ID NO: 64540 - DNA, 601 bp, Human; identical to SEQ ID NO: 64354

SEQ ID NO: 64541 - DNA, 601 bp, Human; identical to SEQ ID NO: 64355

SEQ ID NO: 64542 - DNA, 601 bp, Human; identical to SEQ ID NO: 64356

SEQ ID NO: 64543 - DNA, 601 bp, Human; identical to SEQ ID NO: 64357

SEQ ID NO: 64544 - DNA, 601 bp, Human; identical to SEQ ID NO: 64358

SEQ ID NO: 64545 - DNA, 601 bp, Human; identical to SEQ ID NO: 64359

SEQ ID NO: 64546 - DNA, 601 bp, Human; identical to SEQ ID NO: 64360

SEQ ID NO: 64547 - DNA, 601 bp, Human; identical to SEQ ID NO: 64330

SEQ ID NO: 64548 - DNA, 601 bp, Human; identical to SEQ ID NO: 64331

SEQ ID NO: 64549 - DNA, 601 bp, Human; identical to SEQ ID NO: 64332

SEQ ID NO: 64550 - DNA, 601 bp, Human; identical to SEQ ID NO: 64333

SEQ ID NO: 64551 - DNA, 601 bp, Human; identical to SEQ ID NO: 64334

SEQ ID NO: 64552 - DNA, 601 bp, Human; identical to SEQ ID NO: 64335

SEQ ID NO: 64553 - DNA, 601 bp, Human; identical to SEQ ID NO: 64336

SEQ ID NO: 64554 - DNA, 601 bp, Human; identical to SEQ ID NO: 64337

SEQ ID NO: 64555 - DNA, 601 bp, Human; identical to SEQ ID NO: 64338

SEQ ID NO: 64556 - DNA, 601 bp, Human; identical to SEQ ID NO: 64339

SEQ ID NO: 64557 - DNA, 601 bp, Human; identical to SEQ ID NO: 64340

SEQ ID NO: 64558 - DNA, 601 bp, Human; identical to SEQ ID NO: 64341

SEQ ID NO: 64559 - DNA, 601 bp, Human; identical to SEQ ID NO: 64342

SEQ ID NO: 64560 - DNA, 601 bp, Human; identical to SEQ ID NO: 64343

SEQ ID NO: 64561 - DNA, 601 bp, Human; identical to SEQ ID NO: 64344

SEQ ID NO: 64562 - DNA, 601 bp, Human; identical to SEQ ID NO: 64345

SEQ ID NO: 64563 - DNA, 601 bp, Human; identical to SEQ ID NO: 64346

SEQ ID NO: 64564 - DNA, 601 bp, Human; identical to SEQ ID NO: 64347

SEQ ID NO: 64565 - DNA, 601 bp, Human; identical to SEQ ID NO: 64348

SEQ ID NO: 64566 - DNA, 601 bp, Human; identical to SEQ ID NO: 64349

SEQ ID NO: 64567 - DNA, 601 bp, Human; identical to SEQ ID NO: 64350

SEQ ID NO: 64568 - DNA, 601 bp, Human; identical to SEQ ID NO: 64351

SEQ ID NO: 64569 - DNA, 601 bp, Human; identical to SEQ ID NO: 64352

SEQ ID NO: 64570 - DNA, 601 bp, Human; identical to SEQ ID NO: 64353

SEQ ID NO: 64571 - DNA, 601 bp, Human; identical to SEQ ID NO: 64354

SEQ ID NO: 64572 - DNA, 601 bp, Human; identical to SEQ ID NO: 64355

SEQ ID NO: 64573 - DNA, 601 bp, Human; identical to SEQ ID NO: 64356

SEQ ID NO: 64574 - DNA, 601 bp, Human; identical to SEQ ID NO: 64357

SEQ ID NO: 64575 - DNA, 601 bp, Human; identical to SEQ ID NO: 64358

SEQ ID NO: 64576 - DNA, 601 bp, Human; identical to SEQ ID NO: 64359

SEQ ID NO: 64577 - DNA, 601 bp, Human; identical to SEQ ID NO: 64360

SEQ ID NO: 64578 - DNA, 601 bp, Human; identical to SEQ ID NO: 34391

SEQ ID NO: 64579 - DNA, 601 bp, Human
ccggttggttgtgaagttagacaaaagtgctggacttttagcctctgtgaatatgtagatttcaaagggtgtcggaaataccgttgaaagtggtaattcctcatttttcctccttggcagctcggattctgaaggtaattttgagactcctgaagctgaaaccccgatccgatcacctttcaaggagtcctgtgatccatcactcggattggcaggacctggggccaaaagccaaggtaaagaaaaacttgcatttttcctgcctgttttgtttcaaaagttttgaaaaatatcaatgaargaaggaaaaaagtgtaaatttaggaccatttaagagagtttgactaagaaagagctgtttgaaacctcctggcttatgtatttttaggggtgtggtgatcgaggctttctcctctgagtagagtttgtgcatttgcagtataagattatcattatcaaacattcctactaggcctttctcctcagcccctaaaaaaatatgtatagtaatgaagtaggaagatcatgtttatatttgacttcacaaattcctcaggctaagttgctttctactggggtgtggctggagacaaaaattaca

SEQ ID NO: 64580 - DNA, 601 bp, Human
tttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctcttaaaaggttgatatggtgtatttttagaatgttttagactgcacgtgtgtgtgtgtttgtttgtgtgtgtgtgtgttcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctccaacaagggaatgctttattagagtttcctagaaataatgggactaattaggacctttcatattacctagtccagcagtccaacccatgtggctccttcaacagcatcgc

SEQ ID NO: 64581 - DNA, 601 bp, Human
gcctctctcaggagttagaggcttatctcaggagaacagcagtgtagctggtgccctgtctcttaaaaaagcaatgaaatttgccctaccgtgacttctgggtaatgtttttgtttgggggttttttggaggttaggaaggggtttaaacaggtagtttgttgtctgggttctgcgtgtgtgtgtgtgtgtgtgtgtgtgtgtgtgtgtatgtgtatttttctgctttggttggtgagacagcttaaaactatgatgtacctaagaggatggtctgccttgactcacccactcagaatccygctgacccacccctctcccatgcttccggggatcctgggccccagcagttgttggggaaatgtgagctatgcagcccatacccttagattgtatcccgcattcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaat

SEQ ID NO: 64582 - DNA, 601 bp, Human
tgccctgtctcttaaaaaagcaatgaaatttgccctaccgtgacttctgggtaatgtttttgtttgggggttttttggaggttaggaaggggtttaaacaggtagtttgttgtctgggttctgcgtgtgtgtgtgtgtgtgtgtgtgtgtgtgtgtgtatgtgtatttttctgctttggttggtgagacagcttaaaactatgatgtacctaagaggatggtctgccttgactcacccactcagaatcccgctgacccacccctctcccatgcttccggggatcctgggccccagcagttrttggggaaatgtgagctatgcagcccatacccttagattgtatcccgcattcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaatgctaatatacatctgattaacagtctcctcagggcagaccacttgagcaga

SEQ ID NO: 64583 - DNA, 601 bp, Human
tcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaatgctaatatacatctgattaacagtctcctcagggcagaccacttgagcagaaagggttggtgccagaatcacgcttgtttccctcctgaagcccttgattcrgtgtgggggaggagagctgggagggcaagaccaaggcacggaaaggaggagtgggaccttcagggcaaagggccaagggaagagctatgccaagccatcccccagccgttagcctagagctgagctgcggcatcactgaacaattagctaggccttctcagtatgcgacagatgaggtgaggaggagtcctttatgtatcagacacttgccctgcagtgggcactgattgagcatcagctctgtcttggacgctcagtttctgctcccagggatacaaagagtaaggcccctgtggggct

SEQ ID NO: 64584 - DNA, 601 bp, Human
gtgtctctccaagtgacacacataagacactatttaaagcatgtactttggatgtgtgtgctggctcactcctgtaatcccagcactttgggaggccaaagcaggaggattgcttgagaccagcctgggcaacaaaatgagaccccgactctaccaaaaacaaacaaacaaaaaattagcagggcatgatggcttgtgcctttagtcccagctgctcagaaggctaaggtgggaggatcacttgagcttgggaggttgaggctccagtgagccgtaatcgccccactgtactccagcctgracaacagagcaaatctgtgtggtatagttgaacattttactagaaatcacaggacattcctcctgctccatttccctcgggtctgagcctccatgttcttttttaaaaatagttttattgagatatagtttacctgccatacaattcaccatttaaaagctttatgatagtttttaatttatcgacagagttgtacaactattatctcaatttaatttttagaacattttatcacccccaaaggaaaccctatacccattaggtgtcacactccattcctcttccttcccaccaccagtc

SEQ ID NO: 64585 - DNA, 601 bp, Human
atgtactttggatgtgtgtgctggctcactcctgtaatcccagcactttgggaggccaaagcaggaggattgcttgagaccagcctgggcaacaaaatgagaccccgactctaccaaaaacaaacaaacaaaaaattagcagggcatgatggcttgtgcctttagtcccagctgctcagaaggctaaggtgggaggatcacttgagcttgggaggttgaggctccagtgagccgtaatcgccccactgtactccagcctggacaacagagcaaatctgtgtggtatagttgaacattttaytagaaatcacaggacattcctcctgctccatttccctcgggtctgagcctccatgttcttttttaaaaatagttttattgagatatagtttacctgccatacaattcaccatttaaaagctttatgatagtttttaatttatcgacagagttgtacaactattatctcaatttaatttttagaacattttatcacccccaaaggaaaccctatacccattaggtgtcacactccattcctcttccttcccaccaccagtcctaggtaactgatgatctagtttgtgtctcaatagatttg

SEQ ID NO: 64586 - DNA, 601 bp, Human
attcaggttttatcttacattagattcatattttttaggtaaacttttttttaaataaacttctggctgggtgcagtggctgacacctgtagtcttagcattttgggaagctaaggcagaaagatcagttgaggccaggagtttgagaccagcgtggacaacataataagaccccatttctacaaattcttttttttaattagctgggcacactggctgtatgcctgttgtctcagtttctcaggagggtgaggcaggaggattgtctgagcataggaggttgaggctgcagtgacctacragtgctccgttgtactctagcctgggtgacagagcaagaccctgtctccaaaaaataaataaatatttaaaatttaaaattaggatttaaaatatgttaaagctcaaagatgaaagtgtagaatggatatcacttattattatgtagtattcagtgtgaattacgatgatcacatctatatccatggctctggtgatgtcaaatattattcccagcccagatttcttctctgaacatacttctacttattcaacatctctgcttcaaaatcccaaaacaggccaggcatggtggctcaca

SEQ ID NO: 64587 - DNA, 601 bp, Human
tggaatgattaaaaaaaaaaaaacctgaaacagatctcaacatgtccaaggctaaacccatggccccactccaacagtccccaagcattcactagtatttcctgaatctcactgaatggcactagtcttctagtttcaaaggctaaaacttacaaatcatctttgctacctcctcctacttcagtcctgtatccagcttatcacccagccttatcagtctcacctcatttcctctctagagcataacttctcctcctgttgtgggaagtcagggaccctgaacggagggactggaagaacrtaaatcgtgaagatttcatggatatttatcagttcccaaaattaatacttttataatttcttatgcctgtctttactgcaatctctgaacataaattgtgaagatttcatggacatttatcagttcccaaataatactcttataatttcttatgcctgtcttactttaatctcttaatcctgttatcttcgtaagctgaggatgtatatcacgtcaggaccactattgtacaaattgattgtgaagcatgtgtgtttaaacaatatgaaatcagtgcaccttgaaaaagaacagaataac

SEQ ID NO: 64588 - DNA, 601 bp, Human
ctctagagcataacttctcctcctgttgtgggaagtcagggaccctgaacggagggactggaagaacataaatcgtgaagatttcatggatatttatcagttcccaaaattaatacttttataatttcttatgcctgtctttactgcaatctctgaacataaattgtgaagatttcatggacatttatcagttcccaaataatactcttataatttcttatgcctgtcttactttaatctcttaatcctgttatcttcgtaagctgaggatgtatatcacgtcaggaccactattgtacamattgattgtgaagcatgtgtgtttaaacaatatgaaatcagtgcaccttgaaaaagaacagaataacagcgattttccgggaacaagggaagacaaccataaggtctgactgcctgtggggtcgggcagaatagagccatatttttcttcttgcagagagcctataaacggacatgcaagtaggagagagattgctgaattcttttcccagcaaggaatattaataattaataccctggggaaagaatgcattcctggggggaggtctataaatggccgctctgggagtctctgtcttat

SEQ ID NO: 64589 - DNA, 601 bp, Human
caatatgaaatcagtgcaccttgaaaaagaacagaataacagcgattttccgggaacaagggaagacaaccataaggtctgactgcctgtggggtcgggcagaatagagccatatttttcttcttgcagagagcctataaacggacatgcaagtaggagagagattgctgaattcttttcccagcaaggaatattaataattaataccctggggaaagaatgcattcctggggggaggtctataaatggccgctctgggagtctctgtcttatgcggttgagataaggactgaaatacgcygtggtctcctgcagtaccctcaggcttactaggattgggaaattccagcctggtaaattttggtcagaccggttctctgctctcgaaccctgttttctgttaagatgtttatcaagacaatatgtgcatagctgaacatagactctcatcagtaattctaattttgccgtttgccttgtgatctttgctttgccccttgccttgtgatctttattggcctcagaagcatgtgatctttgtgacctactccctgttcgtacaccccctccccttttgaaatccttaataaaaacatgctgg

SEQ ID NO: 64590 - DNA, 601 bp, Human
agtttaaatctttttggtagaaaatacaaaactaagatatttagaagtatcattttaaaaaaatctcagataatttagtgctgtgtctgttaaatagtcactgttaaaaggcacatttcctgttctggatgttctcagattctccagcaccaactgggtttccaaaaattcagttcatttcttaaactatctgtccttagtgcagaccccacaagttaaggtctcagtcccacgagactgccgccacttcagataccagtcacaagtctcagtgcttctgagcaactggctataaatttgrggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgtgattgattaaattattggc

SEQ ID NO: 64591 - DNA, 601 bp, Human
ctgagcaactggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtargtgtgattgattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaa

SEQ ID NO: 64592 - DNA, 601 bp, Human
gcaactggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgygattgattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaagctg

SEQ ID NO: 64593 - DNA, 601 bp, Human
ctggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgtgatygattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaagctgacaa

SEQ ID NO: 64594 - DNA, 601 bp, Human
tgtaggagctctgtgccaggaactgaggacaaagacaaaatacgtatttttattataccacctgtgttgaatctaaaaagctgacaataagcaccaaaacttaaaaggagtgataactatctaaaccttgatataatcaagactcattgttgtacaactggcctgtcttttaactgagccagttgtacatggaaacacatggatatttgcagccttagggtgctgatggcttgtttttagttgtctgcctccgcatcatcagcacaaagaaacaataacacatttataacagttcacatayatggacagagataatagactctgtacacataagtgaaattgtcagtacagtttaaaatgttcttgttaaaattttgtgtgtattgcagttgagtttttaaactttttatttatgaaaagtttcacaactgtatgacagagaaaatagtacaatgaaaactcccatatacctattcctggacaacagttaccaagattttgccatacttactatctcttttttaaaaaatccttttgaaatatgttaaaccaaattctgattatgaagcactgagacgttttaacacattttagtattaat

SEQ ID NO: 64595 - DNA, 601 bp, Human
aatagttaaacatatatttaaaagaaaaattttaattggacatttgtagaatatctgaagtatgtttgtgaagtataatttgtaaaccagtacccaataataatcatagaagattcatgagaaaggtgtgtgaatgctttaaaaaagctattccaaatcccagctacttgggcagctgagatgggagaattgcttgagccccagagtttgaggctgcagtgagctgtgatcacaccactgcactccagcctgggcaacagagtgagagacccctaaaaaaaaaaaaaaaaaaaaaaaaaaacaggctggacgcagtggcttatacctgtgaccccagtgctttgggagaccaaggcaggcagattgcttgagcccagtgagaccagcctgggcaacttggctgtcctgtctctacataaaaaataaattaaaataaaaattagccaagcttagtggctcatgactgtggtcccggttacttgggaggctgaggtgggaggatcacttgagcctggggaagtcaaggctgcagtgagccatgatcaggccactgcactccagcctgggtaacagagacactgtgtcaagaaaaacaaaaata

SEQ ID NO: 64596 - DNA, 601 bp, Human; identical to SEQ ID NO: 34392

SEQ ID NO: 64597 - DNA, 601 bp, Human; identical to SEQ ID NO: 34393

SEQ ID NO: 64598 - DNA, 601 bp, Human; identical to SEQ ID NO: 34394

SEQ ID NO: 64599 - DNA, 601 bp, Human; identical to SEQ ID NO: 34395

SEQ ID NO: 64600 - DNA, 601 bp, Human; identical to SEQ ID NO: 34396

SEQ ID NO: 64601 - DNA, 601 bp, Human; identical to SEQ ID NO: 34397

SEQ ID NO: 64602 - DNA, 601 bp, Human; identical to SEQ ID NO: 34398

SEQ ID NO: 64603 - DNA, 601 bp, Human; identical to SEQ ID NO: 34399

SEQ ID NO: 64604 - DNA, 601 bp, Human; identical to SEQ ID NO: 34400

SEQ ID NO: 64605 - DNA, 601 bp, Human; identical to SEQ ID NO: 34401

SEQ ID NO: 64606 - DNA, 601 bp, Human; identical to SEQ ID NO: 34402

SEQ ID NO: 64607 - DNA, 601 bp, Human; identical to SEQ ID NO: 34403

SEQ ID NO: 64608 - DNA, 601 bp, Human; identical to SEQ ID NO: 34404

SEQ ID NO: 64609 - DNA, 601 bp, Human; identical to SEQ ID NO: 34405

SEQ ID NO: 64610 - DNA, 601 bp, Human; identical to SEQ ID NO: 34406

SEQ ID NO: 64611 - DNA, 601 bp, Human; identical to SEQ ID NO: 34407

SEQ ID NO: 64612 - DNA, 601 bp, Human; identical to SEQ ID NO: 34408

SEQ ID NO: 64613 - DNA, 601 bp, Human; identical to SEQ ID NO: 34409

SEQ ID NO: 64614 - DNA, 601 bp, Human; identical to SEQ ID NO: 34410

SEQ ID NO: 64615 - DNA, 601 bp, Human; identical to SEQ ID NO: 34411

SEQ ID NO: 64616 - DNA, 601 bp, Human; identical to SEQ ID NO: 34412

SEQ ID NO: 64617 - DNA, 601 bp, Human; identical to SEQ ID NO: 34413

SEQ ID NO: 64618 - DNA, 601 bp, Human; identical to SEQ ID NO: 34414

SEQ ID NO: 64619 - DNA, 601 bp, Human; identical to SEQ ID NO: 34415

SEQ ID NO: 64620 - DNA, 601 bp, Human; identical to SEQ ID NO: 34416

SEQ ID NO: 64621 - DNA, 601 bp, Human
tagaaatgtcgttttttttgttttttttttttttgagttggagtctcgctctgttgcccaggctggagtgcagtggtgccatctcggctcactgcaacctccgcctcccggtttaagcgattctcctgcctcagcctctcgagtagctaggattacaggcgccggccatcacacccggctaatttttgtatttttagtacagacggggtttcgccatgttggccaggatggtcttgaactcctgacctcaagtgatccccctttcccctgcccctcggcctcccgaagtgttgggattacaggcgtgagccactgcgctcggccccaaatgtcattttattatttgagttataaagtgagtgaacctcttggagccctggttctttattcgaatacaggaatgttgtaaggacataacgactgatgcatcgataaacaaaatatggtgttaatatattcattcaatggagtattatttggccttagaaaggaatgaactgctgatgcatgctacaatatgaatgaaccttgaaaacatcacactacgtgagctaagtcagtcagaaagactgcatattgtgtgattccatttatatgaaat

SEQ ID NO: 64622 - DNA, 601 bp, Human
gaaatgtcgttttttttgttttttttttttttgagttggagtctcgctctgttgcccaggctggagtgcagtggtgccatctcggctcactgcaacctccgcctcccggtttaagcgattctcctgcctcagcctctcgagtagctaggattacaggcgccggccatcacacccggctaatttttgtatttttagtacagacggggtttcgccatgttggccaggatggtcttgaactcctgacctcaagtgatccccctttcccctgcccctcggcctcccgaagtgttgggattacaggcgtgagccactgcgctcggccccaaatgtcattttattatttgagttataaagtgagtgaacctcttggagccctggttctttattcgaatacaggaatgttgtaaggacataacgactgatgcatcgataaacaaaatatggtgttaatatattcattcaatggagtattatttggccttagaaaggaatgaactgctgatgcatgctacaatatgaatgaaccttgaaaacatcacactacgtgagctaagtcagtcagaaagactgcatattgtgtgattccatttatatgaaatgg

SEQ ID NO: 64623 - DNA, 601 bp, Human
tagattcactggagatgcaggataaactagtaggccagctagtttgctggagagaaccaggaaaagaagaagctaggaggagccctttggtatcagaacaactctcaaacactgaccttgggaactaactgtccctttagagggacccaaatttgatctactcagtctgtggagcaatttatgcctcagggtgttattaaaaccagtagagcaatcagctggaaattagtgaagctttaacaactagatgtggtcaaggaaagatacactcaaagaaagtcttacaaaaatctttgtcatccaggatgactgtgggcatacccaaggctgtgccttctaatgagcaatatcacatacttcatacttgaagtttgagggcaaacagactttgcaaaaataatccagctggttactaaacaaatgagcaaatgacaataacaagcctaaggtggaaaaggtgggaccagtagtactcagagttgctaaaatgtctagtttccaacaaagaattatgagctatgcaaagacacaggaaagtatgacccatacactggaaaaaaagcaggtaacagaaactgattgtgaaagtgaccagatgtca

SEQ ID NO: 64624 - DNA, 601 bp, Human
agtataacaatataatgttgagtttgtaacatttgtagacataatgtggattacaataaaatcacaaaaaaggggaaaaggaacagacttatataggaatagcattcctgtatctcactggaattaagttggtataaatcagaagctgattctgatgagaagcatattgttagcccagctgggtgctgtggctcacgcctgtaatcccagcaatttgggaggccaaggtgggcagatcacaaggtcaggagatcgagaccattctggctaacatggtgaaaccttgtctgtactaaaaatmcaaaaaaaaaaaaaaaaaaaaaattagccgggcgtggtggcgggcgcctgtagtcccagctacttgggaggctgaggcaggagaatggcatgaacccgggaggcggagcttgcagtgagccgagatcgtgccactgcactccagcctgggtgatagagtgagactccgtctcaaaaaaaaaaaaaaaaaaaaaaggaagaagaagaagtgtattgttagcccaagagtaactgctaaagaaaaaaaaagtataatcattaagttataatgctacatttgaaaatattcacttaatgcaaa

SEQ ID NO: 64625 - DNA, 601 bp, Human
ctgggtgatagagtgagactccgtctcaaaaaaaaaaaaaaaaaaaaaaggaagaagaagaagtgtattgttagcccaagagtaactgctaaagaaaaaaaaagtataatcattaagttataatgctacatttgaaaatattcacttaatgcaaaagaaagcagtaaaggtggaataaaggacaaaaacacatgagacatataaaaaacaaaaagtaaaaataaaacatgtaaatccagctatatcaataatattaaatgtgcatggattaagcaatctagtcagaagacagactggattaaaaaaaaaacaagatccaattatatggtgtctaaaggtggcacacttaaggtttaaagatacaaatagtttgaaagtaaatggatggaaaaagaaatataatgcaataaagaaaagataaatgtttgaggtgtcagatatgccagttaccctgttttgatcattacactttatatacatgtatcaaaatatcacatgtatcccaaaaatatgtactacttttattaattaacaaattacatatatgcacatataaatacatatatatacgtgtatacacatatatatatgcatgtataca

SEQ ID NO: 64626 - DNA, 601 bp, Human
ggaccttaggcatacgccactacacctggctaatttttgtattttttgtagagatggggtctcactttgttgcccaggctggtctggaactcctgacctcaagcgatccacctgccttggtctcccaaagtgctagaattacaagaatgagctaccacgcctggccaagtccttcatttttatgacatactttaatatgtaacagaaatctgttctgaagtcctagaagcattttcttcctttttggattccgtcttatgactctaaatggtgcaaggaactcctgtattttctttgctgkgctccaagtgtcaacctaaaataacaacagagagaaggactcttcaaagaaatgaatctgtttggaaataaacagagaattacaatttcagatgcgcataccatagataatcatcccctacatatctggagaagttgtagtaaggggaaacttttaaagggaaagaggagaagtccatataagctgttttgagacaaacatcattggtcacaggggcctgttgtaggagctgatgttactggaaactcattgctaagcgagtgttcttatgaagatggcttatgtgaaactgcagtcttg

SEQ ID NO: 64627 - DNA, 566 bp, Human
ttttgtgtgattgtaaataatgctgcgatgaagaacttcatgtctataactttttctctagttgaatcatttccttaggatttctagaagttgaataacagtacaaaaagtcacataatgttttattaagtctccaattgtgtgtgtgatgtattacggagttctttgtttatgcccgaagaccttaacagcctcttagtagttttaacatagtggtggttcatggtcttctgctcagggaatgcattgctgactgtttattatamctcatcctgcatggaattctttggtcatgggtatcctcatacctaaagtgggaaagattatatagtcttcgagatagagatgagtataggaaaactggattctgtgttttcactgtttttaaagggtaaagtagaaattaatagaacacgttgaggtgatcatttaaatttagcattaagcttgaatctttttttaaaaattacttttttttttttttttaaatagatggggtttgactatattcctgaggctggtctgtaactcctgagctcaagtgatcctccctcctaggctggatg

SEQ ID NO: 64628 - DNA, 577 bp, Human
ttttgtgtgattgtaaataatgctgcgatgaagaacttcatgtctataactttttctctagttgaatcatttccttaggatttctagaagttgaataacagtacaaaaagtcacataatgttttattaagtctccaattgtgtgtgtgatgtattacggagttctttgtttatgcccgaagaccttaacagcctcttagtagttttaacatagtggtggttcatggtcttctgctcagggaatgcattgctgactgtttattatacctcatcctgcmtggaattctttggtcatgggtatcctcatacctaaagtgggaaagattatatagtcttcgagatagagatgagtataggaaaactggattctgtgttttcactgtttttaaagggtaaagtagaaattaatagaacacgttgaggtgatcatttaaatttagcattaagcttgaatctttttttaaaaattacttttttttttttttttaaatagatggggtttgactatattcctgaggctggtctgtaactcctgagctcaagtgatcctccctcctaggctggatgcagtagctcat

SEQ ID NO: 64629 - DNA, 601 bp, Human
tggggtttcaccatgttggccaggatggtcttgatctcctgacctcgtgatctgcccccctcggcctcccaaagtgctgggattacaggcatgagccaccgtgccaggcaaatcttagccttttttagcaccctgttaggttcttttttttttttttttttttgagacggagtctcgctctgtcgcccaggctggagtgcagtggcacggtctaggctcactgcaagctccacctcctgggttcatgccattctccggcctcagcctcccgagtagctgggactacaagcgcccgccaccrcgcccagctaattttttttgtatttttagtagagatggggtttcaccttgttagccaggatggtctcgatctcctgacctcgtgatccgcccatctcagcctcccaaagtgctgggattacaggcgtgagccaccgcgcctggccaggttcatgtttttttaatattctgtgaataactatgtttatttctctgttcacttcaagaggagttctaacatgtctttatttgtgcttccttatagcatatgggtccgtttgtttatagtatctatgggacagacttgggtttcatccattga

SEQ ID NO: 64630 - DNA, 601 bp, Human
atcaagtaagttcataaatattttatactaataggaacttttggggtgggttttcccccccaatcaaaagcactattttttcaaagtcctcgtatacatgtaattttttttcccccttttagttacatgaagaaacctctaggtccaccacctccatcttacacgtgtttccgttgtggtaaacctggacattatattaagaattgcccaacaaatggggtaagttcaaagcagaaactatggtatatcttactttttttcctttggaattgttccttagctatcttatttttcttggttratactgccttctgtagacaatggcaaatgagcatggtctctggagccaaatttgccaggcttcaaatcttggttctggcacttggctgagtttgggcaagttacttgatctctataagcctgttttttcttctctaaaatggagataaaatagtacgtacttcacatagcagttacaaggattaaatgagatcacatatgtaaagcactacaagtaatatagtaagcactgtataacattagctaatttattaaataaagataactgctttttctcttcctcctcctcttcctttttcct

SEQ ID NO: 64631 - DNA, 601 bp, Human
tctacaaaaaactggacctagaatgtctaatgaggtgttactttacatttttgtaacaccgattttgatcatttaagtcactaatgcttcttaattgactataaattgattaacctctcttaaaatactaataagtagatcatgggttttggtatctcattttattaattatttgtgtggtaatgacataatatttcccttgaactatctttccttaattgtataatgtcagtactaattttaatttcccgtcttgtggcatttactccaataccttcacaggtttgagagacttttgggwtatggagaaggggagattttttgggatttttaattttaattttcatttttatttttttcaagaaacttgatagagtaggaaaaattgtgattatggtgttgtctaaattcaagtcttgtctttgtcacttaaatagaactttatggcacagaacatttcgctttatttctggccctcagttcttaagagtgacgggttctaagatccttttattgtttttgtagcatttctttgcttctttttgttatgcttgtttagacttttgtgtctttgtttagggttaggttgtacataattact

SEQ ID NO: 64632 - DNA, 601 bp, Human
aaaaaaggtgtaagaggcccatttcagacacactgaagcaaaatctttaggatgagacctttacatttacatttaagaaattccactgatctggtggaatttatttggttgatagtggaaataggcccagagagttctatggctgacccaagattatcctttcagtttagtggtagaactagagctaaaacttaactcttaatcctagggggatttttgtcttcataggccagactttgattttaagttttactattcttgcaactgatttctgtcataactgtagtatcttcttaaggaggtccttcattttacttttccacttactacatatagagaactcttcaaagtttcagccttctctcactttcctcagaagtattcatcatctttgacttaactcatcttaactgcaggtgatgggtaaacagcagcaaacttttttactcttaattgtccatttctgataatttttaatgtattataatttatgttttttaaagggattctgataataaaatattgccagctgcagctcttgcatcagagcactcaaagggaacctcctcaattgcaattaccgctcttatggaagagaagg

SEQ ID NO: 64633 - DNA, 601 bp, Human
agcttatatgagggttttttttaaatgagcaaatcttttctaaaatacaaaattttaaaagtttttttctactttcatatccaacaaatggggatcttgacaggacttcagtttaatgaatagataagaattacttgaaaagttattttaaatatggtggcagttattttcctagtaggtttaactttttctacccttaatttggatgatcaaagtttgatttgagtacataaatacataataagattaacgtctaccaaacaaaaattttttgtctgaaatcgagttgttcttgccaccmtaaaatacaaagaactttgattttctctgtgggatattttatggcattaaaaatcagcagacttacttaatgtatttttagttatataattatttctgtttatataatccgattgaaaattgatatattcttaaaagtatgagttactagcaggatgtatcagtagaaggaacataggatttagaaacaggtagacttgggtttgaatcccatctccttcatttcctagctgcatgacagtggtcttgtggttttactccctaacatccatttcctcgtttggatttggaatgacactac

SEQ ID NO: 64634 - DNA, 601 bp, Human
cgggtacaagcaatattaatctaagaagtaagaatcttactgtctaggtcaggggtccccaaccctgggccacagaccagtatccatccttggcctgttaggaactgggcaacacagcaggaggtgaacagcagctgagcgagcattaccacctgagctccacctcttgtcagatcagcagtggcattaagattctcataggagcatgaaccctgttgtgaactgcgtgtgcaaaggatctgggttgcacgcttcttaggagaatctaatgcctgatcatctaaggtggaacagtttttamccccctgcccccgtccatggaaaaattgtcttccacaaaacagctccctggtgccaaaacggttgagaactgctagtctaggtcataatcaccaccaggataaaggagcctccaaaacttcataacaagagttttggccaggcataatggctcatgctggtaattttagagctttgggaggctgatgggggaggattgcttgaggcctgaagttcaagattagcctgggcaacatagcaagactctgtctctaccaaaaaaataaaataaccagacatggtggcatgcacctgtggtccc

SEQ ID NO: 64635 - DNA, 601 bp, Human
attttaaaagaaggtaatagttattcatggctcactgaaaagatgcttaaaatctaaacccctactgttgctgttgtgtaccaattatttataatttaaagcacctctagtttaacagaagtaaccagttctgtttggtgaggcacaaattagaaacttagccaacactgttatttttacttaagcttttgagagaaagcgttgatattttcattgttaattatagaagttaaaactagaatttattctgctttgtatgatctttacccacttcctccctcaaaaaagaggttacaggagktggttttccttcatttaaacttttggggccaggtgtggtggctctcacctgtaaccccagcactttgtgcagatcacctgaggtcaggagtttgagaacagcctgcccaacatggtgaaaccctgtctctcctaaaaatacaaaaattagctgggcatggtggcacacgtctctagtcccagctacttgggaagctgaggcaggagaattcgcttgaacccaggaggtggaggttgcagtgagccaagattacaccactgtagtccagcctggacgacagagtgagactctgtctcaaaa

SEQ ID NO: 64636 - DNA, 601 bp, Human
taacaggtagtaattagtggagtgataatcagtctgaacttcataaaagagaacttttaaatacaatatttccgtgtagagaaggtcctataaacttgcatcatctcagtcgagacatggccttaaaaattatgttgtagagttatttttacaaataaattgtactaatgttgctacactagttgaatagttggttctattccactgtttttaagtttgaaaataattatggatagaagagataagcttacttgtctcagatgactttagtttgaagaagtaatatcttggaatttatttytccagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatc

SEQ ID NO: 64637 - DNA, 601 bp, Human
ggacggcgactggaaaagggcagagggcacccctgagggtccagccttggttcaggcccacagacgtggctcccgttgcttgaaaatgtatcaaatgtgagtaagatattggggggggccttccgtagtcccggatgagggtgaactaaccttgtctcagcagtctttcctgtggcctctggactgaccccgagtccctgcctggccagttactagcaagatgctctggtgcaagcaaattggccagcctcagttttctcttctgtgaaatgccccttcctttgtgaactatgaggccctyctcatctccctaggacacactaaatatcagtgtcagcattgtacgggattatgtatctgtaccattagatccaggtcttacaaatagtaacctaaaagcatacaaatagaccttgtctaagaacagggtcccggcacggtggctcacgcctgtaatcccagcattttgggaggccaaggtgggcagatcacttgaggtcaggagttcaagaccagcctggccaacatggtgaaaccctgtctctattaaaaatacgaaaattagctgggcatgatgacgcacacctgtaatcccagctac

SEQ ID NO: 64638 - DNA, 601 bp, Human
tccaggtcttacaaatagtaacctaaaagcatacaaatagaccttgtctaagaacagggtcccggcacggtggctcacgcctgtaatcccagcattttgggaggccaaggtgggcagatcacttgaggtcaggagttcaagaccagcctggccaacatggtgaaaccctgtctctattaaaaatacgaaaattagctgggcatgatgacgcacacctgtaatcccagctactcgggagactgaggcaggagaattgcttgaacccgggagacagaggttacagtgagccaagatggggccrctgcactccaacctgggcaacagagcgagactctgtcttaaaaataaatacatacatacatatacatatatatatatatacacacacacacatacacatatatatataaagaataaagctaaattagtccttttttccccatttttaaaactctagataattgttataatctgctatgtgtgtgctctgtgtagatgaacatctttgttgagcacctactatgtatttggtttttggatatatattatctaattccttaaaaacatggtgaaattgttattagtattcccattttacaga

SEQ ID NO: 64639 - DNA, 601 bp, Human
acaaacagagacttccagattgaggatgtcaaagaaaaaacctttccaatacactaaggaagaaaagttagtgaaagaggtttagttttctcaataaaggtcaattgctatttttaaaataaggaaaggaggctttgaagtatgaagttacctgccatggtgacagaggcagaaatggaggaaccaaggatggtgcccggggcctctttccagcacatcatccttcccaatagaagacagcttattttatcgataggcctagcaggatacagagagtgaatcagagaaggctggagtttcygaagctttattgaacacttgccatgaaagttttaggcttatgggagctattcaaagaaagaaaagaggtcatgtagtttatttgaaagtgtcttgtttctccaagactccattcgtatcttgtttctttctttctttttactgttatattggagaaatgcttgttcaatctataggataaaatagttctcagtacagatgattgaggggttggggtgggataaattcatttcaactctgatttgtttacgcacaacatttcaggagtctattatgtcaaatgggatgtatctaaaatgga

SEQ ID NO: 64640 - DNA, 601 bp, Human
tgagcaaagaatagtaacctataaaaatgtgactaaattatgtggggatgccaaagtctgtacaaaattctcttggtctcaatttctcatccttgaagataaagatgttgttgactttctagtacagggagtgtctttcatatgggagtttcaccttctgattttaagaaacagcagggaagtcaaagtgatcttcttgcccctgctgtttttcaagtgcctttaactcaaatagtcaatatgtcagaagagtatattttaacacctttactaatataacaaaaaatccaaccacaatgtrgtagaataagatttaatgtaagtagttttaatgtagttgcattaaactaaactagaagtaaaatagatgaacatacacacacaatttaagttttatccaggacagcacatgcctactatgtgccacaaattgtggcctctgcccctgaggagcttgcaaggtaatggaggagatagacaggtatctaaataaattagttctctttaattatggtacgtgctaagataggaagatgccagggtgctctgaggatactggcaggagggttcactctgacctgaagacataagtaaggcttcc

SEQ ID NO: 64641 - DNA, 601 bp, Human
catctgtatcttattgcagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtggtgagcattccattttgaatttttaaaacttggtgatcttttggtatttttgatcttttggtatttggtgttaaacagaaacccaaatacaggttaatgttctttcttttcccaccacattgaagtattttatcttgataccgacctgagagcttcaatgtgagttcagaaactggaatcttatttggcaagtctctctctctctctctctcgccattaaaaccatttatctgttgtccttaactccagtggcagaaaaaatggatctctgcaggtgggtctttatgctttttt

SEQ ID NO: 64642 - DNA, 601 bp, Human
attctcaagtcacaggtcttccccttggtacaaccttgtttgtctgcaaactggcctgtatcaatagtgatgaaattcaaatatgtggagcagagatcttcgttggtggtgagcattccattttgaatttttaaaacttggtgatcttttggtatttttgatcttttggtatttggtgttaaacagaaacccaaatacaggttaatgttctttcttttcccaccacattgaagtattttatcttgataccgacctgagagcttcaatgtgagttcagaaactggaatcttatttggcaagcctctctctctctctctctcgccattaaaaccatttatctgttgtccttaactccagtggcagaaaaaatggatctctgcaggtgggtctttatgcttttttgacttaggagaatatgtttaaagctacagcctcctaaaaagaaagaagagatgtctttttagacttatgcagcccaggatgactacacagagttgaacagcacctctcgtcctatctaacttaatgcctcccaaaatagttcttccatccatgctcacccggaccactggttctcatacttaacagaaggtaaaagaaa

SEQ ID NO: 64643 - DNA, 601 bp, Human
aaaaaaaaaaaaaaaaaatctgctaacaattcatgggaagggggcatggggcagaggagttacacagccccagggaggcaagagggaaggagtgagccaggaaagggacaaaagcaaatgccaggtggtaacatcactggactggccacagcttcaacagaaaatgcagctggttgtttatacacttagggacattcccagaaagagcatatagaaatctcatgacaagagaaagaagaacttaactatctcccactggccaaagtccacctgacgggggctcagtttcccacactgctgrcttgcattgctggtcccttcaggcagctgctgggggattagaactaaagtgtcagagttgacatctgcagcatgagccacagtgcacaggatgaaccagcagccagcagcacacctacctgcagttcgcaacctgtggcccatagccttgcaggtccaaccaggcaatcctataagcaagcatgggccctgagggattccatggcaccctgtgcctcagtggttccaaggaagctttggcgtggcagacaagagtcatgaagagactaggaagaattgctctagcaggctggctgaccaa

SEQ ID NO: 64644 - DNA, 601 bp, Human
ttcagtgtagacaatagctaggacttctgtagtatactcattttatctaacctaaaggaaatatgtatctacacgtgggtctgggtattagggtaaaatgggatgactgaatagctgagtatttctcttacctccattttgtccaaaaaattcctagtttgggtcctttcaccataaaatagctttatttaaaaatacacaccttacaatagaagggaccatgcttgctttgtacatctttgtatttccacatctagcactgtgcttggctcgtgggaggtactcaatgcctatgtacacmaaagaattaatttataaatgtccataaagtgctccaagagacaatgcagaaattagatttagatggtatagcccgggaggacatgactgaggcaactgggtgtaagtgtcttgacagcaaatatcaggtgaagaaagcaaataagtctctcatttttaaaggtttctaatatttgaatgggcatcactctaaaagaaattaatttattattaccaggggtaatggagctagcactggatgttcacctgtcagggaaaatggtagaatatggagtaaaaggcttggacttgagttacagct

SEQ ID NO: 64645 - DNA, 601 bp, Human
actctagtagggttaaactggctgcataagatcgcttctcttttctgcagctgtaggctcttggggtcatgatacataaataaactcttccttgtggtagtttcccattcgcttggataagtttctttttaaagcaccattggctgacctaagagtccatgagaagagagagtctgggagattctgttccttgaagtagatttcatgatcccattaaagatccagctgatttgtgctattcctgagtgaggaggagatggaggaaaggaggggttctgtagtacatttactttttctaacytaaaggaaacatctattgacacgcgggtctcagtattagggtaaaatagcccaggattctactctggccactgctgtactaggaactgacaattctgtgccacagatgtcaaggtggccacagtgcttaggataatgtttggaactgccctggggagccaagatgacaagcagggtttggggaatttcagcagcgtaggcttggttacctatctacatgaatgtggaagaacatctcagttctaccaaaaaagggagttgggtgaagtatagtcttacatgaccatatagtacaaatatt

SEQ ID NO: 64646 - DNA, 601 bp, Human
ttggtagtagttatttggtgaaaatgagatttgattaagggggattattttaaagattcagaagtgaatccagcttttaaaaaagttctttcttaaagcctggaacttttctcttgtatattttaccaaatttgatggttgtgcatctcagaactgagttttgtcaaactctttatagctcatgccagtacataagacaattgctgatcacagatcctgaaccacacttttttgtttgtcctggttactagtgaggcctcttcctccgtgggacattagaatcaaatttcaaaaggcttcygtgagcagatgtaccctttattggagagatgagggactggtactgcttaatcgactcagatatcggcccagtaacagcaggctctggaatatggtaattatctttagagtgaaggaaaaaacactgaagcattcttaatattgctgcgcagacctctgtcttttcatacagcaaaaaatagagtttaagaatatttatcccaaaagtacacacgagagaattatcagaaagtcatgtatgcctctgttgattaagaaatatcttgaattttgatctctgattctgaaatttttaaagctt

SEQ ID NO: 64647 - DNA, 601 bp, Human
agaggattcatttctccttattatttaccctgtcctgttattattttttagcatttaaaaaagatattgaaaagagaaatattaagaaatgtccacagagagttatatagaatttaatattccaaagaaaaggtctacaatttaatataatattaggcattgcatgttttaaaataaaaggtataggattatgattctttccgggattgttgtaaaattcaatggcttataataacaaaggatcagtcccacagatagctgatattcaagagagtataactaattaaagggtttttttttwtaaaaaaaaagccagtgctatgtttgtgttaaaacattcatcacatcctaattgtaatcaaataaaaaataatctctagtgtagaaactttgtagttttcaatcttatttttcagctggtttcaggattcccctcgagaacctacatagatgggttcttagtacccagagattttgttttatttttaatgagatgctatcatttcagattaatatcatatctattcggtaagacagtcactgatatttcttctcatttaatggtaggtctgaaaaacaaataagatcaaatagcctgggt

SEQ ID NO: 64648 - DNA, 601 bp, Human
gaggattcatttctccttattatttaccctgtcctgttattattttttagcatttaaaaaagatattgaaaagagaaatattaagaaatgtccacagagagttatatagaatttaatattccaaagaaaaggtctacaatttaatataatattaggcattgcatgttttaaaataaaaggtataggattatgattctttccgggattgttgtaaaattcaatggcttataataacaaaggatcagtcccacagatagctgatattcaagagagtataactaattaaagggttttttttttwaaaaaaaaagccagtgctatgtttgtgttaaaacattcatcacatcctaattgtaatcaaataaaaaataatctctagtgtagaaactttgtagttttcaatcttatttttcagctggtttcaggattcccctcgagaacctacatagatgggttcttagtacccagagattttgttttatttttaatgagatgctatcatttcagattaatatcatatctattcggtaagacagtcactgatatttcttctcatttaatggtaggtctgaaaaacaaataagatcaaatagcctgggtt

SEQ ID NO: 64649 - DNA, 601 bp, Human
aggattcatttctccttattatttaccctgtcctgttattattttttagcatttaaaaaagatattgaaaagagaaatattaagaaatgtccacagagagttatatagaatttaatattccaaagaaaaggtctacaatttaatataatattaggcattgcatgttttaaaataaaaggtataggattatgattctttccgggattgttgtaaaattcaatggcttataataacaaaggatcagtcccacagatagctgatattcaagagagtataactaattaaagggtttttttttttaaaaaaaaagccagtgctatgtttgtgttaaaacattcatcacatcctaattgtaatcaaataaaaaataatctctagtgtagaaactttgtagttttcaatcttatttttcagctggtttcaggattcccctcgagaacctacatagatgggttcttagtacccagagattttgttttatttttaatgagatgctatcatttcagattaatatcatatctattcggtaagacagtcactgatatttcttctcatttaatggtaggtctgaaaaacaaataagatcaaatagcctgggttt

SEQ ID NO: 64650 - DNA, 601 bp, Human
ttaaaaaaaaagccagtgctatgtttgtgttaaaacattcatcacatcctaattgtaatcaaataaaaaataatctctagtgtagaaactttgtagttttcaatcttatttttcagctggtttcaggattcccctcgagaacctacatagatgggttcttagtacccagagattttgttttatttttaatgagatgctatcatttcagattaatatcatatctattcggtaagacagtcactgatatttcttctcatttaatggtaggtctgaaaaacaaataagatcaaatagcctgggttttttttttttcattttatgttaaaattccttaaattagcaatctagtattaataggcactttaaaaaaatgtctgtttcaaggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaaggtatatgtccaaaatatacatacctatcggggagcaataaaggggagagaggggggaagatgtaat

SEQ ID NO: 64651 - DNA, 601 bp, Human
tagcagggattacatgcatgcgccaccatgcccggctaatttttgttattttcagtagagacaggtttcaccatgttggccaggctggtctcgaactcttgacctcaggtgatccacctgcctcggcctcccaaagtgctgggattacagaatatattttaaaaattgtctaaaagtgaatttatccaacaaatgataatttattaccactcattttataataaaatctcttaatgttgaaccacttgccctctggttgttacttttataatccagagcttactcataatatcgttttatkatatatagtcaaagtaatttttttaaagactatctcatgaattagattttgtttatatatgtggtacagataaaacttctgaaaatgggctatattttatatccaagttcaaggtagtaagtagtctgaaaaatatttaagttatatcacattaagctaaactataaactagggaaactctgggcttgtgaattcttgtcattcttactcacatatgataatgacctagttagagatgtgtgaaaaggtttttcttttcttttttaaaaagtgtttgtcttttgaattaaaattccttca

SEQ ID NO: 64652 - DNA, 601 bp, Human
ggagaaaccttcccccatcatggtgacagcaagggtgaggggtgaataatccctaaagggggagaaaatgaagagttaccagctgcagccacctcttcccacattgagaagctaggaaattcatgcactcatttgtaatttaaaaatattgccaagataagataggtgtgaacaattaaatactagagattattttggatagcaaacatttgataacagtcaagcttggtggattggcaaacattttctctacaggtccagatagtaatattttcagctttgcggatcatacgatctgtcrcaactgctaaatgtgctattgtcacatgcaagctgccattgacaatacctaaacaaacaggcatggctgtgttccaacaaaactttatttatgtatgctgaaattggaattttatgtaatcttcacatgtcactaaaaaggattcttcttttgtttgttttgagacggagtctggctctgtcacccatgctggagtgcagtggtgcgatctcggctcactgcaagctccgcctcccgggttcacgccattctcctacctcagcctcccgagtagctgggactacaggcaccccgccacca

SEQ ID NO: 64653 - DNA, 601 bp, Human
ttgcggatcatacgatctgtcgcaactgctaaatgtgctattgtcacatgcaagctgccattgacaatacctaaacaaacaggcatggctgtgttccaacaaaactttatttatgtatgctgaaattggaattttatgtaatcttcacatgtcactaaaaaggattcttcttttgtttgttttgagacggagtctggctctgtcacccatgctggagtgcagtggtgcgatctcggctcactgcaagctccgcctcccgggttcacgccattctcctacctcagcctcccgagtagctggkactacaggcaccccgccaccacgcccggctaattttttgtatttttagtagagacagggtttcaccgtgttagccaggatggtctcgatctcctgaccttgggatctgtctgcctcagcctcccaaagttctgggattacaggcatgagccaccgcgcccggccggattcttcttttgatttcttttcaaccattatcaaaaccattttcttacaggatgtattaaaacaggcagagggccagatttggcccatgggccgtagtttgctgacccctaagctagctatactcgaaagcatc

SEQ ID NO: 64654 - DNA, 601 bp, Human
tacgatctgtcgcaactgctaaatgtgctattgtcacatgcaagctgccattgacaatacctaaacaaacaggcatggctgtgttccaacaaaactttatttatgtatgctgaaattggaattttatgtaatcttcacatgtcactaaaaaggattcttcttttgtttgttttgagacggagtctggctctgtcacccatgctggagtgcagtggtgcgatctcggctcactgcaagctccgcctcccgggttcacgccattctcctacctcagcctcccgagtagctgggactacaggcrccccgccaccacgcccggctaattttttgtatttttagtagagacagggtttcaccgtgttagccaggatggtctcgatctcctgaccttgggatctgtctgcctcagcctcccaaagttctgggattacaggcatgagccaccgcgcccggccggattcttcttttgatttcttttcaaccattatcaaaaccattttcttacaggatgtattaaaacaggcagagggccagatttggcccatgggccgtagtttgctgacccctaagctagctatactcgaaagcatcatatttgtgt

SEQ ID NO: 64655 - DNA, 601 bp, Human
aatatcacatgatttgttcattcattacttaacaattattaggagcctattatattctaagtgctgcgctgggtatgtggcatattaaatgagataggacttccctttaagtacatcattgtctaatgatcacacaccaaataattgtactataccatgataagtctaggaatggagatgaacacaaggtttgtcatttatattagtgtatttttacaagaccaaaaagtgtttttctatatgagttgtatcttctctgttgagaattctttctgcattctagtaaaaaaaaaaaaaaaagaaaagaaaagaaaagaaaagaaccacatatactttatttttatttttttgctctgtcttatggtgctaaagccacatgtactttccttgggttattttaataacacatgttttaagagtaagttaaggccgggtgcagtggctcatgcctatgtaatcccggcactttgggaggccaaggtgggtggatctcttgagctcaggagttcaagaccagccggggcaacatgatgaaagcctgtctgtataaaaaatacagaaattagccaggcgtggtggtacgcacctgtagtcccagcta

SEQ ID NO: 64656 - DNA, 601 bp, Human
taagtctaggaatggagatgaacacaaggtttgtcatttatattagtgtatttttacaagaccaaaaagtgtttttctatatgagttgtatcttctctgttgagaattctttctgcattctagtaaaaaaaaaaaaaaaagaaaagaaaagaaaagaaaagaaccacatatactttatttttatttttttgctctgtcttatggtgctaaagccacatgtactttccttgggttattttaataacacatgttttaagagtaagttaaggccgggtgcagtggctcatgcctatgtaatccyggcactttgggaggccaaggtgggtggatctcttgagctcaggagttcaagaccagccggggcaacatgatgaaagcctgtctgtataaaaaatacagaaattagccaggcgtggtggtacgcacctgtagtcccagctatgtgggaggctgaggcaggaggattgcttgagcctgggaggtggaggttgcagtgagctgagatcgtgccactgcatcactgcattccagccgaggcaacagagcaagatcctgtctcaaaaaaaaaaaaaaaaaaaaaaaaaaaaaaaaaaaaagtaag

SEQ ID NO: 64657 - DNA, 601 bp, Human
accttatccagaactgctgcatcgtgactcatctttgttgaaggaaaatgctgtgcgattcgaattgagctactgattggcatgctcataagaggtttcctggtgaactgcactctttatttctcaggactcacatcctcttcactacacctcttccagttgaggatagaaagttttggaattatgaatctgaatgagcacaaaaccagaagagtaagaataacaattataaagtcctctgatggggttcacatgatgggttttgatcattgcacacttcttcagttttaagaaatgagtkatttcttcttctttctcctccctgtctctctcacacacacataaaacgtctggtataagaagagactactataaatagcctggtgaatcatgatcaggctcttcactttgaaactaacactgcagctcaaaatttattttaaaatgaatctactttcaatagcaagacaattctcaaagcaggacatttagaacagccataatttgtgaatattatagaagaacccagcctaattatttccttttcacgagcaagtgactggttaaaaccaaaattcctcctctcatgtaaaggtttctc

SEQ ID NO: 64658 - DNA, 601 bp, Human
agtaagaataacaattataaagtcctctgatggggttcacatgatgggttttgatcattgcacacttcttcagttttaagaaatgagtgatttcttcttctttctcctccctgtctctctcacacacacataaaacgtctggtataagaagagactactataaatagcctggtgaatcatgatcaggctcttcactttgaaactaacactgcagctcaaaatttattttaaaatgaatctactttcaatagcaagacaattctcaaagcaggacatttagaacagccataatttgtgaatrttatagaagaacccagcctaattatttccttttcacgagcaagtgactggttaaaaccaaaattcctcctctcatgtaaaggtttctcctccaaaaatgtcctcaacagtgatctggaaagatatgctacgtgttaatctattccacgcctctcaactcaagggtttctctcagtagaatgagggtaatgatacaggtatctgcaaagctgacaagaccattgtggggatcagcaaatgagaggacacaaatgtaaaaatcacaagggccaccagtgtaaaattcagcagtgctgcatga

SEQ ID NO: 64659 - DNA, 601 bp, Human
cttcactttgaaactaacactgcagctcaaaatttattttaaaatgaatctactttcaatagcaagacaattctcaaagcaggacatttagaacagccataatttgtgaatattatagaagaacccagcctaattatttccttttcacgagcaagtgactggttaaaaccaaaattcctcctctcatgtaaaggtttctcctccaaaaatgtcctcaacagtgatctggaaagatatgctacgtgttaatctattccacgcctctcaactcaagggtttctctcagtagaatgagggtaaygatacaggtatctgcaaagctgacaagaccattgtggggatcagcaaatgagaggacacaaatgtaaaaatcacaagggccaccagtgtaaaattcagcagtgctgcatgatgcgtgtttatcctgacagtgaaagctccatgcctgcgtgcttttcactgtaacaaacagagtttatagtggacatcatcttggttctctgaaaccagcaccagagtgaagtcaaaataagtatgtgttggccatgagtgatgcttggtaaatgtgagtatgtgatttcttctctgctgccctgatttt

SEQ ID NO: 64660 - DNA, 601 bp, Human
aaagccaacctcaaaaccttcagtgactctctagtctaagaggctccccaaggaaagttggatgcagtcctatattgtcacaggattaagtccttttctgtcaaacctgggcttctttaatggccccaaacaggccactcaactgagggtgggaatggaaacactgaccagagttactgagcagtcctgctttggaccacagaaccacagagttatagacctctagagccaaagggatttaactgtcatgtagtctcaccccacagtttaaaacatggaaactgaggtttcaagaggtgattttccagtgaggggatttcaggtgatttgagtccactcttatcccagcctctaatagggattcctcatgccactctcaggcaggcttgggaattcaagggaatgctgtggtacaagggagttatctaagtgtcaggctagaaggaaaactctgcagccagatcgctttgtgacagggcccaagtcatacctcactggggaaagggagcaagggcgtgtgtggtggggttttttgttttttgggttttttttgtttttttttgtttttgtttttttcctttgagcaactctgggaaaccaa

SEQ ID NO: 64661 - DNA, 601 bp, Human
aacctcccaaaatgctgggactacaggtgtgagctaccacacctggcccatagctatttttaagaggaaaaatactttcaatgttgaagccaaaaagtacagcctaatctatgaaatgaaagaaaaacacctgggtattgttaaaaccacaaatgcaataaaagtaaaaaatgttgcttgattacgaatagccccagggttggattaggcccctttacaaaagggggcttttagcaatcctctccctcaaacttcctttctcttctccttctgtactgttttatattgtattctttccttwattaagtatctcaatccatgattccaatatacttcttttctagttaaaacagcatgtatcttttaagaagaaaaccacctttcatatatatatgaaaaagatatgagaaccaggtaaagccacatcaaccgttctagtttcctctcttaatttctttagcatcctctcattatcttgatcatagcaaatcacaaacttttgaaatttgtttgaggccatgagtctggaagagaaatattcatgttaagctcattcatttgctcaaacaaacatatgaaagctcctctttagtattagaca

SEQ ID NO: 64662 - DNA, 601 bp, Human
tgtctctactaaaaatacaaaaatgttagccaggcatggtggcatacggctgtaattccagctactcaagaggctgaggcaggagaatcacttgaacccaggaagcagagttgcagtgagccgagatcacgccactgcactccagcctggacgacagtgtgagactccatttcaaaaagaaaaaaagaaagaaaactcttagttccaaaagtggggaaaagatttagtgttttttatttgttatacgaagtaattcattttgacaaacagctaccctcaaaccacagaagatggaaagaamgagaagatagcaagccccgtataccaatttacggcacagcctgagagagactgttgtgaaaggaacagcttattcagtacattcactttgtctctttctccttgtatctctctctcatatgcagaatattccaacctatatcacactgcactgaagtgatgaattctttggcctcctcatatgaaaaagcttgttaaaagtagaaagtattatttgggacctgatttatattgatgtaggacaaaggtctattgtaaatccctagtgaggattggctgccaggaccttggggcatttata

SEQ ID NO: 64663 - DNA, 601 bp, Human
tccagcagttaagagttcacctcttggtagagctgtgccacctgggtttgagttccagcttcactacttattggctggatgttcttgggcaaagtgcttaaactctctgttccttattttattcatgagtaaagtgcagatcacatgaagttgtgaagattaatgaaatcgttgtgaaaagtgttaagttattgttatgaggcaaacattgtgcatgacattgaaggtgctagtgggaaaatagatccttagatagtttcaatggagtgttttctaaaatgtccaggtgagggttgtctatttttttttttttttttttgcgacaggttctcactctgtcacccaggttggagtgcagtggtgcgatattagctcactgcaacctctgcctcctgggttcaagcaattctcccacctcagcctctcaagtagctgtgattacaggcatgcaccattatgcccagctaatttttgtatttttagtagaaagtggtttcaccatgttggctgagctggtctcaaactcttgacttcaagtgatttgcccacctcagcctcccaaagtgctgggattacaggtgtgagccaccgcgcacggcca

SEQ ID NO: 64664 - DNA, 601 bp, Human
ctacttattggctggatgttcttgggcaaagtgcttaaactctctgttccttattttattcatgagtaaagtgcagatcacatgaagttgtgaagattaatgaaatcgttgtgaaaagtgttaagttattgttatgaggcaaacattgtgcatgacattgaaggtgctagtgggaaaatagatccttagatagtttcaatggagtgttttctaaaatgtccaggtgagggttgtctatttttttttttttttttttgcgacaggttctcactctgtcacccaggttggagtgcagtggtgygatattagctcactgcaacctctgcctcctgggttcaagcaattctcccacctcagcctctcaagtagctgtgattacaggcatgcaccattatgcccagctaatttttgtatttttagtagaaagtggtttcaccatgttggctgagctggtctcaaactcttgacttcaagtgatttgcccacctcagcctcccaaagtgctgggattacaggtgtgagccaccgcgcacggccaagggttgtcttttgaatcacttcatttggactggggttgcaaaaggcagtcatgagttttaaa

SEQ ID NO: 64665 - DNA, 601 bp, Human
acccaggacctaaaatgagtagctaggagttcaggctttggagtcaacagctttcagaggctttttttttcttttccaatcagcctatgagtagccttggacaagtaaatgaacacctctgagcttcaatgtcctcctctctaaaataggaattatattgcctgtctcataggtcattttgaaactaaatattaatacatagcaggtatttaatacattgtagttaaggaaatactagttacattaaattgaacaccaatatctgactagcttttatagaagcaggagaaatacgtgttaygtttcagaaaacattttacacctaaagtcaaaacgtctttttaaaaccaaagtcggggatggtggtgtgtacctatggtcccagctacttaggaatatgagatgggaggattgcttaagcccaggagttccacgccagtctgggcctcacagtgagacccctttcatcaaaaacaaataaataaataaatacaaccaataatattgaaattctgactaatgaaactatagtaaaattttgttttaccatagccctttattgcacaagtttagacacgtatccaattacctttatcagaaa

SEQ ID NO: 64666 - DNA, 601 bp, Human
agtcaactagtaaaatgtattaaatatttcaaagatccagcccttctactcaagacctcttgaaactacaggaagagtcagaagccagtatggtcataaacacaggctcacagagatggcagagactggggcccaaggaggtgaagtaactgagccaagatcatacatccaatagtggcagagctacatggaaaaccagaccacccttgggtgagcactttttccaaatgccttctgaacgttataacttcatacagaagctctcagtgaaaatggagatgggaagttgaatgattgaggytaaaggaataattttgaaaggtgacagggagaaggtgagttgttagcagacttttgaaggaaagaacatgccccagcaaacatcatgagagaggaaattctaggttggttcctggcaagtgtggtgactcagagacagaagaaccctaggcaatgccaagttgatttacttagctaattccagagaaagtagtggttagaaaggctctttggcttttttacctcaatacttggcaaaggatctcgcaaaccatagtgttcaataaatacttgctgaatgagtaaattttattctcaaaaa

SEQ ID NO: 64667 - DNA, 601 bp, Human
gtagccatcctatcccacttaagaggggaaaactgataagcactggcaagttcccagtacaggagcacagcctcacaaaaagactgggatgtaatcatagggttatagaatgctttctttcccccgacacctttctaccacattactaaaagcccatttactgcatatgcttttacttagtaaatcatatccacctttcaacaaaaaattataaggcattctaaaaggcaaaaaacaaacaaacaacaacaaaacaacagttagttgagatacagcaagcatcagaaccatacttggatayggcagggatgttggaattatcagaccaggaatttaaaacaactatgtttaatatgctaaaggctctaacagataaagtagaaaacctgcaaaaaccgatggacagggtaatcagagaaattagaattctaagaaagggtcaaaaaagaaatgctagagatcaaaaacagtgtaacaaatgaagaatgtctttgatgggtgattcgtaaaatagacatatctgggggaggagtttttgagcttgaagatatgtcaatagaaaccgctaaaactgaaaagcaaagagaacaaagactgaaaa

SEQ ID NO: 64668 - DNA, 601 bp, Human
ccacattactaaaagcccatttactgcatatgcttttacttagtaaatcatatccacctttcaacaaaaaattataaggcattctaaaaggcaaaaaacaaacaaacaacaacaaaacaacagttagttgagatacagcaagcatcagaaccatacttggatatggcagggatgttggaattatcagaccaggaatttaaaacaactatgtttaatatgctaaaggctctaacagataaagtagaaaacctgcaaaaaccgatggacagggtaatcagagaaattagaattctaagaaagrgtcaaaaaagaaatgctagagatcaaaaacagtgtaacaaatgaagaatgtctttgatgggtgattcgtaaaatagacatatctgggggaggagtttttgagcttgaagatatgtcaatagaaaccgctaaaactgaaaagcaaagagaacaaagactgaaaaaacataacaacatatacaaaatctgtggaacaactacaaaagatgtaacctacacataatggaaatatgagaaggtaaaaaaaagaaaggaataaaagaaatatttgaaacaataatgaatgagaatttatcaaatt

SEQ ID NO: 64669 - DNA, 601 bp, Human
caaaatagagattaaacaacacacttctaaataacacattggtcaaagtctcaagagaaattttaaaatattttgaactaattgaaaataaaaataaaacatcaaaatttatggaatgcagcaaaatcagtgcttagaggaaaatttataacattgaatgaatacattagaaaagaagagaggtctaaaatcaataatctaaacttttgccttaggaaactaaaggaaaaatggatcaaataaccccaaagtaagcaaatagtaataataagagaggaaatcaatgaaattcaaaactggrataaagagataaattaatgaaaccaaaagctgattctttaaaaagatcaataaaatttataaaatttctagccaggttaactaaaaaaaagagagaaagaggatgaaaattaccaatatcataaataaaaaggggctatcatcactgatcccatggacatgaaaaggataataatcaaatactatgaacaactctgtgcccacgaatttgataatctagatgaaatggaccaatagtcagacattacaaagcctggtaacatgaacagtgttttctggtaaagtggccaacccagacaca

SEQ ID NO: 64670 - DNA, 601 bp, Human
catgtgaacttatgtcattcttttttatcatctctgtagtatggcatcataagggcttatggtcatttgttgaacaaatacaccattgataaacagaacatatcactgatcagaactgcttccccctggacttgacccagagtcagtcagttctgaaatgcaccccaagaggtaaggaatcaattgatctcttcttcagccatctggaattcctcatgtgaaatttgccccccaaataactttcattttggcagagtttaaattgagatacctgtttgcaaccacatggtctgtttattctttttttttttttttttcatacggagtcttgctctgttgcctaggctggagtgcaatggcacgatctcagcttactgcaacctctacctcccgggttcaagtgattctcctgcctcagcctcctgagtagctgggattacagacatgtaccaccatgccctgctaatttttgtatttttagtagaggaggggtttcaccatgttggccaggctggtcttgaacgcctaacctcaggtgatccgtctgccttggcctctcacagtgctgagattacaggcgtgagccacccagcccagcctc

SEQ ID NO: 64671 - DNA, 601 bp, Human
tttgccccccaaataactttcattttggcagagtttaaattgagatacctgtttgcaaccacatggtctgtttattctttttttttttttttttcatacggagtcttgctctgttgcctaggctggagtgcaatggcacgatctcagcttactgcaacctctacctcccgggttcaagtgattctcctgcctcagcctcctgagtagctgggattacagacatgtaccaccatgccctgctaatttttgtatttttagtagaggaggggtttcaccatgttggccaggctggtcttgaacrcctaacctcaggtgatccgtctgccttggcctctcacagtgctgagattacaggcgtgagccacccagcccagcctctttttttttttttttttttttttttttttaacagtaagccatctactttaatagtcaaagcctcttgagtctgttgattcttaaagctgctcttatggatgttgaagaaaatgccttccttattttgtcacaaatctgatgactctaaagcctgcataagggtatttaaaaataagctaaaaggggagggagagtgcagattcacagtcctattttatactag

SEQ ID NO: 64672 - DNA, 601 bp, Human
ctttcctttttaaatattgaggtcctcagcacaggtcacagatcctattgtaatttgtgtttctttttcaacctcaacctcaaagttggcaaaatgaacctcaaaacccactgaaactcggcggggtgcggtggctcacgcctgtaatcccagcactttcggaggctgaggcaggcggatcacctgaggtcaggagttcaagaccagcctggccaacatggtgaaactcccatctctacaaaaatacaaaaatcaaccaggcatgatggcagatgcctgtaatcccaactactcgggaggycacggtgggagaattgcttgaactcaggttgcagtgaactgagattgtgccattgcactccagcctgggtgacagagtgagactccatcttaaaaaacaaaacaaacaacaacaacaacaaaaaacctattgaaatttgtctattttgtttttagttgacacaggctacttctgctagagtgctggccttgactctgccatcctccccagcttttgaaaggtcactccaaaatccaaacccaacaggccactggagaagattgtctattcattaaaggctacctacactcatgtttctta

SEQ ID NO: 64673 - DNA, 601 bp, Human
gcagtgactcacacttgtaatccagcattttgggaggctaaggcaggcagattacttgaggtcaggagttcgagaccagcctggccaacatggtgaaaccccatcactactaaaaatacaaaaattagctgggcatggtggcacatacctgtagtcccagctacttgggaagctgaggcaggagaattgcttgaacccaggaggcggaggttgcagtgagccgagatcgcatcactgctctccagcctgggcgacagagcaagaacctgtctcaaaaaaaaaaaaaaaaaaaaaaaaaaargttccatagccttgaaaacaatttgtaaatttaacatttctcctccagaactcccaaataagcctgataaatactagaaatgttatcatcattggaaataaagggagttaactttagctaaatattttcaaaagcaaaataacaaaaatttattcaaaagattttaccacaaaacacaaaaaagagaaaagaaaattagaaaataaagtaaaaataaaagattttactacaaaaaaataatttgtttaatatgctgtggagtgagatgtccataaatgacgatgtctagggcctattaag

SEQ ID NO: 64674 - DNA, 601 bp, Human
tcaactctaaacttttgacattgtgccttttgcaaaaccttcctctgctacttgtgagccagttttccatgctgttctctgctacactgctgtggacactgcatatacccctgttttcatacatatcccatgtgaattagtctgttctcacgctgctataaggacatacctgagactggataatttatagaggaaagaggtttaattgattcacagttccacagggctggggaagcctaaggaaacttataatcgtggcagaagggaaagcaaacatgtccttcacaaggtgccaggagaragaagaatgagagccaagtgggggaaaggccccttagaaaaccattgattcttgtgagaactcactcactatcatgagaacagcatgaagataactgcccccatgattgaattacctccccgcaagtccctcacaccacatgtggggatcatgggaactacaattcaagataagatttgggtgaggacacagccaaaccatatcatcccactcctgacccctcccaaacctcatgtcctcacatttcaaaacacaatcatgcattttgaacagtcccctgaagtcttaggccattccagt

SEQ ID NO: 64675 - DNA, 601 bp, Human
tgtcttggtaattaacatttggctcctcattacctatgcaaatttctgcagccagcttgactttctccccagaaaatagggttttcttttctattgaatcatcaggctgcaaattttccaaacttctatgttctgcttcctcttgaatgttttgctgcttagaaatttcttctgccagatatcctaaatcatctctctcaagttcaaagttccaaagatctctggggcaggtacaaaatgccaccagtctgtttgcatagcaagagtaacctttactccagttcccaacaagttccttgtytccatctgagaccacctcattctcaacttcattgtccacatcactaccagcattttggtcaaagtcactcgacaagtctctaggaagttcctaactttcccacatcttcctgtcttctcagccctccaagtctctaggaaattccaaactttcccacattttcctgtcttcttctgagccttccaaactgttccaacctctgccttcatccatttccaaagttgcttccacattctcaggtatctttacagcagcaccccactctctatggtaccaatttacttactatattagtctgtt

SEQ ID NO: 64676 - DNA, 601 bp, Human
attttccaaacttctatgttctgcttcctcttgaatgttttgctgcttagaaatttcttctgccagatatcctaaatcatctctctcaagttcaaagttccaaagatctctggggcaggtacaaaatgccaccagtctgtttgcatagcaagagtaacctttactccagttcccaacaagttccttgtttccatctgagaccacctcattctcaacttcattgtccacatcactaccagcattttggtcaaagtcactcgacaagtctctaggaagttcctaactttcccacatcttcctrtcttctcagccctccaagtctctaggaaattccaaactttcccacattttcctgtcttcttctgagccttccaaactgttccaacctctgccttcatccatttccaaagttgcttccacattctcaggtatctttacagcagcaccccactctctatggtaccaatttacttactatattagtctgttctcatgctgctataaggacatatctgagactgggtaatttataaaggaaagaggtttaattgactcataattcagcatggctagggagggctcaggaaacttacaatcatgg

SEQ ID NO: 64677 - DNA, 601 bp, Human
tgggcacacagccaaaccatatcaccatggcatcatggcttattgtttacatgttcacacatctgtatcctatactatattcatgacttctttagacagcagagccatgtcctatttatctttgtatcccagcacctaacagagcctgttacctggttactactcagcgagtgctggatgaattaatggccaattccaataagtagtaaaatgctgtagttcttttcataggaaagaataggcacaatttcaaacatttcaaacatttcacaatcaccctagctagataaaggcttatgcyatactttgctaaaattaatagctactgtttcttgaggacctcctatattcagacacactgccatgtgctttaaatataccatctctgatcttcatgacaaccagcaaggtacatgtcaccattcacattttatagatcaagaaactgaagtccaggccgggcacggtggctcacgcctgtaatcccagcactttgggaggccgaggcaggcagatcatgaggtcaggagttcaagaccaccctggccaatatggtgaaaccctgtctctactaaaaatacaaaaattagccgggcgtggt

SEQ ID NO: 64678 - DNA, 601 bp, Human
atcccagcacctaacagagcctgttacctggttactactcagcgagtgctggatgaattaatggccaattccaataagtagtaaaatgctgtagttcttttcataggaaagaataggcacaatttcaaacatttcaaacatttcacaatcaccctagctagataaaggcttatgccatactttgctaaaattaatagctactgtttcttgaggacctcctatattcagacacactgccatgtgctttaaatataccatctctgatcttcatgacaaccagcaaggtacatgtcaccattcrcattttatagatcaagaaactgaagtccaggccgggcacggtggctcacgcctgtaatcccagcactttgggaggccgaggcaggcagatcatgaggtcaggagttcaagaccaccctggccaatatggtgaaaccctgtctctactaaaaatacaaaaattagccgggcgtggtggcacacgcctgtagtcccagctgctcgggaggctgaggcaggagaatcgcttgaacccaggaggcggagattgcagtgagctgagattgcgccattgcactccagcctgggagacacagtgaga

SEQ ID NO: 64679 - DNA, 601 bp, Human
gccatgtgctttaaatataccatctctgatcttcatgacaaccagcaaggtacatgtcaccattcacattttatagatcaagaaactgaagtccaggccgggcacggtggctcacgcctgtaatcccagcactttgggaggccgaggcaggcagatcatgaggtcaggagttcaagaccaccctggccaatatggtgaaaccctgtctctactaaaaatacaaaaattagccgggcgtggtggcacacgcctgtagtcccagctgctcgggaggctgaggcaggagaatcgcttgaacccrggaggcggagattgcagtgagctgagattgcgccattgcactccagcctgggagacacagtgagactccatctcaaaaaaaaaaaaaaaaaaaaaaaagaaggaaataaactgaagtccacagattacacatctgctagcggcacagccaggactaagacaaggctcccaattcacaactgtactttgcattccgtacctcctttctttctgaccctgtgagtcggaggagccctgtagggccagagctcctcttggaaccatagaattggtccccttagggtcccatttcccgcactgc

SEQ ID NO: 64680 - DNA, 601 bp, Human
ttgggaggccgaggcaggcagatcatgaggtcaggagttcaagaccaccctggccaatatggtgaaaccctgtctctactaaaaatacaaaaattagccgggcgtggtggcacacgcctgtagtcccagctgctcgggaggctgaggcaggagaatcgcttgaacccaggaggcggagattgcagtgagctgagattgcgccattgcactccagcctgggagacacagtgagactccatctcaaaaaaaaaaaaaaaaaaaaaaaagaaggaaataaactgaagtccacagattacacatytgctagcggcacagccaggactaagacaaggctcccaattcacaactgtactttgcattccgtacctcctttctttctgaccctgtgagtcggaggagccctgtagggccagagctcctcttggaaccatagaattggtccccttagggtcccatttcccgcactgcatagacaaaagtgaatttaccttgttcttgagcacagctgcccaggaactgtgggtaaggcccagagggcgcatacaccaatcaggattttgaaatgttcattggtgataactcactcagtcacaggatttcc

SEQ ID NO: 64681 - DNA, 601 bp, Human
gagattgcgccattgcactccagcctgggagacacagtgagactccatctcaaaaaaaaaaaaaaaaaaaaaaaagaaggaaataaactgaagtccacagattacacatctgctagcggcacagccaggactaagacaaggctcccaattcacaactgtactttgcattccgtacctcctttctttctgaccctgtgagtcggaggagccctgtagggccagagctcctcttggaaccatagaattggtccccttagggtcccatttcccgcactgcatagacaaaagtgaatttaccttrttcttgagcacagctgcccaggaactgtgggtaaggcccagagggcgcatacaccaatcaggattttgaaatgttcattggtgataactcactcagtcacaggatttcctaacttttcaggtaaagccaattggatggcgtttgtggcaccaagcatttgcattgctatcatcatggtgggcattttctcaacacattacttccagcaaaagtgagttggttacacctaccaagtgggtaaatgaggcttttaaaaaatgataatagctgttgctgccatgggtcagggaaatggacact

SEQ ID NO: 64682 - DNA, 601 bp, Human
agtttaattcaaaaggagtcaactaggatcacatgcatcctcttcatggaaattgtgaagatcagttacagtgcaggctaaactgccttaaaaaaaaaaagaggacccaaagcacagtggcttaaataatactttatttatcttccatataacagccctgaggtaaggtatccagactggtgggcagctgtgctccatagttatttgtggactcagttttcttccatctttttggcataccatcccttaggtattgtcctcatctgcatgatctctatgagatcacagacacttctgctcrtatttctttggagaaaacctagtcacatggccacatctcttacttcaaaaggttagacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttccttctacatcataaaagacctgtatttcctcttattgccaaatacaatcactgttaatagatatttcagatatttccctataatacttttttcttggcatttt

SEQ ID NO: 64683 - DNA, 601 bp, Human
ctgccttaaaaaaaaaaagaggacccaaagcacagtggcttaaataatactttatttatcttccatataacagccctgaggtaaggtatccagactggtgggcagctgtgctccatagttatttgtggactcagttttcttccatctttttggcataccatcccttaggtattgtcctcatctgcatgatctctatgagatcacagacacttctgctcatatttctttggagaaaacctagtcacatggccacatctcttacttcaaaaggttagacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttccttctacatcataaaagacctgtatttcctcttattgccaaatacaatcactgttaatagatatttcagatatttccctataatacttttttcttggcatttttaacatggttgtgttcaagctatttataccattttgaatcccgtctttttttcaactgttcacataatttacctgtcattac

SEQ ID NO: 64684 - DNA, 601 bp, Human
cccaaagcacagtggcttaaataatactttatttatcttccatataacagccctgaggtaaggtatccagactggtgggcagctgtgctccatagttatttgtggactcagttttcttccatctttttggcataccatcccttaggtattgtcctcatctgcatgatctctatgagatcacagacacttctgctcatatttctttggagaaaacctagtcacatggccacatctcttacttcaaaaggttagacaaattgtaaagcatacttttaaaaaaaaaaaaaaatcaaagcttatsaaagccaagtctttaaaaatgtttcatattgttcatgaactttaaaaaaaataagtcacatgcatttataagaaatgtttttaggatttttccttctacatcataaaagacctgtatttcctcttattgccaaatacaatcactgttaatagatatttcagatatttccctataatacttttttcttggcatttttaacatggttgtgttcaagctatttataccattttgaatcccgtctttttttcaactgttcacataatttacctgtcattacaaactctttgtaaatattctaat

SEQ ID NO: 64685 - DNA, 601 bp, Human
ttatttgtggactcagttttcttccatctttttggcataccatcccttaggtattgtcctcatctgcatgatctctatgagatcacagacacttctgctcatatttctttggagaaaacctagtcacatggccacatctcttacttcaaaaggttagacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttcctkctacatcataaaagacctgtatttcctcttattgccaaatacaatcactgttaatagatatttcagatatttccctataatacttttttcttggcatttttaacatggttgtgttcaagctatttataccattttgaatcccgtctttttttcaactgttcacataatttacctgtcattacaaactctttgtaaatattctaattagctaaatagtaagggtagggaacatgtcatcttcaatgcttggcaggtagcattgtgctggtcacatattaggggttcaatcaatatttgttg

SEQ ID NO: 64686 - DNA, 601 bp, Human
actcagttttcttccatctttttggcataccatcccttaggtattgtcctcatctgcatgatctctatgagatcacagacacttctgctcatatttctttggagaaaacctagtcacatggccacatctcttacttcaaaaggttagacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttccttctacatcatraaagacctgtatttcctcttattgccaaatacaatcactgttaatagatatttcagatatttccctataatacttttttcttggcatttttaacatggttgtgttcaagctatttataccattttgaatcccgtctttttttcaactgttcacataatttacctgtcattacaaactctttgtaaatattctaattagctaaatagtaagggtagggaacatgtcatcttcaatgcttggcaggtagcattgtgctggtcacatattaggggttcaatcaatatttgttgaatgaatgca

SEQ ID NO: 64687 - DNA, 601 bp, Human
agacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttccttctacatcataaaagacctgtatttcctcttattgccaaatacaatcactgttaatagatatttcagatatttccctataatacttttttcttggcatttttaacatggttgtgttcaagctatttataccattttgaatcccgtctttttttcarctgttcacataatttacctgtcattacaaactctttgtaaatattctaattagctaaatagtaagggtagggaacatgtcatcttcaatgcttggcaggtagcattgtgctggtcacatattaggggttcaatcaatatttgttgaatgaatgcatagctggctagtgatagattgctaaatattaggttgatcaaaagttccatggtttatttagcaaacctcaagtggctgtgttgtaattttacagaaaactaccgtagtcttggatgataaatcatctttgtctttcagtgtttat

SEQ ID NO: 64688 - DNA, 601 bp, Human
gttgatcagctggcagatgagagaggggagagtaaaggaagtgaagggaactgctgcagcccaggaaaggaggtgagaaagctcacagtgggcaagatgggccatccctggtggagggtctggaagttgaaagtatctgaatatgaagactacatttaaggggagaaataggagagagaagtggcaagtcaatattcctcccatcacctggggctttgacaactccaggctccctttccaagaccttataacactccttgctcaagatgcttctctccaactaccgagtatgttctgtcayccacacccttcctcaggccagaagccagtggtccatagtcccaacctccactcaaaaaaaaagagtggatcccagccacagattctttaggcatttaagtctctatagtttagtgcctttgaaatcaagcccagaggccacccctgcctctgccacttactatgtgtgtgactcttgggcaacttgcccaactatctgagcccaagtttcagcctcaataaaacaggagttgacagtatcattcttacttaccactgtgaggattaaataagatgccatgtaaagcacatgggtcatata

SEQ ID NO: 64689 - DNA, 601 bp, Human; identical to SEQ ID NO: 33684

SEQ ID NO: 64690 - DNA, 601 bp, Human
caactgcacaaccagcacaactaaaggcttcttcggggctcctcaatccctctgcagggtcacacaggaatattctcatttgttgacactctcttccttcagcttccacaacactgcagtcgacccatctctttgactactgtgatcttcttgggttcctctttctctttccaacccttaaattctcaggccaactcttacttctcccttaagtaaactacccacagtttgaaggcccctttctactactattctaactccaaaccatttctttgacctcagatacacgtttccaatgagctttccatttgttcatgttacttttctccaaggactatacattcaatacactcctaccaaactcattaattaccccatcaaaactttttccttttcccatctttcttgattcctatgaatgggatcaccatttggagggtgcggagagcagagttagccactttctcctcagcatgcacacagcacttcgaatacacctctgttaaaatatctaccacaacggactcttaactgcttaactcttcacctagatttgagctccatcaaaaagctgtgctaagacacagcagaaactcaacaa

SEQ ID NO: 64691 - DNA, 601 bp, Human
cccttcctctaggaactcttcctgactgacccttacttctatcccagactagaataggcatcctaattataggttttcagagcttcctgtaaagcacatgataaaattaagatgcaataattacctgattaaaccatttacatcattatgtttcatggctaggcacaacagttatctgaaaaacaacaggcactaaataaatatttgtccaattaaatgggtgaatagctacttcccggctggactgtaagctccatgagagcaaggactacgtttatcctgttcactgacacaacttccrggactagcattgtggagaagtggcgcttgatttatattttttgaatgaatgaacaaatgaacaaaaccagtgggactgaaaaggtagtgacaaggactacaagtgacatgtgacaaaggaatagtttcaaggagaatggtcaagtaggtcaaatgtaacacagatgattgataaaacacctcttggatttagctgactcacaaagtcataattgcctcagcacaaccagcttcactggaatggtaggaacagaagtgagaaagtgagacaatgaatatcaactacactttccagaaattt

SEQ ID NO: 64692 - DNA, 601 bp, Human; identical to SEQ ID NO: 33685

SEQ ID NO: 64693 - DNA, 601 bp, Human; identical to SEQ ID NO: 33686

SEQ ID NO: 64694 - DNA, 601 bp, Human; identical to SEQ ID NO: 33687

SEQ ID NO: 64695 - DNA, 601 bp, Human; identical to SEQ ID NO: 33688

SEQ ID NO: 64696 - DNA, 601 bp, Human; identical to SEQ ID NO: 33689

SEQ ID NO: 64697 - DNA, 601 bp, Human; identical to SEQ ID NO: 33690

SEQ ID NO: 64698 - DNA, 601 bp, Human; identical to SEQ ID NO: 33691

SEQ ID NO: 64699 - DNA, 601 bp, Human; identical to SEQ ID NO: 33692

SEQ ID NO: 64700 - DNA, 601 bp, Human; identical to SEQ ID NO: 33693

SEQ ID NO: 64701 - DNA, 601 bp, Human; identical to SEQ ID NO: 33694

SEQ ID NO: 64702 - DNA, 601 bp, Human; identical to SEQ ID NO: 33695

SEQ ID NO: 64703 - DNA, 601 bp, Human; identical to SEQ ID NO: 33696

SEQ ID NO: 64704 - DNA, 601 bp, Human; identical to SEQ ID NO: 33697

SEQ ID NO: 64705 - DNA, 601 bp, Human; identical to SEQ ID NO: 33698

SEQ ID NO: 64706 - DNA, 601 bp, Human; identical to SEQ ID NO: 33699

SEQ ID NO: 64707 - DNA, 601 bp, Human; identical to SEQ ID NO: 33700

SEQ ID NO: 64708 - DNA, 601 bp, Human; identical to SEQ ID NO: 33701

SEQ ID NO: 64709 - DNA, 601 bp, Human; identical to SEQ ID NO: 33702

SEQ ID NO: 64710 - DNA, 601 bp, Human
aaccatcaggtttatttactagctgtgtgactgtgaacaagtctcttacaagtgaacttcagtgttttaagatgggagaagccagccatctcctcaatccccagtgcctctacttgactaatagtatgtttcctgctttgcttttccatcatttgaaatctgtgtcatctgtatttaccactcttccttctttatatttgcatcatgactccagtcttttccacaaaacctcatcttcggattctgtctacagtgatccttcctttccttgcctgcatttttattttattatttaatgttytgtcctctaactgctgcatctgtagcaggtgtttcaccaaccacattgtaatcttttccaacataatctgttattcattcaacaaaaacatatattgtgacctccatgtgccattcactgttctaggcacttggagtacagcaggacattcagggtgaacaaaaaagacaaaaatccctgtcttggtggagcttacattccaggtcagcaggggatatgatatctgggaagaatcagttcctactcagtgaagataaatgaaaagtgaaaataggcctggcatagaaaaagttttcctgc

SEQ ID NO: 64711 - DNA, 601 bp, Human
atgagatacctttgaattgggagagttaattcgaacaactgccacatcccctttgactccatagttaatatgggttctggctaaaaagaaaagaaagatttatttgtaaacatatttattgcaacataaatccaaaaagcaatgtaagcatacacattaaaaagaaattaaacttactcagcaaagcagaagaccctgtaaaattgcggcatatataacctgtaagaaaagacatttcaaaattaatttgcgaaacaatttctgtagtaccttttatatataacaaagctgtaatttacawtaataacaacaacaaaaaccccaaatctgtacaatgtattctaggccatatgactactgccatattttttccatttcagttgttaggtcagatgattatttggatactaaaagaggaagactggcccccacaaagggatatacatccccagaacctgtgaatatgttaggttacacggcaaaggggggattaaagttgctaatcagttggccttaataaagaaagtttatcatggattatccaggtgggcccagtgtaatcacaaaagggaagagggaagcaaagagaaccaaagagata

SEQ ID NO: 64712 - DNA, 601 bp, Human
tgtcaggcaagtaatgaagaaaatggattaacaacctcatatttaagatgggtaggcaaattttgagtcttataaacaaagcttgtactctggttcttctctaataagtcacctcctcattctacactataaccaggaggctggtggcacctaaggtcaacaagaggaattcttacgcaagaacctctgctttagaaaactggctcccttggcaatctgtcaaagtttaacataactgtcaaaactgtaaattcatgtaagattactgccagattggtagatttggggaaatatgggatasatctttcccattcaggactagattcataatgcggttagcagaaaaaaactgcaaattaaatgagatacctttgaattgggagagttaattcgaacaactgccacatcccctttgactccatagttaatatgggttctggctaaaaagaaaagaaagatttatttgtaaacatatttattgcaacataaatccaaaaagcaatgtaagcatacacattaaaaagaaattaaacttactcagcaaagcagaagaccctgtaaaattgcggcatatataacctgtaagaaaagacatttcaaa

SEQ ID NO: 64713 - DNA, 601 bp, Human
ctgttagaagagagtaagaaatatcattctcccagcaagtcagtagctttctattcaggcagctttggcccactacaagcaccccttcctttaaaaataggttttctcaaaggagaaactcagggtcatcctcagagtttgaatcatatgtaggctataaacaaataggtctacaaacatttattggcatggaaaaaatctgcataatgttaagaaaaaaatgaaatacaaataagacatataggccaggcatggtggctcatccctgtaatccctgcactttgggaggccaaggtgggcrgatcacttgagttcaggagttcgagaccagcctgggcaacataatggaaccttgcctctacagaaaatacaaaaattagccgggcctgacagcacacgcctatagtcccagctactcaggaggcttaggtgggaggatcacctgagcctggggaggctgaagctgcactaacctgtgactgtgccactgcactccagcctaggcaacagaatgagaccctatcttcaaaaaaaaccatatagtatgatcttagttttgtaaatattattcattgaaactgaattaaatgtgattatccca

SEQ ID NO: 64714 - DNA, 601 bp, Human
cggcacttctgatttgatcactagcccagatttcattcataacttctgagaactctgaatgtagctctttactcagtgtatttacctgccaaagggaaatatatacaggtaagggtttaaatttgaagcactggatgtacgtaccaccatcaaatgctattttgattataagaaatatacttatccggcagaaatatactgttagaagagagtaagaaatatcattctcccagcaagtcagtagctttctattcaggcagctttggcccactacaagcaccccttcctttaaaaataggtyttctcaaaggagaaactcagggtcatcctcagagtttgaatcatatgtaggctataaacaaataggtctacaaacatttattggcatggaaaaaatctgcataatgttaagaaaaaaatgaaatacaaataagacatataggccaggcatggtggctcatccctgtaatccctgcactttgggaggccaaggtgggcggatcacttgagttcaggagttcgagaccagcctgggcaacataatggaaccttgcctctacagaaaatacaaaaattagccgggcctgacagcacacgccta

SEQ ID NO: 64715 - DNA, 601 bp, Human
ctactcgggaggctgaggcgagagaatcactggaacctgggaggtggaggttgcagtgggccgagatcgcaccactgtactccagcctggacagcagagggagactccgtctcaaaaataaataagtaaataaaaatgatcaggtgcaatgatgttccactcaatgtcctttaatttcagtttgtttcatttgctattttgtgaacacacttaggatatggattttgtacttttgaccaaggataactagtatattctgtaattttatacactgagagttgctcagctggcctcatagaarctacatgcattttcctctggatataggtagctactgccaggtacatcagtgtcttgttagactttataaatgttctgtttaatgttaattttttagaagacccaaaattatcttatcaagtggtttttcttctagctgaattatttgtgcctaacaagagactgattactacacataaataattacactttcagtacaaattactaaacctacaatgctggctatcattgtctaaaatacaaagaacataacaaatacccatattttaatggaattgacaacttaacattttaacctatt

SEQ ID NO: 64716 - DNA, 601 bp, Human
gctcacaccataccatatgcggaattgtttttccctccatattctggttaatcaaattctgcttatagtttaggaccaggcacaggttttcttaattaatatagtcatgtgtcacataatgagggggatatgttctgagaaatgtaccattaggaaattttgttgttgtgtgaacatcgcagagtgtacttacacaaacccagatggcagagcctgctacacatctaggctatatgggatagcctattgctcctagtccagcagtccccaacctttttgacgccagggacaggttttgtgraaggcaatttttccaagaactgggggtggggtgggagggagtggtttcaggatgaaactgttccacttcaaatcatcaggcaatagaggccaatggagtgcgcaacctggatccctctcatgtgcagttcacaacagggttccagctcttatgagaatctaatgccactgttgatatgacaggaggcggaactcaggtggtaatgttcactcgcccactgctcacctcctgctgtggggcccagttcctaacaggctatggcctgggaactggggacccctgtcctaaggggctacaaac

SEQ ID NO: 64717 - DNA, 601 bp, Human
tggtgcacgcctgtaattccagctactggggaggctgaggcaggagaatcgcttgaacctgggaggagaaggttgcagtgagctgagatcacaccactgcactctagcctgggctacagagcaagattttgtctcaaaaaaaaaaaaaaaaaaaaatctgtggaattgaaaaaataagtaccaggaataaagtctgtcactgatcctgtacactcatattttatttggttttttaattctacaatgaatgcccatattatgcattttatacaagaaaacagatctaaagagggcatatagsttcacaaaggggatgttagactcaccattttgggcagcctttgtgtgcctcctgctcctggtaaggcccccagcaaaacttcaggggtacctaatactgtttttctgtcttttgttgctattctgtattggcatgaaatggcaacctttgaacaaatgaaagaaaattagaatgttagaaaatgtaacttagtagcaacttgagatggataagggtctaaagattatttataaagcaggaatgtgctcacagaataaactgaaattccttaggctggcatttaataatttctagaattta

SEQ ID NO: 64718 - DNA, 601 bp, Human
gtgcagtggtgcacgcctgtaattccagctactggggaggctgaggcaggagaatcgcttgaacctgggaggagaaggttgcagtgagctgagatcacaccactgcactctagcctgggctacagagcaagattttgtctcaaaaaaaaaaaaaaaaaaaaatctgtggaattgaaaaaataagtaccaggaataaagtctgtcactgatcctgtacactcatattttatttggttttttaattctacaatgaatgcccatattatgcattttatacaagaaaacagatctaaagagggcrtatagcttcacaaaggggatgttagactcaccattttgggcagcctttgtgtgcctcctgctcctggtaaggcccccagcaaaacttcaggggtacctaatactgtttttctgtcttttgttgctattctgtattggcatgaaatggcaacctttgaacaaatgaaagaaaattagaatgttagaaaatgtaacttagtagcaacttgagatggataagggtctaaagattatttataaagcaggaatgtgctcacagaataaactgaaattccttaggctggcatttaataatttctag

SEQ ID NO: 64719 - DNA, 601 bp, Human
agagggtaatgaacacacaagtcagaatagtggcttctttggataaagggaggcaaagaaactgaatgggaggaagtagcccatcagtagatatcaattattgttaatattctcaggttggttgtttcatttattatattactaaaacagacacaagaaactgaaggaaggttatgcatggataatgatacaggtaatttaagaaccaaaaataatgacttgactgaattctgtactcctaatgttctaattataaagcaaaataaaaatcagggtgatgttgaaaatgatttagtattarctattttataaaacttccttccttagaataatgactcatttcttaagagtttgagcttctctctgtgcttcctgtgatattcaagaggttaactgttttttcttttgagatgggagtctggctctgttgcccaggctggagcacaatggcatgatcttggctcactgcaacctcagccccgccaggttcaagcgatcctcctgcctcagcctcccaagtagctggaactacaggtttgcaccaccacacccggctaatcatttttagtggagacagggtttcgccatgttggcaaggctg

SEQ ID NO: 64720 - DNA, 601 bp, Human
aagttgacaatacttgttctcatgacttctatccagtattgtacaaaggtcttagacattgtggtaagtcaagaaaaagaaacaaatgacatctatattggaaagaaagaagtcaaactgtctttacttacagacaacataattatctatgtagaaaatcctcaggaatctattaataaaaaaggctactagaactagtaaatgaatttagctaaaccacaagatacaaggtccatgtccaaaaatctttgtatttctatattctagtgagaaattaaagttaaaaaagtaaaacaacctrcaagtatgaaatacctaggcataaatttaacaaaatgtgttcaagatctattcactgaaaagtaccaaacactgctgagagaaatttaaagacctaaataaacagagaactttaccatgttcatggatgaaatgactcaatatttttaagctgtcaattctccccaaatttatatactgactcaatgcaattccaataaaaatcctagcaggtatttttgtagatatggacaaaatgattataaaatttgtacacaaatgcaaaggaactagtatgagcaaaataattttgaaagaaggg

SEQ ID NO: 64721 - DNA, 601 bp, Human
gaacaagttgacaatacttgttctcatgacttctatccagtattgtacaaaggtcttagacattgtggtaagtcaagaaaaagaaacaaatgacatctatattggaaagaaagaagtcaaactgtctttacttacagacaacataattatctatgtagaaaatcctcaggaatctattaataaaaaaggctactagaactagtaaatgaatttagctaaaccacaagatacaaggtccatgtccaaaaatctttgtatttctatattctagtgagaaattaaagttaaaaaagtaaaacarcctgcaagtatgaaatacctaggcataaatttaacaaaatgtgttcaagatctattcactgaaaagtaccaaacactgctgagagaaatttaaagacctaaataaacagagaactttaccatgttcatggatgaaatgactcaatatttttaagctgtcaattctccccaaatttatatactgactcaatgcaattccaataaaaatcctagcaggtatttttgtagatatggacaaaatgattataaaatttgtacacaaatgcaaaggaactagtatgagcaaaataattttgaaaga

SEQ ID NO: 64722 - DNA, 601 bp, Human
gatggagaaaaggcatgacaaaattcaatactcattctcagcaaacctgataaagagcacatatgaaaaacctacaactaacatcatacttaatactgaatgctttcctcctaagactgggaacaagttgacaatacttgttctcatgacttctatccagtattgtacaaaggtcttagacattgtggtaagtcaagaaaaagaaacaaatgacatctatattggaaagaaagaagtcaaactgtctttacttacagacaacataattatctatgtagaaaatcctcaggaatctattaawaaaaaaggctactagaactagtaaatgaatttagctaaaccacaagatacaaggtccatgtccaaaaatctttgtatttctatattctagtgagaaattaaagttaaaaaagtaaaacaacctgcaagtatgaaatacctaggcataaatttaacaaaatgtgttcaagatctattcactgaaaagtaccaaacactgctgagagaaatttaaagacctaaataaacagagaactttaccatgttcatggatgaaatgactcaatatttttaagctgtcaattctccccaaatttatata

SEQ ID NO: 64723 - DNA, 601 bp, Human
tcccaacaaagaaaactaggagcccaggaattactggttaattctatcaagtatttaagaaataataccaactctacataaaatcttccagaaaatataagaggaggccaggcacagtggctcacacctgtaatcccagcactttgggaggctgaggcaggtaggtggatcatgaggtcagaagattgagaccatcctggccaacatgatgaaacactgtttctactaaaaatacaaaaattagcccaagatctcgccactgcaccactccagcctggcgacagggtgagactccatctcaaaaaaaaaaaaaagaggagagaacacttctcaattcattttatgaagccagcattatcctgatgccaacaccacgcaaaaatatcataagaaaattatccttgagactttatccctcatgatgacataaaaatcctttataatatatgacaacaaaatggagtttattccaagaagcaaggctagttcaatattcaaaaatcaatgtgactgacattattaatagactaaaaaagaagaaaaccccacaattatctctgtagatggagaaaaggcatgacaaaattcaatactcattctc

SEQ ID NO: 64724 - DNA, 601 bp, Human
cacaccaaacctggtacacagccagtgcactgcggtgtcatctgagggagctgcagtcaaggacttgggtctctggggctggctaagctcttacacaaatgtgcattcctagcctagatgccttctattcctaggtctttttatatggggactttggctgaggccttcttcaggtgcctctgctgagaccttgtcaaaggaggaaggggaaatcttttatttatttatttatttttttgagatggagtttcactctgtcgcccaggctggagtgcaatggtacaatctcggctcactgcarcctctgcctcccgggttcaagtgattctcctgcctcagcctcctgagtagctgggaatgcaggcatgtaccaccacgcctggctaattttcgtatttttagtggagatgaggttttgccatattggccaggctggtctcgaactcctgacctcaggtgatctgcccgccttggcctcccaaagtgctggtattacaggcatgagccactgcacctggccggaatgggaaatcttaaagacacttctcccagtctactccactctcctcacccagggtccataaagccgcaggaacctttt

SEQ ID NO: 64725 - DNA, 601 bp, Human
ccagaaatcaaggagagcaaacagaaattacccagttcactattacccctagtgatctaatctaccagcaaaatttctgcttcttgtccctgcaactttgggctctgcctgtctagagggctcagttccaaagggaggaatgcttccaccaggagacacaacaatgattctactgaactgttagttaaaactgccatctggccactttgggctcctcatgccttggaatcaacaggcagcagagggcgggtactgtactggctggggtgattaatcctgattaccaaggggatattaggtygctactatacaacagaggtaaggaagagtatgtctcaaatgtggcagatctcttagggtgtcccttagtactaacatgacctctaattagtcagtagaagatcacaacccagttcacatgggactgctagtggcctagaagacattttaggaatgaaggtcaccccaccaggcaaagaactaggacaaactgaggtacttcctgagggcaaagggaatatgaaaaggggagtagaaatatcaccctttccacaccaaacctggtacacagccagtgcactgcggtgtcatctgagggagc

SEQ ID NO: 64726 - DNA, 601 bp, Human
catcccttaaggacagtggtgaagggatagcctcccagtgggcagtacttctgacagtgcacccggttgttcattttgtctagaaagaaaaatggcctgagctaagggtctactctgattcataggccgtggcaaacggtttgcctgggtggtaaggaacttacagggaacacagatgaaaaactgttggcaaggtgttatgggctgaattgtgtcccccctacctcattcatatgttgaagtcctatcctccagtatctcagaatgtgactgtaattggggatagggcctttaaagaagygattaagttaaaatgaggccattagggtgtaccctaatctaatctgactggtatccttatgagaagaaaaaatttggaaacacaaaagagatgccagggatgtgcagacacagtaagaaagcagtgccatctgcaagccaaagagagatgcctcagaagaaaccaaacctgctaacacctgatcttagacttccagtttccagaaatgcgagaaaacatgttaagtttctgttgtttaagccactcagtctggtattcgttatggcagccctagcaaactaatatacaaggacacctggg

SEQ ID NO: 64727 - DNA, 601 bp, Human
agttgattggtaaagaaaaactcaggcctggtttgtagatatttctgtgtgatacgcaggtaccacctggaagtgcacagctgtaacactacagtcccttctgggacatcccttaaggacagtggtgaagggatagcctcccagtgggcagtacttctgacagtgcacccggttgttcattttgtctagaaagaaaaatggcctgagctaagggtctactctgattcataggccgtggcaaacggtttgcctgggtggtaaggaacttacagggaacacagatgaaaaactgttggcaagktgttatgggctgaattgtgtcccccctacctcattcatatgttgaagtcctatcctccagtatctcagaatgtgactgtaattggggatagggcctttaaagaagcgattaagttaaaatgaggccattagggtgtaccctaatctaatctgactggtatccttatgagaagaaaaaatttggaaacacaaaagagatgccagggatgtgcagacacagtaagaaagcagtgccatctgcaagccaaagagagatgcctcagaagaaaccaaacctgctaacacctgatcttagacttcc

SEQ ID NO: 64728 - DNA, 601 bp, Human
tggcgcctgaagtgtcggcagcagacagaggtgctgtctggagtctttaatagatctctattaggtgaatcacaacacagacccttaggattttagaaaaagccctaccatcctctgtgaataactactctccttttgggaaacagtgtttggcttgttagtgggacttcacagagactcaaagcttaaccatggggcatcaagttactggtgacctgagctgctgatcatgaaacagatgttgtctaacctactaagccataaagtggggtgtacacggtagcactccattatcaaatgsaagtggtatatgtaagactgggcttaaacagaccctaaaggcacaagctgcatgaggaagtagccaaaataccccacggccctgttcttctttgtctcttccagcctgcacctatggcctcatggggagttctctatggccagttgattggtaaagaaaaactcaggcctggtttgtagatatttctgtgtgatacgcaggtaccacctggaagtgcacagctgtaacactacagtcccttctgggacatcccttaaggacagtggtgaagggatagcctcccagtgggcagtacttctg

SEQ ID NO: 64729 - DNA, 601 bp, Human
aaccccagagcaaccattaaaagggaaaagcaaagtaaaaggccagtaatgaagacaaaaaatatatatatttttttgagatggagtctcgctctgttgcccaggctggagtgcagtggtgtgatctcggctcactgcaacctccacctcccaggttctagtgattcttctgcctcagcctcccaagtagctgggattacagatgtgccaccaggccaggctaattttttgtatttttagtagagatggggtttcaccatgttagccaggacggtctccatctcctgacctcgtgatttgyccacctcggcctcccgaagtgctgggattacaggcgtgagccactgtgcccggccaataaaaaattattaatccaaaagaaagcaggaagaagaaaaaaggagcaaagaactgacaggtcaccctggaagggttagaggacgcacccttcaccaccactgtgagaaatcaatttgtgaggtgaggcccagcatctttgctctgtggttgcttctctttgtaggtcagaaattacagtgggaactgctaccatcaactgggatccctaaatgcaatggggataaaggaatcccggggtggc

SEQ ID NO: 64730 - DNA, 601 bp, Human
taaaaccccagagcaaccattaaaagggaaaagcaaagtaaaaggccagtaatgaagacaaaaaatatatatatttttttgagatggagtctcgctctgttgcccaggctggagtgcagtggtgtgatctcggctcactgcaacctccacctcccaggttctagtgattcttctgcctcagcctcccaagtagctgggattacagatgtgccaccaggccaggctaattttttgtatttttagtagagatggggtttcaccatgttagccaggacggtctccatctcctgacctcgtgatytgtccacctcggcctcccgaagtgctgggattacaggcgtgagccactgtgcccggccaataaaaaattattaatccaaaagaaagcaggaagaagaaaaaaggagcaaagaactgacaggtcaccctggaagggttagaggacgcacccttcaccaccactgtgagaaatcaatttgtgaggtgaggcccagcatctttgctctgtggttgcttctctttgtaggtcagaaattacagtgggaactgctaccatcaactgggatccctaaatgcaatggggataaaggaatcccggggt

SEQ ID NO: 64731 - DNA, 601 bp, Human
aatattatcaattgaaaaccggccaggtgtggtggctcacacctgtaatccagcactttgggaggccaaggcaggcagatcacttgaagacaggagtttgagaccagcctggccaagatagtgaaaccccatctctactaatatacaaaaattagctgggtgtggtggtgtgcacctgtaatcccagctactcaggaggctgaggcaagagaattgattgaacctgggaggcagagattgcagtgagtcaagatcacaccattgcactccagcctgggcaacagagcaagactccgtctcaaaaaaaaaaaaaaaaagaaagaaagaaaatagactgtgatgggttaaaaatgtatactgtaaaaccccagagcaaccattaaaagggaaaagcaaagtaaaaggccagtaatgaagacaaaaaatatatatatttttttgagatggagtctcgctctgttgcccaggctggagtgcagtggtgtgatctcggctcactgcaacctccacctcccaggttctagtgattcttctgcctcagcctcccaagtagctgggattacagatgtgccaccaggccaggctaattttttgtattttt

SEQ ID NO: 64732 - DNA, 601 bp, Human
aggaaaatattatcaattgaaaaccggccaggtgtggtggctcacacctgtaatccagcactttgggaggccaaggcaggcagatcacttgaagacaggagtttgagaccagcctggccaagatagtgaaaccccatctctactaatatacaaaaattagctgggtgtggtggtgtgcacctgtaatcccagctactcaggaggctgaggcaagagaattgattgaacctgggaggcagagattgcagtgagtcaagatcacaccattgcactccagcctgggcaacagagcaagactccrtctcaaaaaaaaaaaaaaaaagaaagaaagaaaatagactgtgatgggttaaaaatgtatactgtaaaaccccagagcaaccattaaaagggaaaagcaaagtaaaaggccagtaatgaagacaaaaaatatatatatttttttgagatggagtctcgctctgttgcccaggctggagtgcagtggtgtgatctcggctcactgcaacctccacctcccaggttctagtgattcttctgcctcagcctcccaagtagctgggattacagatgtgccaccaggccaggctaattttttgta

SEQ ID NO: 64733 - DNA, 601 bp, Human
cttcaggttgcaagaaaaccaaatcagatgggaatctggatctacctatacaaaggataaaaagcactaaaaatggtaactatgtgggcaactataaaaaagatcttttctaattttttattctccttaagagataattatctaaaacaaatataccaatatatacaagaatttataatgtatgtagcagtaaaatgtataacaacaatagcaaaaatggggagtatacaaaataaatgcatactcttttaaggttctgacaccacaggaaaatattatcaattgaaaaccggccaggtgyggtggctcacacctgtaatccagcactttgggaggccaaggcaggcagatcacttgaagacaggagtttgagaccagcctggccaagatagtgaaaccccatctctactaatatacaaaaattagctgggtgtggtggtgtgcacctgtaatcccagctactcaggaggctgaggcaagagaattgattgaacctgggaggcagagattgcagtgagtcaagatcacaccattgcactccagcctgggcaacagagcaagactccgtctcaaaaaaaaaaaaaaaaagaaagaaagaaaa

SEQ ID NO: 64734 - DNA, 601 bp, Human
tagccaaagaagtctccaatttttacgaaaactataagcccatatgtccaagatgctcaatgaatcccagacataataactttaaaaaaaatcccaacaaaccaaggcacatcataatcaaattgctaaaaccagtcataaaaggaaaatctgaaagcagacagaggaagggaaaggcacatcatatatagaagtataaagaaaagaatgacagctgggcacagtggctcatgcctgtaattccagtgctttgggaggctgaggtgggaggatcacgtgagcccaggggtttgagaccagygtgggcaacatggtaagaccttgtctctacaaaaagaattttttttttaattagctgggcatggtggtgcatgactgtagtcccagctactcgagaggctgacgtggaaagattgcttgagcccagaagttcggggcttcagtgagttatgatcataccactgcactttaacctgggcaacagagcaagaccctgtctcaaaaagaaacaaacaaacaaaaaagtgccaagataaaagtgacaacagacttttcatcagaaattatgcaagccaaacacaatggagacatttataaagta

SEQ ID NO: 64735 - DNA, 601 bp, Human
tgaaactctggccgagtattgttctgcatgtgcatgaggggaaactatctgcagctgaggaaagaaccaccataaaaggcatgaaatgaagcaaggaaagaatgacccatagccaggagacagatcaataaatagacacagattcagaaatgaaaaaaatgatagaaggagcagacgtgatgttcaagactactgtaaattcatgctgtatgttacagaaggtagaggaaaacaggacgataatgaagagaaactgaagatataaaagtgaatcaaccccagctacttaggagactgaggygagaggatcacttgagcccagtagctcaaggaccagactcggcaagaccccgtctgaaaaaaaaaaagtgaatcacatgggattggattaacagcagggatacacagaagagggaaacatcaggaaacttgaacacatggcagtagaaataaccagaatgaaagaagacctaaaacaaacaacccagagcttcatttttgggcaatatcaaatgacctaacaatgtgaaattggaatctccaaaaaggggagggagacagaaaaatatttgaagaaataatagccaaagaagtctccaat

SEQ ID NO: 64736 - DNA, 601 bp, Human
tactgtggtacttaggaaacaaaatcccaactgagggaacccatagcagacatacaaccaatctctcccttaagacatttgacctattttttttttttttttttttttgagatggagtctcactctgtaacctaggctggagtgcagcagtgtgatctcggctcactgcaacctctgcctcccagtttcaagcgattctcctgcctcagcctcccgagtacctgggattacaggtgcatgccactgtgcccagctaaattttctatttttagtagagatggggtttcaccatgttggccargctggtcttgaattcctgacctcaaatgatctgcccacctcggcctcccaaagtgctaggattacaggtgtgagccaccgagcctggaccatttggcctattttgaacctgtgtggggaaggaggaataataactaagcccaaaactttggagtgacaaaagttcagtgtccagaaaagtcctaacacagtcataatcctgagggaggccagggcagctggaatctgtgacgtgaaatgctggagagcagctgctgcacaacaggagagctccagagctctaaagagcggtccttgaaac

SEQ ID NO: 64737 - DNA, 601 bp, Human
agaccccacctctatttaaaaggaatccaaagaacacaatttatagtgctgtgaaaacagacacctaccaggctctcaatcaaaagtctgtaagagccacattggaggaggtggctggggtcaaaatggcaatcttgtgcagtactgtggtacttaggaaacaaaatcccaactgagggaacccatagcagacatacaaccaatctctcccttaagacatttgacctattttttttttttttttttttttgagatggagtctcactctgtaacctaggctggagtgcagcagtgtgatctyggctcactgcaacctctgcctcccagtttcaagcgattctcctgcctcagcctcccgagtacctgggattacaggtgcatgccactgtgcccagctaaattttctatttttagtagagatggggtttcaccatgttggccaagctggtcttgaattcctgacctcaaatgatctgcccacctcggcctcccaaagtgctaggattacaggtgtgagccaccgagcctggaccatttggcctattttgaacctgtgtggggaaggaggaataataactaagcccaaaactttggagtgaca

SEQ ID NO: 64738 - DNA, 601 bp, Human
atgcctataatcccagcactttggaagactgacacaggaggattgctcaagaccagcctgggcaacatagtgagaccccacctctatttaaaaggaatccaaagaacacaatttatagtgctgtgaaaacagacacctaccaggctctcaatcaaaagtctgtaagagccacattggaggaggtggctggggtcaaaatggcaatcttgtgcagtactgtggtacttaggaaacaaaatcccaactgagggaacccatagcagacatacaaccaatctctcccttaagacatttgacctattttttttttttttttttttttgagatggagtctcactctgtaacctaggctggagtgcagcagtgtgatctcggctcactgcaacctctgcctcccagtttcaagcgattctcctgcctcagcctcccgagtacctgggattacaggtgcatgccactgtgcccagctaaattttctatttttagtagagatggggtttcaccatgttggccaagctggtcttgaattcctgacctcaaatgatctgcccacctcggcctcccaaagtgctaggattacaggtgtgagccaccgagcctg

SEQ ID NO: 64739 - DNA, 601 bp, Human
tggcaaaagtaattgcaacttcttctaggtattctattgtccgttcctctggaggttttagtcctggtcctataaaaatgaatgcaacactggaatgcaaatcaggcttagaccagtcccaggtagtgaaaaacccagacttgccaaagccaaaggccctagcacagcgttccatttcagactggagactggtaggtggcaaagtcataaaccaagaagtcaaagaagggaaatcacaatgaatagaggagaaacaatatgctctaggtagaaaacgcggtctttaactgtttcatttggyttccacttctgagtagaatgtagtatgtaacacacacaaaaggaatgcattatgtctactgcaacctgcattcttgctgcaaaactggaaagaaaaaagaagaaatcatgaaatcatttgtaaagacactggggagctatggaagtaacaaggacaacatgaactaaaattctagagagcaagagcctatcttagctgaactgatgattgctgatcattttcttttcagggatgtgtaatgcttttgggcatggactgaagactggacttgactcaagcagaaggaaagtgaaaccatca

SEQ ID NO: 64740 - DNA, 601 bp, Human
catgggcaagatattacacatgttatgagctgcagtcaaaactgttttatgtgaaaaattattaaaaataatgtatgatattaccatcaggctatgtgtataaggtgtatatgaaattaatttcatgtttagactctgatcccattcccaagatctctcatcatatatatgcaaatattccactatctgacaaagtctgaaatctgaaatgtttctagtcccaaacattttggataagagatattcaactttataaaagagcaaccattcttcgatgatcgtttaaaacttaaaaacaaasacaaatcacttaaatctgcaacatcaccaagttgctagaaaagtacacaggtaaagctggtacatacatctcttctgtcttcgtcttttagtgggtacaagatacttcctttccttttccaatttaccaaaaaattcaatttcatcatctctaggccttaacatgtaagaaaaatatttttctgtctttgtattcattttgtctcaataaaacctgcccaagtgcggaacaaaaaacacccaagtgacttgttttgaaaggattagaactctgttcctgcccttcgtagagacaacctta

SEQ ID NO: 64741 - DNA, 601 bp, Human
gttctgggggattaaatgagaacactagtaaaatgaccagggtctcaaggttagctattattaatatcactaggatatactggtaagattgcatggttacaaagagcatttcaaaagaatccctctaataaagttgctttcatgacccaaaagaacataaaatgacaacacaatcaatgctttactaatcttgatacaggatgttttatctaataaaccagtgattttcaaacatgggcaaaagattcatcaatggtcagaaatttagtgggtgccaataagcattacatatataaaaagmggaatacacagaaaatactgagcacaatgcacacaggacagttactgattcgtgaaacttattcctcaatttttctgtacgtatgtttatgtgcacttggttatatttttaaaaaatcagaaatgcccaatgagacatctagtaccagaagtgtttttctggtacttgtcctgagctcttcagatttttttttttgtccttttacaggttgagcatccctaatctgaaaatccaaaatccaaaatgctccaaaatccaactttttgagtgccaacatgatgtcatgggcaagatattaca

SEQ ID NO: 64742 - DNA, 601 bp, Human
ccgtgcctcgcctcgaactccggttctttttccactgtagcaggctgcccacgtgggacttaccacttttaaaagtagcttaatttatggagaaaaagtctcaacttggtggttaaaggcataatatctaggatttgacagatcctgtctctgccactgccccattgtgaagctttcttcatccttaaaaatgggaaaaacaatacccattttacagtattgttctgggggattaaatgagaacactagtaaaatgaccagggtctcaaggttagctattattaatatcactaggatatamtggtaagattgcatggttacaaagagcatttcaaaagaatccctctaataaagttgctttcatgacccaaaagaacataaaatgacaacacaatcaatgctttactaatcttgatacaggatgttttatctaataaaccagtgattttcaaacatgggcaaaagattcatcaatggtcagaaatttagtgggtgccaataagcattacatatataaaaagaggaatacacagaaaatactgagcacaatgcacacaggacagttactgattcgtgaaacttattcctcaatttttctgta

SEQ ID NO: 64743 - DNA, 601 bp, Human
ttcgaactggatatttctttatggtggggactatctgtgcattataggatggttagcagcatccctggcctccacccacagatgccagtagcatccctccctccctagttgtgacaaccaaaaatgttcccaggcattgtcaaatgtccccctgggaggcaaaattgtccacgctgagaaccacagagctacaagttgcatcattaaacatagactctgaagagctattaggcagcgtaatatggaaaaaggctggcttatggcaatacacatgaaagaggcaaacagactttccaatacktaggttgtaagctaaaagaaggacaagattttaacaattacaatgaggttttatgttttttaatgaggaagaagtgtgagttcccagagatgacatctcaaatcacagggagagagatgatcattgaacagtgcagagggagtgtgtggtttgggaagggggacctaaaccagacttctaggcaacatcaatatgtgacaagaaagcctctataggaatgaccagaggggtttggaaaaaactcagaacaggcagaactttgaaagccaaaaagtttttagtagacataagggctcaaat

SEQ ID NO: 64744 - DNA, 601 bp, Human
acaatggtgcgatctcagctcattgcaacctctgcctcccaggttcaaacgatcctcctgtctcagactcccgaggagctgggattacaggtgcccaccaccacacccagctaatttttgtatttttagtagagatggggtttcaccatgttggccaggctggtctcgaactcctgacctcaggtgatccacgcacctcggaatcccaaagtgctgggattacaggcgtaagccaccacacctggccaaaaattttaaagtatcagttaggatgtacaaaaaattagttcatgcatggttsacggaagtatactttgtcctacttttgggggggttctttggttttgttaaaaccaagaactgcatactgtataacatagtaattctactcgtcattatctactttacagagatggacttatacacaagatgacatgctgtgatgaacagctatataataatgtttgtaatgaaaaattgtaacagccagtaattcgtcaacaggggattaaaaggaaggagttacctgatatgtactaatctacatctccaagtcatatcactgagtaaaaagtgcaagctacaggatccatacagaagg

SEQ ID NO: 64745 - DNA, 601 bp, Human
caatttaaaaagacaacgaaataaaatgggcaagggatataaagcaattcataaaagaacaaaacaaattgtcagtaaagatgctcaatttcagccaggcacggtagctcatgcctgtaatcctaacactttgggaggcctaggagggaggatcgcttgagctcaggagtttgaaaccagcctgggcaacacagtgagacctcatctctattatgaaaataataataataataaaaagatgttcaatttccctaataactggggcaatgcaaattaaaatgagatgcatcagactggcaatttttttttttttttttttaagatggagtttcactcttgccgcccagggtggagtacaatggtgcgatctcagctcattgcaacctctgcctcccaggttcaaacgatcctcctgtctcagactcccgaggagctgggattacaggtgcccaccaccacacccagctaatttttgtatttttagtagagatggggtttcaccatgttggccaggctggtctcgaactcctgacctcaggtgatccacgcacctcggaatcccaaagtgctgggattacaggcgtaagccaccacacctggc

SEQ ID NO: 64746 - DNA, 601 bp, Human
ttccagaccttatcccttccttaaacacttccacatatgcacattgctacctttttttgcccctgaattcctctagaacttctcaggacgacttgatttaccccagagtatcctggaatggcttcgtgtccattatttgtctcctcaattaaattctaagccttttgaggaccagagatcatatctgcttattcattttagttccctatagttctggaataatttgccatattcccatagtaaataactaagaaaaatttttaaagaatctcttcataaaagaagcccaagtttacagcaytgttatccaaattagagttgaaatgagggataaagtttcattcttaaccattctgattgtaatgttcaaaaatcatactaaagtcctgaaaaggaaatctaacttcaagtcctaggagcatcttctaaatgcagctttgtaatggtacaaatatttatatggtgagtgataagtaattgcaggacaatgagaaaatacagtagagaaacaaaaaatagggactgaaaaaaaagactgatacatttgctacatcaaaattaaaaatttctgttttggctgggcacagtggcttacgcctgt

SEQ ID NO: 64747 - DNA, 601 bp, Human
aagggataacaacatgcttaagctatctaatccatttaagaaacaaaaaagctcactcagctaaaagtcacatgcaggatgctttaagtgcagccagcttgtccattaaatgtgagcagaaaactgatcaaaccaaccctccatttggccaagctgctgctccaccttcccctctgcaaaacaggcagcatgtgtgtgatggtgagagaggcaggtggtgaggaaggggaataatattccccctttattaattcagaggtaagatggagatagtctgtaaagccccagacactgtggaggratcagttcatggcttctctctgtaatgccagtcaggaaataaaagtctgaagagtcctgatcccggccctgccttccccctgcagttactgcccatttccttacatcctaacctcactcagtcttctcaacagagacagtcatgctgtttgaataatccttaacaatagagcaattacctgcaaactatatcaaaatccgcaggcctgatacgaaagtgtaaaatggcattaacaagtatctactagataagattttcccttctgcattcaaagactacagactccaaggatgttaattg

SEQ ID NO: 64748 - DNA, 601 bp, Human
aacaaaagaggagttctggtaattctctacctatgacaggggaagcagccaacgtgtgtctgagaccacatggtttatatttgcttatcgcaaatatataattttatgttattctgtagttgtaatctttttttttttttatttattttttgagacggagtctcgctctgttgcccaggctggagtgcagtggcgcgatctcagctcactgcaacctcttgtctcctgggttcaagcaattctctgcctcagcctcctgagtagctgggattacaggcgcccaccaccacgcctggctaattttttttttttttttttagtagagatggggtttcaccatcttggccaggctggtcttgaactcctgacctcgtgttccatccgcctcagcctcccaaagtgttgggattataggcgtgagccaccgcgcccagcctgtggttgtaatcttctaaagaacagagaccaagcattatttcctatattctccatctacttcccactcattacctagtagcacattgcactgattacataaaatattaactcaaggtttcttttttcccatagggagcagaaaaggattcctgttattcagaca

SEQ ID NO: 64749 - DNA, 601 bp, Human
actctgtgaggtagttattctattactcccattttgagggagactttcaagttgtttagtcttagagggacctgtggtcaaatagcttgataagggagggtgctagcattcaaagacatgttaactcccaagtacacattctttctaccatagaatgcctccaaatgcccaatttacgtaaactaaatcactcttaaaccagttaaatttgccaagaggagtaaataacatgaacactagaatggcaaaacaaaagaggagttctggtaattctctacctatgacaggggaagcagccaamgtgtgtctgagaccacatggtttatatttgcttatcgcaaatatataattttatgttattctgtagttgtaatctttttttttttttatttattttttgagacggagtctcgctctgttgcccaggctggagtgcagtggcgcgatctcagctcactgcaacctcttgtctcctgggttcaagcaattctctgcctcagcctcctgagtagctgggattacaggcgcccaccaccacgcctggctaattttttttttttttttttagtagagatggggtttcaccatcttggccaggctg

SEQ ID NO: 64750 - DNA, 601 bp, Human
gggaagaaaaggaaactaacgtttattgaatgtccatgggccagagcacacctgtgtttttcaccaactctgtgaggtagttattctattactcccattttgagggagactttcaagttgtttagtcttagagggacctgtggtcaaatagcttgataagggagggtgctagcattcaaagacatgttaactcccaagtacacattctttctaccatagaatgcctccaaatgcccaatttacgtaaactaaatcactcttaaaccagttaaatttgccaagaggagtaaataacatgaayactagaatggcaaaacaaaagaggagttctggtaattctctacctatgacaggggaagcagccaacgtgtgtctgagaccacatggtttatatttgcttatcgcaaatatataattttatgttattctgtagttgtaatctttttttttttttatttattttttgagacggagtctcgctctgttgcccaggctggagtgcagtggcgcgatctcagctcactgcaacctcttgtctcctgggttcaagcaattctctgcctcagcctcctgagtagctgggattacaggcgcccaccac

SEQ ID NO: 64751 - DNA, 601 bp, Human
gtcggccttttcaaaaccttggtaatcaagctgcccagtcaagttgctgaagatggaatccctttcaaatgatgttagagctttcttcttcactttgtcattcaatctagaaaaaacacattcctagttagatgggaagaaaaggaaactaacgtttattgaatgtccatgggccagagcacacctgtgtttttcaccaactctgtgaggtagttattctattactcccattttgagggagactttcaagttgtttagtcttagagggacctgtggtcaaatagcttgataagggagggtrctagcattcaaagacatgttaactcccaagtacacattctttctaccatagaatgcctccaaatgcccaatttacgtaaactaaatcactcttaaaccagttaaatttgccaagaggagtaaataacatgaacactagaatggcaaaacaaaagaggagttctggtaattctctacctatgacaggggaagcagccaacgtgtgtctgagaccacatggtttatatttgcttatcgcaaatatataattttatgttattctgtagttgtaatctttttttttttttatttattttttgag

SEQ ID NO: 64752 - DNA, 601 bp, Human
atcatgagtttcctatagctcctttaaaaaaaaaatctctgtgttttctgttcactacactaggattcaagtacaacagccccttgcttaccgcttctacttcctttagcactctgtgcttaagactaaggtcctcaaacacagcttcaatcaccatgtcggccttttcaaaaccttggtaatcaagctgcccagtcaagttgctgaagatggaatccctttcaaatgatgttagagctttcttcttcactttgtcattcaatctagaaaaaacacattcctagttagatgggaagaaaaggaaactaacgtttattgaatgtccatgggccagagcacacctgtgtttttcaccaactctgtgaggtagttattctattactcccattttgagggagactttcaagttgtttagtcttagagggacctgtggtcaaatagcttgataagggagggtgctagcattcaaagacatgttaactcccaagtacacattctttctaccatagaatgcctccaaatgcccaatttacgtaaactaaatcactcttaaaccagttaaatttgccaagaggagtaaataacatgaacactagaatgg

SEQ ID NO: 64753 - DNA, 601 bp, Human
ttccctatttcctttgcagccttagacctgaagaggtttgtttttggctttcagctaaccaaaaaatctcaaagcatctggctatactctgtgaggttatctgtatgtttgggtgacagagctcctacatgaataaggtgaacgcaccctcattttcttcctttagaatttagatttgacctttataacatatgcagtgtgcatgagcacacataaaaacttaacgtttgataacaaaaagtctttttttttttttggagatggagtctcgctctgtcacccagactggagtgcagtggcrtgatctcggctcactgcaacctctgcctcccaggttccagtgattctcctgcttcagcctcccaaatagctgggactacaggtgtgtgccaccatgcccggctaatttttgtattttctagtagagatggggtttcatcatatcggccagtctggtctcgaactccttacctcgtgatccgcccacctcagcctcccaaactactgggattataggcgtgagccaccatgcccagcctttgaatagtcctttttataaaagcaatcatgagtttcctatagctcctttaaaaaaaaaatc

SEQ ID NO: 64754 - DNA, 601 bp, Human
atttgggagctgggccaaagcagcatttccacagaacaagcatctggacgaactgtcttccctatttcctttgcagccttagacctgaagaggtttgtttttggctttcagctaaccaaaaaatctcaaagcatctggctatactctgtgaggttatctgtatgtttgggtgacagagctcctacatgaataaggtgaacgcaccctcattttcttcctttagaatttagatttgacctttataacatatgcagtgtgcatgagcacacataaaaacttaacgtttgataacaaaaagtctttttttttttttggagatggagtctcgctctgtcacccagactggagtgcagtggcatgatctcggctcactgcaacctctgcctcccaggttccagtgattctcctgcttcagcctcccaaatagctgggactacaggtgtgtgccaccatgcccggctaatttttgtattttctagtagagatggggtttcatcatatcggccagtctggtctcgaactccttacctcgtgatccgcccacctcagcctcccaaactactgggattataggcgtgagccaccatgcccagcctttgaa

SEQ ID NO: 64755 - DNA, 601 bp, Human
agaatcatttcatgttcacctttcagtaacccacattctgtttatccaactgtagactagcttaggccttggtcctacctcatccctgaattactgctattactccttctcggggcttactcttcctactccccacttcaagtacttgttttgttcatgtcagcccatctcaagaagtgcctatggagaacatttgggagctgggccaaagcagcatttccacagaacaagcatctggacgaactgtcttccctatttcctttgcagccttagacctgaagaggtttgtttttggctttcrgctaaccaaaaaatctcaaagcatctggctatactctgtgaggttatctgtatgtttgggtgacagagctcctacatgaataaggtgaacgcaccctcattttcttcctttagaatttagatttgacctttataacatatgcagtgtgcatgagcacacataaaaacttaacgtttgataacaaaaagtctttttttttttttggagatggagtctcgctctgtcacccagactggagtgcagtggcatgatctcggctcactgcaacctctgcctcccaggttccagtgattctcctgc

SEQ ID NO: 64756 - DNA, 601 bp, Human
tgaatctgaagcaataaaacatctcagggtttttctctgttccgagtttaccttctcaggtcttttgctgacagcagcgatttcactgattgggagagcagatgtgttactggcaaagatacagtgatctggaatcacctgcaggggaaaagcatttaacaatgtgtcaggtaggcctgggagatgattagaggccacatcaaagctaatgagtgacacctgggcccagcccactctgtcccccacaactgctcagacagtagatgtcactcacccagacattgacggatcacctaggggsttttgtgtcggggaatatgttgaccttgttccttttcccattctgccttcctctagttatggcccatcataaggtcaccttatcctgacctggagactacatctcagcagttgggtcaataaaacagcttagaacaacactgaaaagacggccttgaattgcaattcattgatttcaacacccagcatgggtgtcacctcctcttttgtttggatctgccctgaatcactccccgcttcacctttataagaacaagccaaaatgtgcatgcttgtctcattttatacagtgtgttactaa

SEQ ID NO: 64757 - DNA, 601 bp, Human
gtcatggtattagcatttattgtgtccagtgtttaggaaccacccgcatccactccgtaatccactgtctcttctgtactcaagctgtaagcctttatcagtgaatctgaagcaataaaacatctcagggtttttctctgttccgagtttaccttctcaggtcttttgctgacagcagcgatttcactgattgggagagcagatgtgttactggcaaagatacagtgatctggaatcacctgcaggggaaaagcatttaacaatgtgtcaggtaggcctgggagatgattagaggccacakcaaagctaatgagtgacacctgggcccagcccactctgtcccccacaactgctcagacagtagatgtcactcacccagacattgacggatcacctagggggttttgtgtcggggaatatgttgaccttgttccttttcccattctgccttcctctagttatggcccatcataaggtcaccttatcctgacctggagactacatctcagcagttgggtcaataaaacagcttagaacaacactgaaaagacggccttgaattgcaattcattgatttcaacacccagcatgggtgtcacct

SEQ ID NO: 64758 - DNA, 601 bp, Human
taaagtgttcttttacttacatctgaaatacttaggacctgattcagactcagtactcctgagcaaaaggaattagcctttattgatgtagaatttctatataataaaatgcacagatcttgaagtgttcacatcaatgagttttgacaactgtatatacatccatataatcactaacccaagcaaaatatatttacatcactcagaaagttgtgccaaagatgaccaactcatcctggatggctggggatttcccaatttgtggcactgagggtcctgtatcccttgctcccgggcaaaycaagatggttggtcaccctattttgtctttttggccttacttttaaatgaatgacaaaaggcaagcaggtgagaaaagctgtcctagatacttggagggcagaactgcaaagtgtgatgcttgctctgctccgatggcggggagaggttaccatcaaatgaacagcaacggcatcgcctgtactgattttagatgccacacagatgtcttgagtgatatgacatggccagactgtccatctgtagactatcggctgcaacttctccctatgacctttagcctgccatcattgagcctgcc

SEQ ID NO: 64759 - DNA, 601 bp, Human
gaattaatgtgttgggctgtcagagaagtatttgcattttacacagatgggtctcaccaccaggatactaggtttaactaacactcctcaacagtcagatgcacttaagactcattaaaccagcagttctccaagtgtagtacccggacccaacaagcactgtcatcacctgggagcgttaggcctgcacattctcaggcctagcccagccctactgaatcagaaactccatgggtggggcccagatttgttttaataatccctcctggtgattctgatgcgtgctaaggtttcagagaamcccctcattgagctaacagttacatagtcttcccaacagaactgtggtgaaagaagtctaattcattaatttatagttttgctttctccctctcactttagctataaggtacaacaagtgatatctgtaatttttggctgctcattatctacctgctcttcaatacatttaccacttattccttacatttaatccattacaaccctatgaactggtcagcctaattatctagatgaggaaaaaaggtatcaagaggttagtagtacagagtcagtcagcatatgacggggtgggattcca

SEQ ID NO: 64760 - DNA, 601 bp, Human
ggggcagagggaaagctctgcccctttcagtgcagtataagcccaacttccgactgctgtgcagagagagggcaccagggaccttcctagacaagagcaggagttggtgtatcagaaggaagcttggtccttatcttgacatcatgagttttagagtgactgaaggagtggaagatgccgcaaacactctggagagcaataccaacctggaggattcggatgacttcagacatcatgggcgcaagacacctggtagtatagaagccaggtccatcctgccaaggaagagaacatgagctcmctggccctgctgctgggactgagtctgaaacactctacctttcccagggtcacttcaaagtcatttgaaagtcactgtaaaacttaaggtgacttaaaatctcaatcagaatccttaaaaatgaaattgcaggggaagccgtactaggggtagcctggcttgaatcaaacagtacagcagatagtttcatggtcaccttcaaggtctgggatggctgggagaaccctgccacatcctagatactccccactcccaccttgactcagtgggacagtcaataccaccgtccatcctggagac

SEQ ID NO: 64761 - DNA, 601 bp, Human
agcttgcttctgcactattgcagatttcatctcggggggataaaaatgcttgtccatctggcataacttggaccaggtgatgctagagccccagaagggtagaactctgccttttgtccataatctatagtcctagcccttagaaggttcacatgacatctttttttttttttttttttttgagaaggggcctcgccatgttgcccaggctggcctcacacttctgggctcaagcgatcctcccacctcagcctcctaagcagctaagaccataagtggttgctaccgcacctgactcatraaatcatttttgaaatcgccagtgataagggctctgtgtttagaaaactttcttccacgagggcttctgtaactctttggtctcaggaactgcttagaactttgtaactaatggtgctagttatgtttccttgaggctactcacctaggaagcccttggacaccatctgtgtcagcagttctgggtttccacctccaaaccgctccccaaagactttgcccagatcttccgccacatgtttcgctacatccacaccaacttcatccaccagtgtggcggcacccacaggaaagccaaagc

SEQ ID NO: 64762 - DNA, 601 bp, Human
gtcagaagagtgggcagagaaggaaagaagatcttgtgacccggagcttgggcatctgtgtacatggatgagaaaggccacctgggtgagttttaacatccccatatgcagcaccgggtcctagaacacccaggttgtaatgctgattttgctgttttgccaagacagaaagtcacttctctgtgggcctcaactgtatactgtgtatggtgagcttatacattctcctcacaggtggccagacagcatggtaaagcccggatgcagagcttgcttctgcactattgcagatttcatctckgggggataaaaatgcttgtccatctggcataacttggaccaggtgatgctagagccccagaagggtagaactctgccttttgtccataatctatagtcctagcccttagaaggttcacatgacatctttttttttttttttttttttgagaaggggcctcgccatgttgcccaggctggcctcacacttctgggctcaagcgatcctcccacctcagcctcctaagcagctaagaccataagtggttgctaccgcacctgactcataaaatcatttttgaaatcgccagtgataagggct

SEQ ID NO: 64763 - DNA, 601 bp, Human
acaaaaaacaaacaaaaaagaccctgacctgagaattcttgtctctgttggtctattataaagctctggcctcttctgaattcctgaatttgtatgtctagctaaccctagcaaattagtctttgtcagaagagtgggcagagaaggaaagaagatcttgtgacccggagcttgggcatctgtgtacatggatgagaaaggccacctgggtgagttttaacatccccatatgcagcaccgggtcctagaacacccaggttgtaatgctgattttgctgttttgccaagacagaaagtcacytctctgtgggcctcaactgtatactgtgtatggtgagcttatacattctcctcacaggtggccagacagcatggtaaagcccggatgcagagcttgcttctgcactattgcagatttcatctcggggggataaaaatgcttgtccatctggcataacttggaccaggtgatgctagagccccagaagggtagaactctgccttttgtccataatctatagtcctagcccttagaaggttcacatgacatctttttttttttttttttttttgagaaggggcctcgccatgttgcccaggc

SEQ ID NO: 64764 - DNA, 601 bp, Human
ctgtctcaaaaaaaaacaaaaaacaaacaaaaaagaccctgacctgagaattcttgtctctgttggtctattataaagctctggcctcttctgaattcctgaatttgtatgtctagctaaccctagcaaattagtctttgtcagaagagtgggcagagaaggaaagaagatcttgtgacccggagcttgggcatctgtgtacatggatgagaaaggccacctgggtgagttttaacatccccatatgcagcaccgggtcctagaacacccaggttgtaatgctgattttgctgttttgccragacagaaagtcacttctctgtgggcctcaactgtatactgtgtatggtgagcttatacattctcctcacaggtggccagacagcatggtaaagcccggatgcagagcttgcttctgcactattgcagatttcatctcggggggataaaaatgcttgtccatctggcataacttggaccaggtgatgctagagccccagaagggtagaactctgccttttgtccataatctatagtcctagcccttagaaggttcacatgacatctttttttttttttttttttttgagaaggggcctcg

SEQ ID NO: 64765 - DNA, 601 bp, Human
aggcaagaaaagggagtgttactatttgttctcagggagggagtgttactatttgttctcagaaccctggcctggccaggcgtggtggctcacgcctgtaatcccagcactttgggaggccgaggcggaggatcatttgaggtcaggagtttgagaccagcctggccaacatggtgaaaccccatctctactaaaaatacaaaaattagctgggcgaagcaggaggatcgcttgaacccgggaggtggagacgagattatgccactgcactccagcctgggcaacagtgtgagactctgtstcaaaaaaaaacaaaaaacaaacaaaaaagaccctgacctgagaattcttgtctctgttggtctattataaagctctggcctcttctgaattcctgaatttgtatgtctagctaaccctagcaaattagtctttgtcagaagagtgggcagagaaggaaagaagatcttgtgacccggagcttgggcatctgtgtacatggatgagaaaggccacctgggtgagttttaacatccccatatgcagcaccgggtcctagaacacccaggttgtaatgctgattttgctgttttgccaagac

SEQ ID NO: 64766 - DNA, 601 bp, Human
gctgtcagagaaagtcaatttccaggcattagccactcaaacggacttacacttcagacttaggaggcagcttcagactcgctaaaatactatccatgtcagaattcaaatccttcctcttcacaccctcctgatagatgtaaaagcccttcccagatttacgacctaaaacaggcaagaaaagggagtgttactatttgttctcagggagggagtgttactatttgttctcagaaccctggcctggccaggcgtggtggctcacgcctgtaatcccagcactttgggaggccgaggcggrggatcatttgaggtcaggagtttgagaccagcctggccaacatggtgaaaccccatctctactaaaaatacaaaaattagctgggcgaagcaggaggatcgcttgaacccgggaggtggagacgagattatgccactgcactccagcctgggcaacagtgtgagactctgtctcaaaaaaaaacaaaaaacaaacaaaaaagaccctgacctgagaattcttgtctctgttggtctattataaagctctggcctcttctgaattcctgaatttgtatgtctagctaaccctagcaaatta

SEQ ID NO: 64767 - DNA, 601 bp, Human
caagacctcgccgccttagccattgctttaacgtgcccagacctcagaaccggggttgcctcgcatagcaaaaaaaaaaaaaaaaaaaaaaaaaaaaagaggcagagagagagaacttgtggaacaggagaaatccagcaaccttccctaacactagagtgactgacactgctccatggcaaatgtggccaaaccttgcttgtccattcattcatgcaatagacacttatggctcaaccgctgtgagccaggcaacattctgaagatttagcagtcaatagtcatggagcttatttctagwtgggaaggaaggaaacttcctttctttccaaacgtcttttttccccatctaagagccccctttaaatgttacccgtaggagccttcaaaactctcccaaatttctcccataggcttcttttgacctttctgctttatccccaaaaccacgcaatttatggctccaatttcccaatactgggaaaagacaaaagagaccgaaagtaaatagggcatgcgacataaaattcgacgctcctttgtatttcatgtgcatatcttcacagccacactgtcagcacctcaataacatgacggtgtt

SEQ ID NO: 64768 - DNA, 601 bp, Human
ttggttttaaaataaatacataaacaaaatatcattgagagagcctggaataaggcacccaatattgtagaacctaggcacctctcaacaagagacctgctggctgtacagccctgaaacaggagaaataaatttacttcttcaaggcttcctatacaatgccagattttgattattacttatttttcacacgaagaaactaaggccctgagagagtaacataaagacataaaataaacaataagttgaaattctcttggttctgagtctaattttctaaccataggtagaaatttgtctstcgggcatagtggacatccaaaaactctgccagcactaccttgactgcacaacccctttcaaaggcaattccacttatgcatgataaaaatccttagagaactcataaaaggtcaagttttaatttggcagacaaagtaacccaacaggcactgcaacccaggttactgaaacagcagcctggagctccagagttcagagattcaaccaaggcagagcacaggtagaattccagcccttacagaaaagcagaggcaccaacagcctcgcactacaggtctaagacccaagaaccaggacc

SEQ ID NO: 64769 - DNA, 601 bp, Human
tgcactccagtctgggcgacagaggaagaccctatctcaaaaaaaaaaaaaagcctacaactgaatacactaagcagttgaaaataaatggattaaatccacaagcagcaacatggttatagccccatcagttatgaagtaaaacgcatacctctgacccagcaactgtagtttttcattcactgcagcaacggtccttaatgagaatactaaataaactacgatacatactacataagagattgtgtagtagttaagaagactcaggttgattcctgtgttccaacatgaaaaaatctcraaatcattctgttaggggaaaaaactgcagaacaatgtgtatggtatgatgtcattaatgcagaggagaaaaaactctgctctttttttattctgtattacctatatatacatgaaaatacatagagaatagcctggaaagaccacaaaaactgataacttctgtttctgtgagtaggtcaagggggcctttattctgtctatactgttttgagtatcagatgagtttgtgttccctatatatacatgaaaatacatagagaatagtctggaaagaccacaaaaactgataacttgtttc

SEQ ID NO: 64770 - DNA, 601 bp, Human
tcatccaaattgaaaaaaaaattgtatcttttcattataccatacatagaaataaattccatctggaaagcaaaacttttttaaacttttggaagaaactctaagaatatatcattaacaccatgagagacagaaaattttcttaaaccagatacacacccaaaaaaagacaagccatttaagggaaatttttcataaatatgacattaaacttaaatggtatatacaaccaaatacattgttaacaaagggaaagaaaagcctagggctggcaggatgcatttgcaacacacagacccaytgaagaatcagcatctaaaggaacccaactgttcctcagtgagtaaaaggacacgtgcgctgtgatgtaagtccacaaccgggccaggtgcaggggctcatgcctgtaatcccaacgctttgggaggatcacttgccagcctgagcaacatggcgagactgcatctctacaaaaaattttaaatggtggcacgcaagtgtagtcccagctacttgggagaatcacttgagccctggagtgccactgcactccagtctgggcgacagaggaagaccctatctcaaaaaaaaaaaaaagcct

SEQ ID NO: 64771 - DNA, 601 bp, Human
aactgtacacttacaatggttaaaattgttatttttatgttatgtgtattttactataataaaaaaagttagagtgctgaaaaactggtcatccaaattgaaaaaaaaattgtatcttttcattataccatacatagaaataaattccatctggaaagcaaaacttttttaaacttttggaagaaactctaagaatatatcattaacaccatgagagacagaaaattttcttaaaccagatacacacccaaaaaaagacaagccatttaagggaaatttttcataaatatgacattaaacktaaatggtatatacaaccaaatacattgttaacaaagggaaagaaaagcctagggctggcaggatgcatttgcaacacacagacccactgaagaatcagcatctaaaggaacccaactgttcctcagtgagtaaaaggacacgtgcgctgtgatgtaagtccacaaccgggccaggtgcaggggctcatgcctgtaatcccaacgctttgggaggatcacttgccagcctgagcaacatggcgagactgcatctctacaaaaaattttaaatggtggcacgcaagtgtagtcccagctac

SEQ ID NO: 64772 - DNA, 601 bp, Human
cagagagatctgtcctattcttgacatgttaaagaagggaaaaaataatttcaagaaatgccccaaaaaaaggcctccataaaattcaacacccaattaaaaatatttaccaagaacagaagaaaacttccttaaattgacaaaagacatcttccaaaaaccaacagtaaacatcatatctaacagtgaaacactggaaacattaccactcaggaaaaagattaaaatgcccattattatacttattcttgtactggaaggcctaggcaatgccataacaaagaaaaaagtctttgtataragttgagaaaggagcttggctaattaaatcttctagaaagtggccagtaagtacattctttgatgcatcctctctgctctaaatacacaataatggataaaatattttttaacaattttttttaattaggctcaaaaacaagataaacctctatttggagaaacagaatagatacacaaagttgcaagcaggactgaagctctaggcttgctggatccggagtctagaccaggtgtgcacttcctgcaggtagtaatgacagaaagcaaaggaggatgaagaaacggagatatctgggcc

SEQ ID NO: 64773 - DNA, 601 bp, Human
tacaactcagagagatctgtcctattcttgacatgttaaagaagggaaaaaataatttcaagaaatgccccaaaaaaaggcctccataaaattcaacacccaattaaaaatatttaccaagaacagaagaaaacttccttaaattgacaaaagacatcttccaaaaaccaacagtaaacatcatatctaacagtgaaacactggaaacattaccactcaggaaaaagattaaaatgcccattattatacttattcttgtactggaaggcctaggcaatgccataacaaagaaaaaagtctytgtataaagttgagaaaggagcttggctaattaaatcttctagaaagtggccagtaagtacattctttgatgcatcctctctgctctaaatacacaataatggataaaatattttttaacaattttttttaattaggctcaaaaacaagataaacctctatttggagaaacagaatagatacacaaagttgcaagcaggactgaagctctaggcttgctggatccggagtctagaccaggtgtgcacttcctgcaggtagtaatgacagaaagcaaaggaggatgaagaaacggagatat

SEQ ID NO: 64774 - DNA, 601 bp, Human
gaaaaattctcaaatattcttcctttaatacttcttttctcttctctttcagatttaaaaaaaaaaaaaaaaggccagggaaaataaatgttcataaaaccttaaagatttgctttttacaaatctgagagagttctctaggttccaataaaaaaattcagtaactgcactccactacaacaaagagttctgagtagctaaataacctcacggggctgtggtaactcttaaatcaatatcatgtaaagcatttagcacaatggcatccagtaagagcccaataaatgttagctactattaytgatattattaggtactattcaaatatagtgaagttacgatgatatttagtccaaacctgattactacagcatttcagccctattttaacttatatataatgttagtatacaaaaattcaagtttaaaatgtgttttctttaaaggttgtgaggttttttgttaaaagtgaattaacaagtaaatcatatacatctgtttctctcagttacctacaactcagagagatctgtcctattcttgacatgttaaagaagggaaaaaataatttcaagaaatgccccaaaaaaaggcctccata

SEQ ID NO: 64775 - DNA, 601 bp, Human
gacatgcgcctatagtcccagctacttgggaggctgaggcaagagaatcccttgaacccaggaggtagaggttacaatgagctgagatcgtgccactgcactccagcctggatgacagagcaagactccgtctcaaaaaaaaaaaaagttagtgatgactaagactctcattaacacttagttacaacaagccaaactttattgaaagagaacttccttgcttatttcagaaaaattctcaaatattcttcctttaatacttcttttctcttctctttcagatttaaaaaaaaaaaaaaaaggccagggaaaataaatgttcataaaaccttaaagatttgctttttacaaatctgagagagttctctaggttccaataaaaaaattcagtaactgcactccactacaacaaagagttctgagtagctaaataacctcacggggctgtggtaactcttaaatcaatatcatgtaaagcatttagcacaatggcatccagtaagagcccaataaatgttagctactattattgatattattaggtactattcaaatatagtgaagttacgatgatatttagtccaaacctgattactacagc

SEQ ID NO: 64776 - DNA, 601 bp, Human
cattttattcaaatcaggtaatatgatctgaaagaccactaaacccagcagaggtgaactaaaacatgtgctaaaacaatataagcaggtaaataaggaggatcacagtatcagcccctccaggcggtggggttccctagcttaccgtacgtgacagacatcatcagacacacagatgaagtaaagtgtcaacctatgggtcaaatactggtaaaacttgattgctcatattttcttgtaacaccctgcctagaggatcattttacatacctcccactttggagactattgctctttttaraagtaggtgagaagacaagaccgtgctgagcttgaggagattttcaggattaggggtgttagaagtagagaggaaactaaagtctaagtggtcaggtaacttggcctgaagttgcaaagctaggaatctgcggagttgaccatgacgatgctaaagcgctagagcccattttctttctattgtgtcacatcgccccctccagggcaacatgaggcctcaaggaataaggaaagaacacaggtcccaaaactgtggtgctggatcagaccttaaatcatggagctaagtaggatctgaaga

SEQ ID NO: 64777 - DNA, 601 bp, Human
gtatataagtccatattttaaatagtatttttagtaattctaagctattttttattactgcttcttcatcaatctgatgagatcaccattgtttttatattatgcatttgactgacaagttcataatataaatagaagtatccactctgtttctttctggctgttcacgtgtatttgtattattacttcaatcttctgctgactctgaaacttcaatctgcattttctttgcaggaatctttgtgagccatctgtctatttagcaaagttcattttattcaaatcaggtaatatgatctgraagaccactaaacccagcagaggtgaactaaaacatgtgctaaaacaatataagcaggtaaataaggaggatcacagtatcagcccctccaggcggtggggttccctagcttaccgtacgtgacagacatcatcagacacacagatgaagtaaagtgtcaacctatgggtcaaatactggtaaaacttgattgctcatattttcttgtaacaccctgcctagaggatcattttacatacctcccactttggagactattgctctttttagaagtaggtgagaagacaagaccgtgctgag

SEQ ID NO: 64778 - DNA, 601 bp, Human
acctcaaaaggaacttctaaaaatgtattattaaccttaataaaattttaaggtactggattatgactgacaatcactgaaaaacatcaataagtctgtctttatattctgaatatttagtttttaaatatctcaatttataagattagcccataatatcattagtaaataccttcaggtacaatgtactcaacagtgtatataagtccatattttaaatagtatttttagtaattctaagctattttttattactgcttcttcatcaatctgatgagatcaccattgtttttatattatrcatttgactgacaagttcataatataaatagaagtatccactctgtttctttctggctgttcacgtgtatttgtattattacttcaatcttctgctgactctgaaacttcaatctgcattttctttgcaggaatctttgtgagccatctgtctatttagcaaagttcattttattcaaatcaggtaatatgatctgaaagaccactaaacccagcagaggtgaactaaaacatgtgctaaaacaatataagcaggtaaataaggaggatcacagtatcagcccctccaggcggtggggtt

SEQ ID NO: 64779 - DNA, 601 bp, Human
agtaatattaaaaatggatataggccaggcgcagtggctcccacctgtaatcccagtattttgggaggctgaggcaggtggattacctaaggtcaggagttggagaccagcctgccctacatggtgaaaccccgtctctactaaaaatacaaaaaattagctgggcatggtcgtgggcgcctgtagtcccagctactcgggaggctgaggcaggagaactgcttgaacccaggaggtggaggctgcaaggagctgagattgtgtcactgcacgccagcctgggtgacagagcgagactccrtctcaaaaaaaaaaacaaaaaaaacaaatggatgtatctaattacccagaaattccctttttacaactatgtcctgaggagacacatacaagaatgcttatgatgatattgtttctaaacacaaaatcagaaacaacctaaatgtccatcaacagaagcatgggaaaataaaattatagtatagtcaatcgcacaacagaataaagcagggctacatttatcgagatggatcaatttcacaatattaagtgaaaaaagttacaagagaatacataaaaaataatattatttccataaagc

SEQ ID NO: 64780 - DNA, 601 bp, Human
caaagaccagagcttgggccataaaacaaacagtaacaaattcaaaagaattaaaatcatacagagtatgttatctgaccataatgcattgaaactagaattcactaaaagaaagagaagtcaatgaaactaaaagctagttctttgaaaagatcaataaaattgataaacctctagcaaaacagagcaacaaaaaaaagagggcataaattatcaatattactaatgaaagaggggaagttatcactacagaacacatgaacattaaaagaaacaccatagaaatattatgaacaattckaatctatacatataacaactcagataaaactgaccaattcctcaaaagctacaaattgccagaactcgcccagggtgaaacagataaccagaataaccctataattactaaagagattgaatttgtagtttaaaaaaaaaccttctgtgaaaggaatctgcaagcccaattctacaagaacccttccagaaaacaaaagacaaggaaacacttacctactcattttgtagccagcattacctagataacaaaacccaacaaaggcagaaaaaaaggaaaactaccaaccaatgttcatga

SEQ ID NO: 64781 - DNA, 601 bp, Human
caaaaataaataaatgaaagggttgaaactgaaagttcctagaaaaggctgtttaatatcctcagcccaaagcaaaaccaaatgaatgggtttggaaagcacaacccatgaaataaaaaaaaaaatagttagattttatcaaaattaactgccccacaaaagatactattaagtgaatgaaaagacaggcaactgagtgacagaaaatattttcaaaacacgtatctgatgaagtacttgtatacaaattatataaagaacactgggcacggtgactcacacctgtaatcccaacaggatktggaaggctgaggtgggcagatcacttcagcccagtagttcaagaccagcctgggcaacatggcaaaagctcatctctacaagaaaaatacaaaaactgccaggcaggctggtgcacacctgtattcctggctactcaggaggctgaggtgggaaggatcgcttgtgcccaggagttcatggctgcagtgaactgtgatcacactactgcactccagcctgggtgacggagcaaaaccctgtctcaaacaaacaaacaaacaaaactcataaaactcagtaacaaaacaacagcttaatc

SEQ ID NO: 64782 - DNA, 601 bp, Human
cccagtctctactaaaatacaaaaaaaattaactgggtgtggtggtgcatgcctgtaatgccagctaattgggaggctgaggcaggtgaatcttttaaattcaggagccagaggttgcactgagccgagatcatgccactgcactccagcctgggtaacagagtgagactccgtctcaaaaataaataaatgaaagggttgaaactgaaagttcctagaaaaggctgtttaatatcctcagcccaaagcaaaaccaaatgaatgggtttggaaagcacaacccatgaaataaaaaaaaaaatagttagattttatcaaaattaactgccccacaaaagatactattaagtgaatgaaaagacaggcaactgagtgacagaaaatattttcaaaacacgtatctgatgaagtacttgtatacaaattatataaagaacactgggcacggtgactcacacctgtaatcccaacaggatgtggaaggctgaggtgggcagatcacttcagcccagtagttcaagaccagcctgggcaacatggcaaaagctcatctctacaagaaaaatacaaaaactgccaggcaggctggtgcacacctgta

SEQ ID NO: 64783 - DNA, 601 bp, Human
agtataagactggcaaggaaacgtctgttgatatgggccactcttccatgactcacaatttaatgttccaaaaagggcatctggagccagtcctaacatgctactagaatggctcatttaaggtggaaataaatgtttccaatgatgtcttaaaggaaataaattgaaaatcccggaactgcatggcaaggtattaaggaaggagtcaaaagagagtctgtatatcccctatcccctaccaggtacactggcctgacagcacctgagagctttctctaacctcgagtccattttgttccckgcatggcacgcctgacatacacgcctgtcaggtagatctaccacctcctgaaaacaatcttaaccaataactgaaagagatggtatataaatactccaactacctttcccctgaaggactataactctaagacacaagttttacattcgctcctggagtttctcagtgggaatactgtgaaaaaaatcagtacctggcttgaaaacaaatctcgtatttgcaatctttgctatcttccctctcctatctcacttcccactcccccactggcttttccaaggataacctccaaaataaaat

SEQ ID NO: 64784 - DNA, 601 bp, Human
cattgtcagaatagggaggtactggccttccttttgatgaaagcattgattcaccaacacagtatgatatgatgagatgtactggcaagaactggaagaacatacctggatcttgagactactgaacttggtggtcaagtataagactggcaaggaaacgtctgttgatatgggccactcttccatgactcacaatttaatgttccaaaaagggcatctggagccagtcctaacatgctactagaatggctcatttaaggtggaaataaatgtttccaatgatgtcttaaaggaaataaaytgaaaatcccggaactgcatggcaaggtattaaggaaggagtcaaaagagagtctgtatatcccctatcccctaccaggtacactggcctgacagcacctgagagctttctctaacctcgagtccattttgttcccggcatggcacgcctgacatacacgcctgtcaggtagatctaccacctcctgaaaacaatcttaaccaataactgaaagagatggtatataaatactccaactacctttcccctgaaggactataactctaagacacaagttttacattcgctcctggagtttct

SEQ ID NO: 64785 - DNA, 601 bp, Human
aattgtatctcccagaatgtccatgtgttgtgggagagaggtaattgaatcatgggggccggtctttcccgtgctattctcgtgacagttaataagtctcgtgaaatctgatgggtttatcaggggtttccgcttttgctttttctacattttctcttgctgctgccatgtaaaaagtgcctttcacctcccaccatgattctgaggcctcctcagccatgtggcactgtaagtccaattaaacgttttttttttaaaaaaaaaaaaaagaaagaaggaaaagaaaactgttcagagcttkctttctttctttctttctttctttctttctttctttcttttttttttttttttttgacagtctcactctgtagtccaggctggagtgcagtggtgcgatctcagcttgctgcaacctccgactcccgggttcaagcaattcttgtgcctcagcctcctgagtagctgggattacaggcacgcaccaccacgcctggctaatttttgtatttttagtagagatggggtttcaccatgttagccaggctggtctcgaactcccagtctcaagtgatctgcctgcctcagcctcccaaagtgc

SEQ ID NO: 64786 - DNA, 601 bp, Human
aatccctgatacggtttggctgtgtccccatccaattctcaacttgaattgtatctcccagaatgtccatgtgttgtgggagagaggtaattgaatcatgggggccggtctttcccgtgctattctcgtgacagttaataagtctcgtgaaatctgatgggtttatcaggggtttccgcttttgctttttctacattttctcttgctgctgccatgtaaaaagtgcctttcacctcccaccatgattctgaggcctcctcagccatgtggcactgtaagtccaattaaacgtttttttttwaaaaaaaaaaaaaagaaagaaggaaaagaaaactgttcagagcttgctttctttctttctttctttctttctttctttctttcttttttttttttttttttgacagtctcactctgtagtccaggctggagtgcagtggtgcgatctcagcttgctgcaacctccgactcccgggttcaagcaattcttgtgcctcagcctcctgagtagctgggattacaggcacgcaccaccacgcctggctaatttttgtatttttagtagagatggggtttcaccatgttagccaggctggtctcg

SEQ ID NO: 64787 - DNA, 601 bp, Human
atatacatgaatattcaatttcatattaaagaaatcaggtattaatccctgatacggtttggctgtgtccccatccaattctcaacttgaattgtatctcccagaatgtccatgtgttgtgggagagaggtaattgaatcatgggggccggtctttcccgtgctattctcgtgacagttaataagtctcgtgaaatctgatgggtttatcaggggtttccgcttttgctttttctacattttctcttgctgctgccatgtaaaaagtgcctttcacctcccaccatgattctgaggcctcytcagccatgtggcactgtaagtccaattaaacgttttttttttaaaaaaaaaaaaaagaaagaaggaaaagaaaactgttcagagcttgctttctttctttctttctttctttctttctttctttcttttttttttttttttttgacagtctcactctgtagtccaggctggagtgcagtggtgcgatctcagcttgctgcaacctccgactcccgggttcaagcaattcttgtgcctcagcctcctgagtagctgggattacaggcacgcaccaccacgcctggctaatttttgtattt

SEQ ID NO: 64788 - DNA, 601 bp, Human
tttaggccaggcacagtggctcaggcctgtaatcccagcattttgggaggccaagacaggcggatcacttgaggtcaggagtttgagaccagcccggccaacatggtgaaaccccatctctactaaaaatacaaaaattagccaggcgcggtggcaggcacctgtaatcccagctactcacgaggctgaagcatgagaatcacttgaacccaggaggtggaggttgcagtcagccgagatggcgccactgcactcccgcctgggcggctgagtgagactccctctcaaaaaaaaaaaaaataataataataagtagcacagatttaaatagttcaatctggtagctgatcatagacagcagatttgagagggtcaagactggaagaagggatcaggaaattattgctttggttcagaaaagtaccagtgattaaaaaaaattagtaataaacacaaccatccatattaagtatgtactacttacttcatacttaagtatgtgagtgccaggcactgtgccaagtgctttattcacattatctcatttaatcttcacaacaattctatgaagtcaatgccattcctgctttatggatgagga

SEQ ID NO: 64789 - DNA, 601 bp, Human
aagcaaagaagtagcacagatttaggccaggcacagtggctcaggcctgtaatcccagcattttgggaggccaagacaggcggatcacttgaggtcaggagtttgagaccagcccggccaacatggtgaaaccccatctctactaaaaatacaaaaattagccaggcgcggtggcaggcacctgtaatcccagctactcacgaggctgaagcatgagaatcacttgaacccaggaggtggaggttgcagtcagccgagatggcgccactgcactcccgcctgggcggctgagtgagactcsctctcaaaaaaaaaaaaaataataataataagtagcacagatttaaatagttcaatctggtagctgatcatagacagcagatttgagagggtcaagactggaagaagggatcaggaaattattgctttggttcagaaaagtaccagtgattaaaaaaaattagtaataaacacaaccatccatattaagtatgtactacttacttcatacttaagtatgtgagtgccaggcactgtgccaagtgctttattcacattatctcatttaatcttcacaacaattctatgaagtcaatgccat

SEQ ID NO: 64790 - DNA, 601 bp, Human
aggactacttcagatctctaccccatcaacgcctgcatgcgtattacttaaggcaccccagcctcttcttagtatcaggaattactgtgtttgtgtatttggtttcctattttgtctgcttccctttactaacatggaagtttcatgaagtgaagtcagggactgtgttttgttctcctctgtagccctagcacccagaatagtgcctggagcatagcagatcctcaataaatgcactaaaagttgaaaggaaaagatgacccctatgctgagttttgaagggtaggcagaagcagtatgmcgggtggtggaggcaacagtattgtgcaaaggcggaaaggcatgaaaccacatgatctgcaggaaagccaattcagtattgctgggaagtaacacgcaaggcatgtgatggaaaaattgggaactagtgggcagagcaaaaaaggggccagaagggccttgtttggcattcttaggagtggggtctttcccattaaagtgatgagaagcaagtaaaggaatgtaagcaaagaagtagcacagatttaggccaggcacagtggctcaggcctgtaatcccagcattttgggaggccaagac

SEQ ID NO: 64791 - DNA, 601 bp, Human
ggtgggaggatcacttgagcccaggagttcgagaccagccagcctgggcaccatagtgtgaacccatcactacgaaaaacaagaaaattagccaggcctgctggcacacgcctgtagtcccagatactcagaaggctgaggcgggaggatcaattgagccctggaggttgagtctgcagtgagccgtgatcataccactgcactccagcctgagtgacagagcaagacacagtctcaaagaaaaagaaaaaaattgtatagttacctacctaagtaggaatctataaccattaagactaayaagagttgagaaagagtactggattcaaaactgacatactaaaatcaacatactaaatgatacaactgaataatggctggaaaaaggtgattctggcatccatagaaagtagttatgctggagtttctggttgacgttgctggaaatgagggggtggggcttccagcagcagacactatagtcacccatgcaattcttcctgtgaagaaatataggagactcaagaagtcatacttaccaaacgtctcccagactgactgttatccttaagtcagaggatgataattcatatgaggtttc

SEQ ID NO: 64792 - DNA, 601 bp, Human
cgctctgtcgcccaggctggagtgcagtggcgcgatcttggctcactgcaagctctgcctcccaggttcacgccattctcctgcctcagcctcccaagtagctgggactacaggtgcctgccagcacgcccagctaatttttttgtatttttagtagagacggggtttcaccatgttagccaggatggtctcaatctcctgatctcacgacccgcctgccttggcctccgaaagtgctggcattataggcgtgagccaccacacctggccatccttcctacttttcaatataacctctgcrgccctaaccagtacactaggtcaagaaaaaggtataaggattacaattacaaaaggaagagtcaaaattgtctttctttaaaaatggtatagttactggccaggcacggtagttcatacctgtaatcccagcgttttgggaggtagaggtgggaggatcacttgagcccaggagttcgagaccagccagcctgggcaccatagtgtgaacccatcactacgaaaaacaagaaaattagccaggcctgctggcacacgcctgtagtcccagatactcagaaggctgaggcgggaggatcaa

SEQ ID NO: 64793 - DNA, 601 bp, Human
ttttttttgagacggagtctcgctctgtcgcccaggctggagtgcagtggcgcgatcttggctcactgcaagctctgcctcccaggttcacgccattctcctgcctcagcctcccaagtagctgggactacaggtgcctgccagcacgcccagctaatttttttgtatttttagtagagacggggtttcaccatgttagccaggatggtctcaatctcctgatctcacgacccgcctgccttggcctccgaaagtgctggcattataggcgtgagccaccacacctggccatccttcctayttttcaatataacctctgcggccctaaccagtacactaggtcaagaaaaaggtataaggattacaattacaaaaggaagagtcaaaattgtctttctttaaaaatggtatagttactggccaggcacggtagttcatacctgtaatcccagcgttttgggaggtagaggtgggaggatcacttgagcccaggagttcgagaccagccagcctgggcaccatagtgtgaacccatcactacgaaaaacaagaaaattagccaggcctgctggcacacgcctgtagtcccagatactcagaa

SEQ ID NO: 64794 - DNA, 601 bp, Human
tttttttttttttttttttttttgagacggagtctcgctctgtcgcccaggctggagtgcagtggcgcgatcttggctcactgcaagctctgcctcccaggttcacgccattctcctgcctcagcctcccaagtagctgggactacaggtgcctgccagcacgcccagctaatttttttgtatttttagtagagacggggtttcaccatgttagccaggatggtctcaatctcctgatctcacgacccgcctgccttggcctccgaaagtgctggcattataggcgtgagccaccacaccyggccatccttcctacttttcaatataacctctgcggccctaaccagtacactaggtcaagaaaaaggtataaggattacaattacaaaaggaagagtcaaaattgtctttctttaaaaatggtatagttactggccaggcacggtagttcatacctgtaatcccagcgttttgggaggtagaggtgggaggatcacttgagcccaggagttcgagaccagccagcctgggcaccatagtgtgaacccatcactacgaaaaacaagaaaattagccaggcctgctggcacacgcctgtagt

SEQ ID NO: 64795 - DNA, 601 bp, Human
ctgcatcccgactaccttgggcacatgttctcaggacctcctgagggctgtgtcacgggccatggtcactcatatttagcttcgaataaatctcttcaaatattttacagaatttgactctttttgtcaacagaaaatatgaaatatatgtgtattcattaaaaaggctagacaaaataaactcttcagtgacaaggcaaagactgccatattagtttttttctaaatattctagcttatgctacttacaagagacaaaaacataagaattaagaaatttaagtaaaagaatgaaaagatrcatactgtactaagtatgctaactgaaagaaagccagcattagctctatcaatatgctacaaaatagacttcaaagcatcaaaagcattactagaaaaagagggtaactacacaatgacaaaggattcactttcctagatagacataacattttaaaggtacatgcatccaagaattaaagttctaaaagctaacagaagtacagggaaaaaattaatactcttgatcaaagcagaaatatttaacatctttcagtgattaagatcaagcaatcaaatcaccaaggacaaaaaagatttt

SEQ ID NO: 64796 - DNA, 601 bp, Human
agcactttgggagcccaaggcagctgaatcacctgatcaggagtttgagacagcctggccaacatggtgaaaccctatccctactaaaaatacaaaaattagctgggcatggtggtgagcacctgaaatcccagctactccagaggctgagacaggataatgacttgaaccctggaggcgaaggcggaggcttcagtgggccgagattgtgccactgcactccagcctgggtgacaaagcgagattctgcatcaaaaataaaaaaatgagaaataagaaatttttcaacagattattagtycaaataactaacacaaatgacttccttatctttttctttgcaataagaataaaaaccctgggggacagagatgaggccagaggtcccaccagagaggaagatacaaatacaaccaagaccactgaatactgtaaggatgactctctcagtgggtgaactaggaaaaaaagagaaagcatcccacaaagggaaatgctggggacacaagcctttgtccaccttgatttagacttaaatttatctgaatttaacaaaaataagaataatagcaagcaaagaaagtggtaactaaatggctgg

SEQ ID NO: 64797 - DNA, 601 bp, Human
atgacaacatcaggaagttaccctagatggtctaaaaaggggaggcatgaataatccacctcttgtttagcatatcattaagaaataaccataaaaatgggcaaccagcagcccttgtggctactctgtctatggagtagccattcttttattcctctactttcttaataagcttgctttcactttacggacgcactgagaattctttcttgcgtgagatccaagagccttctcttgggatctggatcgggacccctttcctgtaacaaacccatggaagatacaggaagtaagtgtattktgtttaaaatgcaatgcaaatggggagaggaggaaaaaaggaagaagggagaagagatatagagctagaagatgtaagcataatataatgctaaattgtctgaaatttttcacaaccatttatgattgaaaaaatttttggctgggtgtggttgttcatgcctgtaatcccagcactttgggagcccaaggcagctgaatcacctgatcaggagtttgagacagcctggccaacatggtgaaaccctatccctactaaaaatacaaaaattagctgggcatggtggtgagcacctgaaat

SEQ ID NO: 64798 - DNA, 601 bp, Human
gtgagataagtaacagccaatttggcatgcctgtgcacgtgtgtgtgtatatgtgtatgtgtgtgtgttgataggagaaggcaggatatgaagctaaatcttctaactccaatcacagtgaagatcatatgatgccaggggttaattagtatcatctgatcataagcattgcctggcactatgctcaatgtataaaattccaggtcccactgcagatcaacttcctgaaacaaaatctccagtgagaaaccctgggacactatttttttttttttagacagggtctcactatgttgcccargctggaatgcagtggtgcaatctcggttcactgcagccttgacctctcgggctcaggtgattcacctcagcctcctgagtagctgggaccacaggtgtgtgccaccacacccagctaattttttgtattttttacagagatggggtttcactatgttgcccaggctggtcttgaactcccgagctcaatggatttgcctcccttgcccttccaaagtgctgagattataggcatgagccaccatgcctggcctggaatcttcatttttaacaagtgccccagtagagtgtttttgggttt

SEQ ID NO: 64799 - DNA, 601 bp, Human
tgagtaaaaagatataaataatacaagtgagataagtaacagccaatttggcatgcctgtgcacgtgtgtgtgtatatgtgtatgtgtgtgtgttgataggagaaggcaggatatgaagctaaatcttctaactccaatcacagtgaagatcatatgatgccaggggttaattagtatcatctgatcataagcattgcctggcactatgctcaatgtataaaattccaggtcccactgcagatcaacttcctgaaacaaaatctccagtgagaaaccctgggacactatttttttttttttagacagggtctcactatgttgcccaagctggaatgcagtggtgcaatctcggttcactgcagccttgacctctcgggctcaggtgattcacctcagcctcctgagtagctgggaccacaggtgtgtgccaccacacccagctaattttttgtattttttacagagatggggtttcactatgttgcccaggctggtcttgaactcccgagctcaatggatttgcctcccttgcccttccaaagtgctgagattataggcatgagccaccatgcctggcctggaatcttcatttttaacaag

SEQ ID NO: 64800 - DNA, 601 bp, Human
caactacttccaaatatttcttatttgagatattggcccaaagctgattcccactgacagcttcctatattttgtgtaactgtgctttcgtgaaaaaggatacagttctactctgttaacatgttgaagaaaaatgcaacctcagatgagattttagtgcactgcaaacacctttgatttccagacaagggaagagttttagaaaaatgacaaatgtagaagccagatcaacttcaaagtcttttttgtttgtttggacggagtctcgctctgtcacccaggctggagtgcagtagcacgrtctcggcttactgcaagctctgcctcccgggttcacgccattctcctgcctcagcctcccgagtagctgggacaacaggcacccacaaccacgcccaactaattttttgtatttttagtagagacagagtttcaccatgttagccaggatgatctcgatctcctgacctcatgatccacccgcctcagcctcccaaagtgctgggattacaggcatgagccaccacacccagcccaaagtctttttatgagtaaaaagatataaataatacaagtgagataagtaacagccaatttggca

SEQ ID NO: 64801 - DNA, 601 bp, Human
cttcctttataaaatttggcagcaagttttgactcaataaggggacagagaactggcacaaattatcttgtatcagtatttataggcatctctcatttgtcttcattacacggtatggaggcggggggtggagggggttaaaggaaggatttttccaggtttttggtttttgtatactgaacaaaaagtgaaggtttatcttagtctgacttcaatcaaccttcctcctgatgtcatgattaaaattatttcctcaggggatacctggttctcacaaaatatttatccctctctctctatrtattatacagtcccactttctctttttaaatataaaagctttattaaaatataattcaaagtccagatgcagtagctcacacctgtaatctcagtactttggggggctgaggtaggaggatcagttgagcccagcagtttaaaaccagcctttttttggccaggcgcggtggctcatgcctgtaatcccagcactttgggaggctgaggcgggcggatcacaaggtcaggagatcaagaccatcctgactaacatggtgaaaccccgtctctactaaaaatacaaaaaattagccgggtg

SEQ ID NO: 64802 - DNA, 601 bp, Human
tccttcctttataaaatttggcagcaagttttgactcaataaggggacagagaactggcacaaattatcttgtatcagtatttataggcatctctcatttgtcttcattacacggtatggaggcggggggtggagggggttaaaggaaggatttttccaggtttttggtttttgtatactgaacaaaaagtgaaggtttatcttagtctgacttcaatcaaccttcctcctgatgtcatgattaaaattatttcctcaggggatacctggttctcacaaaatatttatccctctctctctmtatattatacagtcccactttctctttttaaatataaaagctttattaaaatataattcaaagtccagatgcagtagctcacacctgtaatctcagtactttggggggctgaggtaggaggatcagttgagcccagcagtttaaaaccagcctttttttggccaggcgcggtggctcatgcctgtaatcccagcactttgggaggctgaggcgggcggatcacaaggtcaggagatcaagaccatcctgactaacatggtgaaaccccgtctctactaaaaatacaaaaaattagccggg

SEQ ID NO: 64803 - DNA, 601 bp, Human
tatccttcctttataaaatttggcagcaagttttgactcaataaggggacagagaactggcacaaattatcttgtatcagtatttataggcatctctcatttgtcttcattacacggtatggaggcggggggtggagggggttaaaggaaggatttttccaggtttttggtttttgtatactgaacaaaaagtgaaggtttatcttagtctgacttcaatcaaccttcctcctgatgtcatgattaaaattatttcctcaggggatacctggttctcacaaaatatttatccctctctctmtatatattatacagtcccactttctctttttaaatataaaagctttattaaaatataattcaaagtccagatgcagtagctcacacctgtaatctcagtactttggggggctgaggtaggaggatcagttgagcccagcagtttaaaaccagcctttttttggccaggcgcggtggctcatgcctgtaatcccagcactttgggaggctgaggcgggcggatcacaaggtcaggagatcaagaccatcctgactaacatggtgaaaccccgtctctactaaaaatacaaaaaattagccg

SEQ ID NO: 64804 - DNA, 601 bp, Human
cagcccatcaaaatgatttcatgaagcattaatgggtaacaactcacaatgtaaaaaataatgctttgagaaaccactggagaaagaaacatcacttcgatctaggatggcatgataaactcttcggagagaattttaagttaagatttgtgagtaagacttaaagtagagtagaatttatcagctgtaacgtgatttgcccaagattatttgtttataataaatggcaaaaccaggtctaacagagccctcagaaataatagcacacatctacaaccatctgatctttgacaaacctgaygaaaacaagaaatggggaaaggattccctatttaataaatggtactgggaaaactggttagccatatgtcaaaagctgaaactggatcccttccttacaccttatacaaaaattaattcaagatggattaaagacttaaatgttagacctaaaaccataaaaaccctagaagaaaacctaggcaataccattcaggacacaggcatgggcaagaacttcatgtctaaaacaccaaaagcaatggcaacaaaatccaaaattgacaaatgggatctaattaaactaaagagcttctgcaca

SEQ ID NO: 64805 - DNA, 601 bp, Human
catagatacatccagatatcagaacacatttagccttaccacataagttgcattctaatattttatttttcttccttttttttcctattatatgtttttaattctggctacagcccatcaaaatgatttcatgaagcattaatgggtaacaactcacaatgtaaaaaataatgctttgagaaaccactggagaaagaaacatcacttcgatctaggatggcatgataaactcttcggagagaattttaagttaagatttgtgagtaagacttaaagtagagtagaatttatcagctgtaaygtgatttgcccaagattatttgtttataataaatggcaaaaccaggtctaacagagccctcagaaataatagcacacatctacaaccatctgatctttgacaaacctgacgaaaacaagaaatggggaaaggattccctatttaataaatggtactgggaaaactggttagccatatgtcaaaagctgaaactggatcccttccttacaccttatacaaaaattaattcaagatggattaaagacttaaatgttagacctaaaaccataaaaaccctagaagaaaacctaggcaatacca

SEQ ID NO: 64806 - DNA, 601 bp, Human
attcatgaatatgttcatattcaatgaatgaatatgggaagactctttagcagtaaagaaaattgtttattttcttctgtttattgactgtttagtgaccctttcaataaaaagtgaaggaacaactgaaaatacatatggaaaaacttgtacagattcatgaatatattcatattcaatgaataagcatgagaagactcttcagcattgaagaaaattgtttattttcttctgtttattgaccctttcaacaaaaagtaaaggaacaactgaacatacatatggaaaaacttgaaaactsactactacttatcctgtacagtctcaaaatttttttcagatcaactctagaatcctacgtgaaaggtaacaaaataaaacctttagaacaatgcatcttttactttatattactaatgccactagcctagtcaggctctcaacactccacacgtagactactgtttcccaagaataattatggcaggaattataaaaacgagagttgttctaaggcagtggttttcgaactttttgaccacgagcacagaaatatatttaaatcatcacatacacacatatacacacaaacacatacata

SEQ ID NO: 64807 - DNA, 601 bp, Human
agggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaagaaaaaaagaaaaaaaaaaaaagaaattttaaaataatagtatcatgtcactgaagacctaggaataaatccaatgaagaggctgggagtggtggctcacatctgtaatcccagcactttgggaggccaagacaggtggatcacttgaggccaggagttygagaccagcctggacaacatggcgaaactgtctctactaaaaatacaaaagttagctgggtatggtggcgggcgcctgtagttccagctactggggaagctggggcaggagaatcaaacctaggaggcggaggttgcagtgagccaagattgcgccactgcactccagcctgagcgatagagcgactctgattcaaaacataaataaataaaaatttaaaaaataaaaaacatccaatgaaggatgtgcaacatctctacaaagaaattaaagacctaaatagttctagggatgaccata

SEQ ID NO: 64808 - DNA, 601 bp, Human
acatgtgctgtgtccactcagggttaaatggattaagggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaagaaaaaaakaaaaaaaaaaaaagaaattttaaaataatagtatcatgtcactgaagacctaggaataaatccaatgaagaggctgggagtggtggctcacatctgtaatcccagcactttgggaggccaagacaggtggatcacttgaggccaggagttcgagaccagcctggacaacatggcgaaactgtctctactaaaaatacaaaagttagctgggtatggtggcgggcgcctgtagttccagctactggggaagctggggcaggagaatcaaacctaggaggcggaggttgcagtgagccaaga

SEQ ID NO: 64809 - DNA, 601 bp, Human
tctctgaaacatgtgctgtgtccactcagggttaaatggattaagggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaakaaaaaaagaaaaaaaaaaaaagaaattttaaaataatagtatcatgtcactgaagacctaggaataaatccaatgaagaggctgggagtggtggctcacatctgtaatcccagcactttgggaggccaagacaggtggatcacttgaggccaggagttcgagaccagcctggacaacatggcgaaactgtctctactaaaaatacaaaagttagctgggtatggtggcgggcgcctgtagttccagctactggggaagctggggcaggagaatcaaacctaggaggcggaggttgcagtg

SEQ ID NO: 64810 - DNA, 601 bp, Human
ttgtcgaatagaaaagggggaaatgtggggaaaagatagagaaatcagattgttgctgtgtctgtgtagaaagaagtagacatgggagactccattttgttctgtactatgaaaaattattctgccttgggatcctgttgattggtgaccttacccccaaccctgtgctctctgaaacatgtgctgtgtccactcagggttaaatggattaagggcggtgcaagatgtgctttgttaaacagatgcttgaaggcagcatgctcgttaaaagtcatcaccactccctaatctcaagtacccmgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaagaaaaaaagaaaaaaaaaaaaagaaattttaaaataatagtatcatgtcactgaagacctaggaataaatccaatgaagaggctgggagtggtggctcacatctgtaatcccagcactttgggaggccaagac

SEQ ID NO: 64811 - DNA, 601 bp, Human
attgagaacgggccatgatgacgatggcggttttgtcgaatagaaaagggggaaatgtggggaaaagatagagaaatcagattgttgctgtgtctgtgtagaaagaagtagacatgggagactccattttgttctgtactatgaaaaattattctgccttgggatcctgttgattggtgaccttacccccaaccctgtgctctctgaaacatgtgctgtgtccactcagggttaaatggattaagggcggtgcaagatgtgctttgttaaacagatgcttgaaggcagcatgctcgttaaragtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaagaaaaaaagaaaaaaaaaaaaagaaattttaaaataatagtatcatgtcactgaagacctaggaataaatccaatgaagaggctgggagtggtggctcaca

SEQ ID NO: 64812 - DNA, 601 bp, Human
agctcattgagaacgggccatgatgacgatggcggttttgtcgaatagaaaagggggaaatgtggggaaaagatagagaaatcagattgttgctgtgtctgtgtagaaagaagtagacatgggagactccattttgttctgtactatgaaaaattattctgccttgggatcctgttgattggtgaccttacccccaaccctgtgctctctgaaacatgtgctgtgtccactcagggttaaatggattaagggcggtgcaagatgtgctttgttaaacagatgcttgaaggcagcatgctcsttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaataaaaaaagaaaaaaagaaaaaaaaaaaaagaaattttaaaataatagtatcatgtcactgaagacctaggaataaatccaatgaagaggctgggagtggtggc

SEQ ID NO: 64813 - DNA, 601 bp, Human
aaaggacttgccacaaacatattacttaatagtaaaatgaaaggttttgctctgataatgggaatgagataaaaaatgcccactatcatcatttctgtagtacttgaggccaaaccaatacaaatattcagataaagaaataatcagtgtattggaaatgagtaactgaaactgtcattattcagaaataacaaaactatgtacatagaaatcaaagattctacagataaattaatatgagtcgagaacaattgctagaaataagatcaagatcaagatcactgtatttctgtacatcagyaacataacaatgaaattttaaaatagctctccctctccctctccctctccctctctttccacggtctccctctgatgccgagccgaagctggactgtactgctgccatctcggctcactgcaacctccctgcctgattctcctgcctcagcctgcccagcgcctgccattgcaggcgcacgccgccacgcctgactggttttcgtatttttttggtggagacggggtttcgctgtgttggccgggctggtctccagctcctaaccgcgagtgatccgccagcctcggcctcccgaggtgc

SEQ ID NO: 64814 - DNA, 601 bp, Human
caaaaagtacagatacagacaattaaacttcacaactaacaaagtaggcataatgagcactatataaagtacagcctccactgatgagagaatatgttttattttcaagtacgcaaagatacatataaaaattgaccacatccttggccgggcacagtggctcaagcctgtaatcccagcactttgggaggccgaggtgggtggatcacttgaggtcaggagttcaagaccagcctggccaacatggtgaaaccccatctctactaaaaatacaaaaattagccaggtgtggtggctcatrcctctaatcacaactactcgggaggccaagacaggagaatcgcttgaacctgggaggcgaagtgcagtaagctgaaatctcagccctgcactccagcctgggccacagaacgtgactctgtctcaaaaaaaaaaaaaaaaaaaaagaaattgaccatatcctgagccataaagcaaatctcaataaatgttaaaggattaaaatcatatgaaccatgctctctgatcaaaatgaaattaagttagaaatcataatcaaaagacaacttttaaaggaaaccttatttttagaaatgaagaa

SEQ ID NO: 64815 - DNA, 601 bp, Human
ccctgtggtcaaaaaaaaaaaaagaaagaaaaaagaaaataaagaaagatacaggaactttatatttatttacatctaacagaatagtctcaaaacatataaaacaaaaataaacataacctcaaagggacacaaaggaattcagaagcttagtgggagatattaactcacctctcttaataagtgatagtgcaaatacacactcaaaaagtacagatacagacaattaaacttcacaactaacaaagtaggcataatgagcactatataaagtacagcctccactgatgagagaatatgytttattttcaagtacgcaaagatacatataaaaattgaccacatccttggccgggcacagtggctcaagcctgtaatcccagcactttgggaggccgaggtgggtggatcacttgaggtcaggagttcaagaccagcctggccaacatggtgaaaccccatctctactaaaaatacaaaaattagccaggtgtggtggctcatacctctaatcacaactactcgggaggccaagacaggagaatcgcttgaacctgggaggcgaagtgcagtaagctgaaatctcagccctgcactccag

SEQ ID NO: 64816 - DNA, 601 bp, Human
aaaaaaggttcaataaagacattttcaagtaaaggaaatctgaaagtatactttccaacgctgaaaaactaggggaagaactgaaattaggaaaacacaactattcaaaagaaggcaagaaacacagaacaagcagcaaaaatagcacaagaaaagatggctggtgcggacccaaatatgtcagttaactgcagtgactataaacacactaacgtaccacttacaagacaaagactgacaaattcacaattttttaaataaccaaattatacgctgtttgtaagggatatgtctaaaacawaaggacataaaaaagatttaaatataagtggatgacaattttcaaccaaaacaaaggtgatgtaactttattcgtaacaggaaaaaaaggggggagggcggagcttggaaaaccatatgatcaactcaatagacatagaagtagcatttggaaaaatcaaataccctttcataataaaaacacaacaaactaaaaacagaagaaaacttcctcaacctgataaagggcatctacaacaaatcccaatgccaacatcatacttaatcagggaagactgaaagctctcccctcaagatcagg

SEQ ID NO: 64817 - DNA, 601 bp, Human
gtcaaataaagaacatcagtcccagacaacatcaaggagccaccacagcggtatgggaaggactacttccagccttcacatttaaatagcgagtatttcacgtctctgcaaatagtgacccatgcaattcctaacaatggataacttgataaaaagatcaagaactactcctaagaacttctagtctttttgaaaatttgctgtattaccttgagtcagctttactgtattactttagccgagcaactaaagcaacattttacaactgaaactttactgtatgaccctaaagagagagacwaatacaactgcattaagtaaaatattaatatgctttagaggctactcagagctctgaacaactcatagctcagccaaaaataaatttatctactgcatatttcctccattatttaagaggctgactttcttttaaattccatttccagtaataaagtaggcgcggtagctgggtctacactcttcttgaaaacgacaaaaattcctggatggaatataaaaacttcttaagtgcacaaaaaaagtaaacaatactcaactacacagaaaagagacatttccttgaaagaaaaataattaa

SEQ ID NO: 64818 - DNA, 601 bp, Human
atcaataaaaagactaacatttgaagtatttaacgacaaaatgccctggttttcaaaattaacattctgataaccagattctttctttttttccaacacaagaaggtcaattttaagcttccagatagccaaataagctctattatataaaggtatcaaagttagtaaagatgtgatcatttattctgataccatggtctatgttttaaacacatcaaagtaaaaattacccaactcactaataacatactataccccttactcttcttaactcactcattttttttttttttttttttttgctagttattttcggtgtgtgtttctacacatctgccttcaactgattcactgtccacttattctcgtctctctgtatgtgtctagctttctcggaatatggcccaggatatccttgtaccttctgcttctgagtttggtcctcccattctcccttttgccatctctgccctcttccttcctctcccttctttagccatatgctataacctgaatgcctgtgttccccaaaattcacatgttgaaatcctaacccccaaggtacggtattagaaggtgggaccttctgaagataattagg

SEQ ID NO: 64819 - DNA, 601 bp, Human
catgacttctgttggaagaaaagctacaagataaagagtaagtaagtgatggatggccaggtgtggtggctcatgcttgtaagccaagactctggaaggccgaggctggagaatcccttgaagccaagagttcaagaccactctgggcaacaaagcaaaaccctgtctctacaaaaaataaaaaataaaataaatagcctgttcacactgagaaacagctctgaaattttaaaaagcaaaagaaaatagccaggcatgatggcacgcacccaacagtcccagccactccggaggctgaagyaggagaactgcttgagcccaggagttcaaagttgcagtgagctatgatcatgccactgcactccagcctgggcagcagagcaagaccttgtctcttaaaaaaaagaaaatttaaatgtgctacaacggtggaaaatcttcccactcagcataggactctgatcttacttggctggcttttttcttatgatcctgaatccttctaaaaacaagcagggatgtaaataaatactgtacaccaacatatgaaatgtctgtgcctcccaggaaattacagttttgtttaaaaatcactaatgaa

SEQ ID NO: 64820 - DNA, 601 bp, Human
aacaaaaatatacacaaaagttataattgtatatttaaatacagttatagaaacttattaaagaagccaggcgtcgtggttcacgcctgcaatcccagcactttgggaggctaatgcaggtggatcacttgagaccaagagtttgagaccagcctcaaactgtattaataaaaatacaaaaattagccaggtgtggtgatacgcgcctgtagttccagctacatgggaggctgaggtaggagaatcgcttgaacccatgaggtggaggttgcagtgagccaagatcacgccactgctcttyggcatgggcaacagagcaagaccctgtctcaataaaaaatttaaaaagaaacttattaaagatacctactttaaaattccagtataacttggcataaagaaatagttatccgataaaattaatgaaggggtagtctcaacatccttacttccacaaatcacgttacttatatttttcccttcaaaaagaaaaaaaacttagctcttttctctcaattgtttgctttgcaggccaaacatcagcagtgactcctctgcacagaatgcttttcttggcactgaaacccctcagtctacttta

SEQ ID NO: 64821 - DNA, 601 bp, Human
ggctaacacggtgaaaccccatctctactaaaaatacaaaaaattagccgggcgtggtggcaggggcctgtagtcccagctactcaggaggctgaggcaggagaatggcgtgaacccaggaggcggagcttgcagtgagccgagatcgcgccactgcactccagcctgggcgacagagcaagaccccgtctcaaaaaaaaaaaaaaaaaaaggaaaaaaaagactcattaacccctcaattaagtattgccagtaatgtgtggtcccttaacataccatctctgagatccactgtttaacsatttttcttattcacaacagccacgtagaaatctccacacataatctcccacccaacaaactacgaatcttctcttccctccacctgtatgcactttcaggtgaacaaatgtatgcgtgcttaacatcacaggctttattaagggtcaggggatatgcaccaaagtgtcaatctgtaactcaacaggataaacagactgtataagcacagtggaaggagttttaagttcaggtaaaagtagaggaatctgagattaaggatcatagtaaatgtgagcgggatgaatttacagacaggaga

SEQ ID NO: 64822 - DNA, 601 bp, Human
gccgggcgcagtggctcatgcctctaatcccagcactttgggaggccaaagctggtggatcacgaggtcaagagatcgagaccatcctggctaacacggtgaaaccccatctctactaaaaatacaaaaaattagccgggcgtggtggcaggggcctgtagtcccagctactcaggaggctgaggcaggagaatggcgtgaacccaggaggcggagcttgcagtgagccgagatcgcgccactgcactccagcctgggcgacagagcaagaccccgtctcaaaaaaaaaaaaaaaaaaagraaaaaaaagactcattaacccctcaattaagtattgccagtaatgtgtggtcccttaacataccatctctgagatccactgtttaaccatttttcttattcacaacagccacgtagaaatctccacacataatctcccacccaacaaactacgaatcttctcttccctccacctgtatgcactttcaggtgaacaaatgtatgcgtgcttaacatcacaggctttattaagggtcaggggatatgcaccaaagtgtcaatctgtaactcaacaggataaacagactgtataagcacagtg

SEQ ID NO: 64823 - DNA, 601 bp, Human
ggccgggcgcagtggctcatgcctctaatcccagcactttgggaggccaaagctggtggatcacgaggtcaagagatcgagaccatcctggctaacacggtgaaaccccatctctactaaaaatacaaaaaattagccgggcgtggtggcaggggcctgtagtcccagctactcaggaggctgaggcaggagaatggcgtgaacccaggaggcggagcttgcagtgagccgagatcgcgccactgcactccagcctgggcgacagagcaagaccccgtctcaaaaaaaaaaaaaaaaaaargaaaaaaaagactcattaacccctcaattaagtattgccagtaatgtgtggtcccttaacataccatctctgagatccactgtttaaccatttttcttattcacaacagccacgtagaaatctccacacataatctcccacccaacaaactacgaatcttctcttccctccacctgtatgcactttcaggtgaacaaatgtatgcgtgcttaacatcacaggctttattaagggtcaggggatatgcaccaaagtgtcaatctgtaactcaacaggataaacagactgtataagcacagt

SEQ ID NO: 64824 - DNA, 601 bp, Human
cacaacccagggagctttatcccaagaatataaggctattttgacatatgaaaaccaatcaatataattcactatctcaacagaccaaaaagagagaaaggcgatacgaccatttgaatagatgcagagatgacaaaattcaacatcaattcctgacactctcagaaaactcaggaaaaaaagagaatttcttccatgtgacaatgggcatctttaaaaataatcatggtgaccatcatactcagtgaagaaagactgagtgcttgtcccctaagattaagaacaaatcaagaggactgcycccaccactccttgtcaacctcacactgcagaacccagctggtgaaataagacaagaaaaataaacaaaaaacacattagaagtaaagaaataaaactgtgtccattccaggcaatatgatcatatgtagaaagctatagaactactaacaacactataataagtgagtttaacaacattgcagaatgtaaggtcaacataaaaaattcaattttatttctctaaactagcagaagactattggaaatacaacagcaacaaaaatataaataattaaataatattttttaaaagcatgtt

SEQ ID NO: 64825 - DNA, 601 bp, Human
ggtgcacaccaccatgcccagataatctttttatttttagtagatacagggtttcacgatgttggccaggctggtttagaactcctgacttcaggtgatccacccacctcggcctcccaaagtgctgggattgcaggcgtgagccactgcacccagcccagtaacatctatcctgacttctagtatcataggtcagatttggcagcaattgaacttcatacaaatggaatcttacagtatgcactcttttgtgtctggcttctttcactcaacaaaatatctacaagattttttatgttgwtacatatattagttcatcctgctatgcagcattctgttgtatgaatatactgcattttatccattctcttactgagggatattttcaaactctatattttaaactattcgatgagcaggacaaacaaaacatgagtcactgcctatactataggtacaaataaatacttgttgacttattgatattccttactaaaagaaagaaaaaaaagctgcttgtgggtaaaagtgaaaccagtggcacaagaactgataacattctaaggattatatacaatcagccctcagtattcatgggcaa

SEQ ID NO: 64826 - DNA, 601 bp, Human
atataattttaagctctaaccatgatcaacgattatgcctttagttaattctgtatggtatcctttttaacttttcattaaagtataatgaacctatagaaaagtgcataattcatgaatgaactttcacaaaatgttccctcatgaacatttaaagttcactgaatgaactttcacaaaataaatacccaggtaactaaccagcactcaggtcaaaagacagaacattactagcacccagaagcacctctttcctaaacccacttcccaccgtggtaacttctatcctttttttttttttgagacagaatctctctctgttgcccaggctggagtgcagtggtgtgatcttggctcactgtaacttccacctcttgggttcaagtgattctcgtgccttagcctcccgagtagctgggattacaggtgcacaccaccatgcccagataatctttttatttttagtagatacagggtttcacgatgttggccaggctggtttagaactcctgacttcaggtgatccacccacctcggcctcccaaagtgctgggattgcaggcgtgagccactgcacccagcccagtaacatctatcctga

SEQ ID NO: 64827 - DNA, 601 bp, Human
ggggcagctacattcagtgttctggggcagcagagataatgattcttggggcagcacccagagcccagcatcagtggtgtttggagcacaagcagcaaggtctgtggccagagaggtgtcttcatgagagttctgtgcaatcattttgcactatgttcctagcagtgtagttttcaagcctactttcccaacctacttacagaatctgtgggtcacccttttaattaattagccagagatggtatctattacttacaactaagaactctgatggatacagcttctaacctgaagtaaagtrgcccacaaagatgaagcaacaaaagaaactattgctgaagtccagagtgggattaagaatgcctgatgggccgggtacagtggctcacgcctgtaatcccagcactttgggaggccgaggcaggcagatcacctgaggtcgggagttcaagaccagcctgaccaacatgaagaaactccgtctctactaaaaatacaaaattagccaggtgtggtggcgcatgcctgtaatcccagctactcagaaggctgaggcaggaaaattgcttgaacccaggaggcggaggttgcagtgagctga

SEQ ID NO: 64828 - DNA, 601 bp, Human
ttatggcactctgaacactgtactgaaattacacgtgtgtctcctgctacagcactagcacaggggagcacaatcacatagctcagaacagggctctgacatctgagttaaaaccccagctttgcccccttggttaactcatcgataaaatgaagaaaatatcacctgctgctcaaaggaattttaaggattccatgagaaaatacatgtaaagcacctagcacaattcttggcatatcttagggagttaataactaataactgaataaataaaaaccataagcagcaaaattaaatagtygtgaatttcatctcttttgatttcatctaatcaccttcttatagtatctaatgaatggtaaaatgccaaaatgactaatggttaaaaaaaaattagcaaagataacaggaatttttttaaaaaaacaggtcatcagcttctaaataactgtggctgactctagagtagtaaggaataatgtaatcacagcaaacatcacctgatgaagaatggagttattaagagctaaaccagaccgaactcagtaaaagcaatcaaatttactttaactaaaagttctcaatataatcattttcaagc

SEQ ID NO: 64829 - DNA, 601 bp, Human
attaagacttcagtctcatcccttgaaagctggcatccagtttcctactctgtggctactgctttatggcactctgaacactgtactgaaattacacgtgtgtctcctgctacagcactagcacaggggagcacaatcacatagctcagaacagggctctgacatctgagttaaaaccccagctttgcccccttggttaactcatcgataaaatgaagaaaatatcacctgctgctcaaaggaattttaaggattccatgagaaaatacatgtaaagcacctagcacaattcttggcataycttagggagttaataactaataactgaataaataaaaaccataagcagcaaaattaaatagttgtgaatttcatctcttttgatttcatctaatcaccttcttatagtatctaatgaatggtaaaatgccaaaatgactaatggttaaaaaaaaattagcaaagataacaggaatttttttaaaaaaacaggtcatcagcttctaaataactgtggctgactctagagtagtaaggaataatgtaatcacagcaaacatcacctgatgaagaatggagttattaagagctaaaccagacc

SEQ ID NO: 64830 - DNA, 601 bp, Human
atatctaaatctatatctaatgggccatctagctttccaactttcagtgtcatggtaaagtaagaaaaagcacaaaaaacaaatacacctatgaagtaatcttgccgaaaaacttgtattaatacttgaatctgatcaaacctctgtatctttcaatttaaaaaaaaaaaagggcatggaggaatattgcaaggactcagtcatccaaatccgggctcacagggtaccacactaccacactacctcattaagacttcagtctcatcccttgaaagctggcatccagtttcctactctgtgrctactgctttatggcactctgaacactgtactgaaattacacgtgtgtctcctgctacagcactagcacaggggagcacaatcacatagctcagaacagggctctgacatctgagttaaaaccccagctttgcccccttggttaactcatcgataaaatgaagaaaatatcacctgctgctcaaaggaattttaaggattccatgagaaaatacatgtaaagcacctagcacaattcttggcatatcttagggagttaataactaataactgaataaataaaaaccataagcagcaaaat

SEQ ID NO: 64831 - DNA, 601 bp, Human
aaacctcagaagaatatttaaataaaaccataattcttattaccaaaaacatgttctatattgcagctaactttgaaatgaagataaactggataacagttgaccaaatacattaagatctttctttggaatatctaaatctatatctaatgggccatctagctttccaactttcagtgtcatggtaaagtaagaaaaagcacaaaaaacaaatacacctatgaagtaatcttgccgaaaaacttgtattaatacttgaatctgatcaaacctctgtatctttcaatttaaaaaaaaaaaagggcatggaggaatattgcaaggactcagtcatccaaatccgggctcacagggtaccacactaccacactacctcattaagacttcagtctcatcccttgaaagctggcatccagtttcctactctgtggctactgctttatggcactctgaacactgtactgaaattacacgtgtgtctcctgctacagcactagcacaggggagcacaatcacatagctcagaacagggctctgacatctgagttaaaaccccagctttgcccccttggttaactcatcgataaaatgaagaaaatat

SEQ ID NO: 64832 - DNA, 601 bp, Human
taaattgcacagtcaaattaattgataattaagcatgttttaatacataatgggctttacagtctacaaattttgtttccttgagttatattttgggtttctgacattactgaattttgattgtgcttttaattaaagtccatattccgattataaatcattggtatttagaatcctgataaaagttacctccgaatctaggacatagtctctaatggccacaacaatgaaccatctctgtaaatgaatgctacctggagacagaaactctcttaagacaaatctgaaaaatctaagaaaygttttaaacagaaagtacaaatatttgttcagtcattcaaatgctatcttgatactaaaaccaaaaaccccatgtcaaataaaaaaggtagagaggagaaaatcataggaaaaattctaagaaagtaaaaagcaggaagatcaaagcagaaaaaaaaaagtagaaatgctaaaacattccataaatgagaaaacttaatataacaggagcattaatagaggtaacaacagagagtccagtcagtagaaggaggttggagcaaacaagaagaaccaaaacaatggaataattaggtatgag

SEQ ID NO: 64833 - DNA, 601 bp, Human
tctacaaaaaataaaaaaaaattagctaggcatggtggcaggtgcctgtactcccagctactcaggagactgaagggggaggaccgcttgagtgcagaagttgggggctgcagtgagctctgatcataccactacactccagcctgggtaacagagcaagaccctatctcaaaaataaataaatagctgctagtcttacaaggaggaaaataatcgttcattgaatctgaatgaaaacaaagggtcaacatgggaggtggcagacactgccaggtgcctcagtatcttcttccccttctcrctcactagctgagcccgactgctgggaatgactatgtgccacttaacgaatgacttctcagcctcctttgcacattgcaatgctggagtagatgtctggaaaaccctttgctttcttcatagaggcaactctttcttccttctgcctggagtaagtacagaggcctgggatatggcaaacatcttttgatcctaaggacgaaggccatatggcagaagaaagacgggaagaagtgaagtctgtgaggacagccataagtcagggtaccaactttgaacttctcagcgtttggacttattt

SEQ ID NO: 64834 - DNA, 601 bp, Human
accagctaggaaaccttgtaaacaatgcacaaaggaggttgtgggggagcctggattacagcagtgacagtgtgtgcggggacaggggaggccaagtccaaggcatttcaatgcaaggaactgcagttgatggcaaactagattacggaataaaggaagtttaaaagttaggattattttaagtttctagtttggggaaatgatgacaaatcctgattgacataagcaaatcaaagataaagatattacacttagctttgaacattactgtttgaactaactagcaattttttttttttttagacggggtctcactttgttgcccaggctggagtgcagtggtgtgatcttggctcactgcaagctccacctcctgggttcacaccattctcctgcctcagcctcctgagtagctgggactacaggcgcccgccaccatgcccagctaattttttgtatttttagtagagacggggtttcaccgtgttagccaggatggtctcaatctcctgatctcgtgatgcacgcctcggcttcccaaagtgctgggattacaagtgtgagccacagtgtctggcccaaactagcaaatttttaagtg

SEQ ID NO: 64835 - DNA, 601 bp, Human
aaggtcaaaaagttcagaggccaaatcaagtttaaaaccacacctatctgactccaaaataaataccattacaccacactccttcaaaatataatttagaatagatacaaaaacacataagcaggaattgtcaagttctaaaataaagacatttggaagctaggccttgaaagagaggatctggaatgatggggtcaaaacaggttgaggatagggactggggggcactaaagaagagtaggataaaagtctatgacaggagcatgcagcctgtatctcttaccggtgataagcaggaaayagggtattgaagaaaaaattctacaacagccaatttatagtgagaaaaaaagaaaaataaagactgaataggaagagtatttctgttataaaagaaaacgatgaaagagggaagcaatctggatttagcttaaaaacttttaagtagagatcaaatttttagaaagctaggtttcaaggcaattagactgttaatgaccggcacacaatgaataaaagaaaaagaatggaattggagacaccagctaggaaaccttgtaaacaatgcacaaaggaggttgtgggggagcctggattacag

SEQ ID NO: 64836 - DNA, 601 bp, Human
actgagactgcttttatcactgtatgcagtctcatattttttcttagaaacaagcgtttgtttgttgctctttgttattctaatctagactgacaactattaccctacatgccattctcacttcccttcctccacccttgactacctcttcccatttttaaaaggggagaggagtaaccccttaaaaatgaaaaatccagtatcaataaaataacatgagaaaataaaataatttagctatagatcatcattgctacagtctccaacttcatcatttccaacaaaaactcctataatgtgyaacatagaaatatttacccattgccttatcatttaaatgatgtatgacatttagttaactgtcttgaaagggacacttctaaagttttcaggttaaaacatttttatgcaaacttctgagtatagttacagagatattttatctgacaagggcaaacatacattaatcagagttacagagttgttgtaactgaaaggggcagtctttcaattattttcacactgaatttccccacatcacagatttattttggactttgaaaataagagtaatttataatgacaaaataatataatgtta

SEQ ID NO: 64837 - DNA, 601 bp, Human
gacgttttccaaaaacatgaggaatgaaactagcagagccatgtccaagcactctgtcttccaccaaccacgtgatctggagaaaatcactgaacatctctgagtttcagttttctcatctttcaagggctaaaatagcagttctcagtgtcatcagggaacccctggaaggtatttaaacattttcatggagtttcacggagctttggaatatttcataataatactaagacattattggtctttttcaatctaattctctgaagagtgtacagtggggttttccagagacaatgtgacraagccacaattatctaaaaaggctactaaaagactctccctttcccaactatatagctgtccggggccaaattttcttccaaattttaaccaaaagagcatatcacaacagattgaatggataagcaaacatgggaatccatgtgtcttctatagaggcaaatattaaagataagcaaaaatacaaaaccatggcactcttctcattaaatttttgttttgaaatagttatttgtcataaaaatgttatttatgttaacatataataggttcatcattatttttaagtgacttagttttc

SEQ ID NO: 64838 - DNA, 601 bp, Human
atatatgacgttttccaaaaacatgaggaatgaaactagcagagccatgtccaagcactctgtcttccaccaaccacgtgatctggagaaaatcactgaacatctctgagtttcagttttctcatctttcaagggctaaaatagcagttctcagtgtcatcagggaacccctggaaggtatttaaacattttcatggagtttcacggagctttggaatatttcataataatactaagacattattggtctttttcaatctaattctctgaagagtgtacagtggggttttccagagacaaygtgacgaagccacaattatctaaaaaggctactaaaagactctccctttcccaactatatagctgtccggggccaaattttcttccaaattttaaccaaaagagcatatcacaacagattgaatggataagcaaacatgggaatccatgtgtcttctatagaggcaaatattaaagataagcaaaaatacaaaaccatggcactcttctcattaaatttttgttttgaaatagttatttgtcataaaaatgttatttatgttaacatataataggttcatcattatttttaagtgactta

SEQ ID NO: 64839 - DNA, 601 bp, Human
tcaagatgacaaggtagaattagattttgatatctctgaagaccctcataaataaacttaggatcaatctccaaaaattgtcctaaagtcacaccatatatgacgttttccaaaaacatgaggaatgaaactagcagagccatgtccaagcactctgtcttccaccaaccacgtgatctggagaaaatcactgaacatctctgagtttcagttttctcatctttcaagggctaaaatagcagttctcagtgtcatcagggaacccctggaaggtatttaaacattttcatggagtttcacrgagctttggaatatttcataataatactaagacattattggtctttttcaatctaattctctgaagagtgtacagtggggttttccagagacaatgtgacgaagccacaattatctaaaaaggctactaaaagactctccctttcccaactatatagctgtccggggccaaattttcttccaaattttaaccaaaagagcatatcacaacagattgaatggataagcaaacatgggaatccatgtgtcttctatagaggcaaatattaaagataagcaaaaatacaaaaccatggcactc

SEQ ID NO: 64840 - DNA, 601 bp, Human
ttgaacaataaaagttctgcttaccattctcaacatgggcaagcctgtgcatgagaggtagccagacaaggcactggggaggagggtcagccatcattgtgtctaaaaacatatttagcattatctttctctgtaaagagaagaaaaacaaacatactttaagttttttaggaatctccaaactccaagtttaatttaggatttttcccatccaaactttagtgaattacacggtaaattttatagcaaaataaaatattttacattactacagacactactacatgctgtactttacactactactattagtatattcaaatgtattcccatatacattattttattttagtcaactgtataaggtaaactaggttagacattactatattcactttacagataagcaaataaaccatttaaaagttttgtagtggcctggcccaaatcagacacaaacccaagactgtccttcaagtcaccatttccgctttccagtggggaagagaagacaccccacacccaagtataagagcagggactgtggctggttgtctaccatatttccagctctcctaacagtgcctggcacacaagatgc

SEQ ID NO: 64841 - DNA, 601 bp, Human
ctgtatgtatcttataactcaatgaaaaaattcaagagtagatgaaaacatgcaaatcataaagcagtatcagtcacttgtctctaaacaaatacaaaacccccatttttaaaagagttataggttagccaaatgaggaaattcaaaccagggggaataagaagttcccaattctcttagccccaacatccggaataagaattttcagtagaaatataccagcaaactcagtcatcatgaaaggtaaaacagcaaaaactatcccagtgtaaagaattagactctacacacacacacacamaaaaaaaaaaccagtggaaaaaacattaacaattaacatagtgaagtacttgtactttaagaaagcaaaaagaaacaatttgaaaatctgtaaattttctttattcaatgaaaaagaaaagaaactactgtgtttttttcctttttttggattttaaaagtggctcttcacaaccaccaccaccaaaaaaaatggaattcacaacacaacaagacccaggataggatattcagtttaacaaaattttatcattaattataacagaaacctatctaggaaaaaaaaaggatctttaacaga

SEQ ID NO: 64842 - DNA, 601 bp, Human
ggctgggctccatggcttatgcctgtaatcccagcacaggaaggtagaggtgggcagatcacttgtgctcagctcaggagtctgagaccagtctgggcaaaactagcaaaacactgtctctacaaaaattatctgggaatggtggcacacgactgtagtcccagctactcaggagggtgaggtgggaggactgcttgagcccaggaggtcaaggctgtagtgatccatgatcacgccactgcactccagatggacaatagagtggtttcctgtctcaaaaaaaaaaaaaaaaaaaaaaaaagaagaaaaaaaaatgggttagaaatagatattcatttattcattaggagacttagctattctagctgtctccatctttcttaaacctactttaatcggtttttgcccccatcactccacagaaactgttctccagacaatctccacattgttagacaaagggtcagttcttattccttacttgactgttggcagcatttgacacagttgatcacttcctcctcctcaaaacacattcttcacttgttttccagaacacacactctcctggctttcatcccacctcactggaggcaggatc

SEQ ID NO: 64843 - DNA, 601 bp, Human
gttgaataaaaatggcaggagtggatatccttgtctttttcctggttttaggggaaaagctttcagtctttcactattaagtatgatgttaactgtgggtttttctttcttaagagacagggtctcactctgtcacccaggctggagtgccagtgatgcaatcataacttactgcagcctcaacctcccaggctcaagtgatcctcccacctcagcctcctgagtaggcaggactacaagtgtacaccaccaagcccagctatttttttttcattattgttattattttggtagagatagsgtttcactatgttgctcaggctggtctcgaattcctggcttcaagtgattctccctcctgagtctctcgaagggattaaaggtgtgagccactctgactgaccactgtgggtttttcatagatgtcctttttcaggttgagaaagttctcttctattcccagtttattgcattttttttttatcgtgacagaattttgggttttgtcaaattcctttttcatatttattgagatgatcttatttttcatcctttagtctgttaacaaggtatattatactgatttttgcatgcaaaccaa

SEQ ID NO: 64844 - DNA, 601 bp, Human
gaaaccacaattacttttgcaccaatctaatatttttgtattgattttgtatcttataaacttggtaaatttattatctataatggttttttgtgtgtgttaggattttctatatacaagatcatgtcatctgtgaagagaggtagttttacttcttccttttcaatatggatgcattttgcttgctttcttgcttaagtaccctggctaggaccttcagtacaatgttgaataaaaatggcaggagtggatatccttgtctttttcctggttttaggggaaaagctttcagtctttcackattaagtatgatgttaactgtgggtttttctttcttaagagacagggtctcactctgtcacccaggctggagtgccagtgatgcaatcataacttactgcagcctcaacctcccaggctcaagtgatcctcccacctcagcctcctgagtaggcaggactacaagtgtacaccaccaagcccagctatttttttttcattattgttattattttggtagagatagcgtttcactatgttgctcaggctggtctcgaattcctggcttcaagtgattctccctcctgagtctctcgaaggg

SEQ ID NO: 64845 - DNA, 601 bp, Human
atataactaatttttgcattttttgaagtaggttggtacaaaagtaattgcagtttttgccattaaaagtaacggggaaaccacaattacttttgcaccaatctaatatttttgtattgattttgtatcttataaacttggtaaatttattatctataatggttttttgtgtgtgttaggattttctatatacaagatcatgtcatctgtgaagagaggtagttttacttcttccttttcaatatggatgcattttgcttgctttcttgcttaagtaccctggctaggaccttcagtacartgttgaataaaaatggcaggagtggatatccttgtctttttcctggttttaggggaaaagctttcagtctttcactattaagtatgatgttaactgtgggtttttctttcttaagagacagggtctcactctgtcacccaggctggagtgccagtgatgcaatcataacttactgcagcctcaacctcccaggctcaagtgatcctcccacctcagcctcctgagtaggcaggactacaagtgtacaccaccaagcccagctatttttttttcattattgttattattttggtagagata

SEQ ID NO: 64846 - DNA, 601 bp, Human
aaacacccattcagatcctttccccattttttcccccaatttacttttttttcttttttttgagatggagtctcactctgtcacccacgctgcagtgcagtggcacaatctcagctcactgcaacctccacctcccaggctcaagtgatcctcctgcggcctccagagtagctgggattacaggcacccaccaccacacctggctaatttttgtattttgtgtagagatggggtttcactgtgttgggcaggctggtctcaaactcctggagtcaagcaatccatctgcctcagcctcccraagtgctgggattacaggcatgagccaccatgcccagcctaatctacatatttcactggtaaaatcacacaacataaaatttaccaccttaaccatttttaagtgtatagtacagtagtagtgttaagtatgttcacgttgccataactttttcatcgtgcaaatctgaaactctatactgatgaaacaataatttcccattttctcctcccaactgataacgaccattctattttgccctttacccattttaaaactgggttagttggggtgttgtttttgttgttgctgagttttaag

SEQ ID NO: 64847 - DNA, 601 bp, Human
atattacacatcattgaaaaaaatcaagtaatttaaatagcataacttgataaacagggcttttttcctttgcatactattctagacaatttcctatgcataaataagaaaaataataaacacacacaaaatcaaatctattcttacaaaactgagatcattatatatactgctatgtaacttgcttttctcattcaatatgaacctctttccacatcgattccacttattatgactacctatttaatatgaaatagatctttcctggctgggtacagtggctcactcctgtaatcccagycctttgggaggctgaggcaggtggatcacctgagatcaggaattcaagaccagcctggccaacatggtgaaaccccatctctactaaaaatacaaaaaagaattagcagggcatggtggcgtgtgcctgtaatcccagctacttgggaggctaaggcaggagaatcacttgaacccaggaggcggaggttccagtgagctcagattgtgccattgcgctccagcttgagcaacagagtgagattaagtctcaaaaaatataaaaataaataaaataaaatagatctttccagatctattt

SEQ ID NO: 64848 - DNA, 601 bp, Human
aattaaagttcataaaaatttattttgaaaattatataatttctctttttgattttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgayctcatgatccacccgcctcggcctcccagttgatatttttttaagagatgggatctcactatgttgcccaggctggtctcaaacttctgggctctagcaatcctcccaccttagcctcccgagtagctgggagtatgcctatagtcataggcatgtgacacatcactcaaccaatatgttattttataaaaggcttcaaaataactgcaataaaaagtgaaaaattagaattgctaagctccagtttaactggtaagctataattttgattaacatatgagagaaatataatccatgtaa

SEQ ID NO: 64849 - DNA, 601 bp, Human
ctgaccacttgcaatgtgagtcaacagtggcctcccggctggggatccttggctgaatctgttctgaaggagttggctgagcagcttcagggtcccagcagtactgagaacttcctccaggcagtgttagcggttcccttctgcaacttctcattttaacacataccaccttcacttaaagatatcttacagctttgggtatggaacatttcttatttttaatctggaaagggaatttattaatctaacttaatgtcttaccatttctatggatttggtgtagaaacaggacaaggtcaggatgtgcttggtcaaccatcttgaaactggatctattgcttaagtatcatctctctgcattttctttagcctctatctggaactcttattagaaggaactcctcaatccatcctctacactttgttttcttttactttataataatagtaatgtactaaggaatacttctctgttctagcttccagctcacaaatttgttcttcagctataaaccctgttaatcagctcatctatttaatttcttattttaacaatcaaacatttaatttccaggatcactacttaattatttttggtaga

SEQ ID NO: 64850 - DNA, 601 bp, Human
aatatatgtaataatatttattgttaactgtatcctctaacatagcacctaagtggtttttgttgttttcttaaatctgagtttttatcttgtaagtagatgagtttagtttttccatttattttgattactgatatatatatcagtaatatatatttgattatgaatatacatatatcaatatatacatttaaatttaatcataggacttattttgtatcttctatttttcatgactttcttttctcctactttcctgtcttctcttggattggtcaaggttgtttttgctactgttatcttataataggtttaaagtttatattttatatctaacttgtctagtagtcacccttaaatttttaatgcatacttaaaataatattttcttacaagttggagttacattttatatagtcctcttgaattctttggcatgtttttatttccctttttgctccacctacccataaaattccttgttgctaactttgttgacctaaattgcaacttattaaaaatcatcttatattttacaaccaacatttgcttagatggaccattgttgttttcctgatttatttgcttccttcttttttct

SEQ ID NO: 64851 - DNA, 601 bp, Human
atgtacagttcagggccatgatgacaatggcggttttgtagaatagaaaagggggaaaggtggggaaaagactgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatatgctgtgtccactcagggttaaatggattaagggcggtgcaagatgtgctttgttaaacagatgcttgaaggcagcatgctcsttaagagtcatcaccactccctaatctcaagtacccagggacacaaacactgcggaaggcctcagggtcctctgcctaggaaaaccagagacctttgttcacttgtctgctgaccttccctccactattgtcctatgaccctgccaaatctccctctgcgagaaacacccaagaatgatcaattaaaaaaaaaaagaaaacaaaaaaaaaaaagaaaagctagatgatatagaatattcatggtatagaaaataatgtaggtactaacaaggttgaggcaagttctacagcaagaataaa

SEQ ID NO: 64852 - DNA, 601 bp, Human
ggagaggggagagggagagcttttatttatttatctgtcaccaggctggagtgcagtggggtgatctcggctcactgcaaccagcgcctcccgggttcaagcaattctcctgcctcagcctcctgagttgctgggactacaggcgcgtgccaccatgcctggctaatttttgtatttttagtagatacggggtttcacctggttggccaggatggtctcaatctcctgacctcgtgaaccacctgcctcagcctcccaaagtgctgggattacaggcatgagccaccgtgcctggccccayactgcaatttttaatttgtttgtccatctctgttatactgctgcttctgaggggtaggatctacatcttattcatctttgtatttgaacaaattatttacctagatgaattttccagattgcttttacctacctagtaaaaccatataaatctttttttttttgaggattacaagtagatgcaatcagaggacatcaaagagaacaccttacttttacctttataatgaaacactgcatctgtcatccatgtattaatttcatgattttttgctatatctgccattaattcatgcaatgt

SEQ ID NO: 64853 - DNA, 601 bp, Human
agaggcgctcctcacctcccagacggggtggccgtgcagaggtgctcctcacttcccagacggggcagccgggcagaggtgctcctcacttcccattcggggcaaccgggcagaggtactcctcacttcctcccagacggggcagccgggcagaggcactcctcacatcccagactatgggtggccaggcagagacgctcctcacttcctagacggagtggcagccaggcagaggcgctcctcacttcccagacgggggtggccaggcagaggtgctcctcacctcccattcggggcagcygggcagaggcgctcctcacttcctcccagacggggaggccgcgcagaggtgctcctcacctcccagagggggcggccaggcagaggcgctcctcacctcccattcggggcagccaggcagaggcgctccccacttcctcccagacagggttgctgggcagaggcgctcttcacttcccagacggggcggccgggcagaggcgctcctcacatcccagacgatgggcggccacgcagagatgctcctcacttcctagacggggtggcagctgggcagaggcgctcctcacctcccagacag

SEQ ID NO: 64854 - DNA, 601 bp, Human
gaagagcgggtgggcagaggcgctccttaccgcccagacaatgaggtgctcctcacctcccagacgaagagcggccgggcagaggcgctcctcacctcccagacgaagagcggccgggcagaggcgctcctcacctcccagacggggtggccgtgcagaggtgctcctcacttcccagacggggcagccgggcagaggtgctcctcacttcccattcggggcaaccgggcagaggtactcctcacttcctcccagacggggcagccgggcagaggcactcctcacatcccagactatgggyggccaggcagagacgctcctcacttcctagacggagtggcagccaggcagaggcgctcctcacttcccagacgggggtggccaggcagaggtgctcctcacctcccattcggggcagccgggcagaggcgctcctcacttcctcccagacggggaggccgcgcagaggtgctcctcacctcccagagggggcggccaggcagaggcgctcctcacctcccattcggggcagccaggcagaggcgctccccacttcctcccagacagggttgctgggcagaggcgctcttcacttcccaga

SEQ ID NO: 64855 - DNA, 601 bp, Human
cagaggtgctcctcacctcccagacggggtggcggccggacagaggcactcctcacctcccagacagggtggcgggtgggcagaggcgttcctcacattccagacgatgggcggccgggcagaggcgctcctcacctcccagacagggtggccgggcagaggtactccccacctcccagacgaagagcggccgggcagaggtgccctccacttcccagatggggcggctgggcagaggcgctcctcacttcccagacggggcggccgggcagaggcactccccacctcccagatgaagagygggtgggcagaggcgctccttaccgcccagacaatgaggtgctcctcacctcccagacgaagagcggccgggcagaggcgctcctcacctcccagacgaagagcggccgggcagaggcgctcctcacctcccagacggggtggccgtgcagaggtgctcctcacttcccagacggggcagccgggcagaggtgctcctcacttcccattcggggcaaccgggcagaggtactcctcacttcctcccagacggggcagccgggcagaggcactcctcacatcccagactatgggtggccag

SEQ ID NO: 64856 - DNA, 601 bp, Human
cccagatggggcggcctggcagaggcgctccttcacttcccagacggggcggctgggcagaggcactcctcacttcccagtcggggcggccgggcagaggtgctcctcacctcccagacggggtggcggccggacagaggcactcctcacctcccagacagggtggcgggtgggcagaggcgttcctcacattccagacgatgggcggccgggcagaggcgctcctcacctcccagacagggtggccgggcagaggtactccccacctcccagacgaagagcggccgggcagaggtgcccyccacttcccagatggggcggctgggcagaggcgctcctcacttcccagacggggcggccgggcagaggcactccccacctcccagatgaagagcgggtgggcagaggcgctccttaccgcccagacaatgaggtgctcctcacctcccagacgaagagcggccgggcagaggcgctcctcacctcccagacgaagagcggccgggcagaggcgctcctcacctcccagacggggtggccgtgcagaggtgctcctcacttcccagacggggcagccgggcagaggtgctcctcacttccc

SEQ ID NO: 64857 - DNA, 601 bp, Human
gtatcttggcatgtgcctttcccaggtctccctttcccaatctatctttctgtacatttttttctcatctctcaagcctgctggtcagcatcctttcctctgtgaagactttcctcactgctccatacgacagcaagtgcctttccaggctacccatttacctgtacctgtttccactgttgcactcaccatgctatactgctgctacactgcaatttttatttttatttttatttatttatttatttatttatttattttttggaaatgcagcgtttattttttttttaatttttttttgagtatttattgatcattcttgggtgtttctcagagagggggatgtggcagggtcataggataatagtggagaggtcagcagataaacacgagaacaaaggtctctggttttcctaggcagaggtccctgcggcctttggccttcggccctgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcaggg

SEQ ID NO: 64858 - DNA, 601 bp, Human
actgtgttcttttaggtctctgtatcttggcatgtgcctttcccaggtctccctttcccaatctatctttctgtacatttttttctcatctctcaagcctgctggtcagcatcctttcctctgtgaagactttcctcactgctccatacgacagcaagtgcctttccaggctacccatttacctgtacctgtttccactgttgcactcaccatgctatactgctgctacactgcaatttttatttttatttttatttatttatttatttatttatttattttttggaaatgcagcgtttattttttttttaatttttttttaagtatttattgatcattcttgggtgtttctcagagagggggatgtggcagggtcataggataatagtggagaggtcagcagataaacacgagaacaaaggtctctggttttcctaggcagaggtccctgcggcctttggccttcggccctgtttgtgtccctgggtacttgagattagggagtggtgatgactcttaaggagcatgctgccttcaagcatctgtttaacaaagcacatcttgcaccgcccttaatccatttaaccctgagtggacacag

SEQ ID NO: 64859 - DNA, 601 bp, Human
caaaatacactgtgttcttttaggtctctgtatcttggcatgtgcctttcccaggtctccctttcccaatctatctttctgtacatttttttctcatctctcaagcctgctggtcagcatcctttcctctgtgaagactttcctcactgctccatacgacagcaagtgcctttccaggctacccatttacctgtacctgtttccactgttgcactcaccatgctatactgctgctacactgcaatttttatttttatttttatttatttatttatttatttatttattttttggaaatgcrgcgtttattttttttttaatttttttttaagtatttattgatcattcttgggtgtttctcagagagggggatgtggcagggtcataggataatagtggagaggtcagcagataaacacgagaacaaaggtctctggttttcctaggcagaggtccctgcggcctttggccttcggccctgtttgtgtccctgggtacttgagattagggagtggtgatgactcttaaggagcatgctgccttcaagcatctgtttaacaaagcacatcttgcaccgcccttaatccatttaaccctgagt

SEQ ID NO: 64860 - DNA, 601 bp, Human
ctggttgctcaggaaaaacaggatgcgggggttctctcgtgggtacacaccccaaagatttactaattgcatggctcagcttctttgcaggagatttctgtgtcaaagcagaaaatagtaaggaattaacccttcaaaagaatgaaaggaacttcaaaaaagaaaaaaactttgtgacaagagtgtaaaaacatcttttcaaatacaaatcaagtttcattacatcaatatcattgggcctttcagaaaggaacctccagttgttccaaggtcatctgtggtccttcatttctgcagttcmtccctcatgtttactataaagtcacactatcaagtaatgtcaactttccttctggacatctctatgtactcttggcaagaactccctcctttgatgcttctggatcctttttgctaagatgttaacattaatttcctgatcagagtcggaactttttgatggaggccaggcacggtggctcatacctataatcccagctctttggaaggccaaggtaggtggatcacctgaggttgggagtttgagactagcccaaccaacatgttgaaaccatgtctctactaaaaatacaaaattaac

SEQ ID NO: 64861 - DNA, 601 bp, Human
tcacaaggcccccatttcagtgtgatccacatgcacatccaggggtatacttacactatatgtgcaaggtcaagtggtttctctggttgctcaggaaaaacaggatgcgggggttctctcgtgggtacacaccccaaagatttactaattgcatggctcagcttctttgcaggagatttctgtgtcaaagcagaaaatagtaaggaattaacccttcaaaagaatgaaaggaacttcaaaaaagaaaaaaactttgtgacaagagtgtaaaaacatcttttcaaatacaaatcaagtttcrttacatcaatatcattgggcctttcagaaaggaacctccagttgttccaaggtcatctgtggtccttcatttctgcagttcctccctcatgtttactataaagtcacactatcaagtaatgtcaactttccttctggacatctctatgtactcttggcaagaactccctcctttgatgcttctggatcctttttgctaagatgttaacattaatttcctgatcagagtcggaactttttgatggaggccaggcacggtggctcatacctataatcccagctctttggaaggccaaggtag

SEQ ID NO: 64862 - DNA, 601 bp, Human
acagcaaattaagttgattttcatttccatgttgtctacattaatttaagtccctatgggcattactgctatagagaaaaagatctctgccactgatttaaggaatgaacccaaaatcacaaaaggcagcccagctaaaaccagaacaataatggctcttcaatgggctcatgtttctggaggctgccatattactcaggcttcagcaatcaggagctagatttccatgtggacacttaacggtgatttacagagaagaaagcttgaagtcttaagttcccacaaaagaaagtaaaaaccygagaagttgaatggtcatgttaagtgatccctggttttgatccacaggaatttcacaaggcccccatttcagtgtgatccacatgcacatccaggggtatacttacactatatgtgcaaggtcaagtggtttctctggttgctcaggaaaaacaggatgcgggggttctctcgtgggtacacaccccaaagatttactaattgcatggctcagcttctttgcaggagatttctgtgtcaaagcagaaaatagtaaggaattaacccttcaaaagaatgaaaggaacttcaaaaaagaaaa

SEQ ID NO: 64863 - DNA, 601 bp, Human
aaaatgttatgaggaactcaataagatgagtctaaactttatatgaaagagcaaagagctaataatagacaagacactccagaaaaagtagattacttagttccttatggtaattaagacagtgagatattggcatagggatggacaatttgaccaaaggagcagaataaagaaaccagaagccagcctgtgcgtatttggaaacttcatttttgacaatggtggcattgtagtcagtggggaaatgttgaattatctaatgaatgaccctgagacaagttattattcaaatgcagaaagygagcggctggggaagagaactggatattctacatcacatcacacacaaaaatccattccaaatgaattaaagacatatgtgaaagggccatctttaaaacctaaagaaaaaagtaaggagaaaaccactataatgttgagaggcaggcaaggaaaaacacgacccaaaagggaaaaaggttaacagatttaacaaaaaaaaaaattgcattatggggaacagataaactgtgctatggaacactgtgtaggggtgggagacatcttttttcccaagaagaagaaagcaatgagaaaccgc

SEQ ID NO: 64864 - DNA, 601 bp, Human
tgttggccaggctggtcttgagctccggacctcaggtgatccgcctgcctcagcctcccaaagtgctgggatcacaggcatgagccaccgtgcccggcccttctgtactttttaaggccttctgattgatcttggtatcagccaagtttgggaaccattaacacgtattgaatacagaaaaaaaaatctgtaagacatagaaactcaaagttgaaaggatcctcaaaagttatctagtcaaactaaataggattaactgctcaacatctcatctaaatctgaaagagaatctaccagagcttttttttttttttttttggtggggggggtggtctgctgactatattcttggcttgggagtaattcggactgataaatagttaaactataaaatctgaattctaggtagtatcttgtagagttgaagacatttgtagaacaagttactacagctgaccagtatctggttctcctctcctccctaggtacacagaaggctattcaggcttgaaattaggtggggctgtgaggcaggtggtatgtgtcatttctgaaccaaagcacagaagaatggctctgagctgtccctacgctttcttcc

SEQ ID NO: 64865 - DNA, 601 bp, Human
gtcacacgctgcaacacagatactgcaacacagaaccttgagggcattatactaagtgaaataagccagtcacaaaaagacaaataccatatgattccactcacatgaggtatgtaaagcagtcaaattaatagaaacataaagtagaacggtggtcacagggggtggagggaaagggcattgctgtttaacgggtatggaaaaagttctgaagatctgtttaacaacaacacgattacacttgccattactgaactgtacgcttaaaaaccgtacacttaaaagaattaagatagttaaktttatattatttttttatccacaataaaaaaaaagaatactaagggatgatgatttgtgaagttttgtgagattttgagtttaaaagcagagagctttatagtaggataatggcaaacagggtgagaaaatctcaagggcagagtgaaactcagcagaacaaagtcatagccacttgtaaataatcaccctccttggactaaagcttgatggttctgagttttgttgtattacataatgctgtttctcctcactgcaccatactcatcacatttactgttcacataagcatccctctgtc

SEQ ID NO: 64866 - DNA, 601 bp, Human
gaatggatgagcaaaatatggtatctacatacaatgaatatcattcagccttagaaaggaaggaaatcctgtcacacgctgcaacacagatactgcaacacagaaccttgagggcattatactaagtgaaataagccagtcacaaaaagacaaataccatatgattccactcacatgaggtatgtaaagcagtcaaattaatagaaacataaagtagaacggtggtcacagggggtggagggaaagggcattgctgtttaacgggtatggaaaaagttctgaagatctgtttaacaacaayacgattacacttgccattactgaactgtacgcttaaaaaccgtacacttaaaagaattaagatagttaattttatattatttttttatccacaataaaaaaaaagaatactaagggatgatgatttgtgaagttttgtgagattttgagtttaaaagcagagagctttatagtaggataatggcaaacagggtgagaaaatctcaagggcagagtgaaactcagcagaacaaagtcatagccacttgtaaataatcaccctccttggactaaagcttgatggttctgagttttgttgtat

SEQ ID NO: 64867 - DNA, 563 bp, Human
ctgaggcaagcagatcacctgaggtcaggagttcgagaccagcctggccaacatggtgaaaccccgtctctactaaaaatacaaaaattagctgggcgtggtggtgggcgcctgtaatcccagctatctggtaggctgaggaaggagaatcacttgaacccaggagacagaagttacaatgagccaaagaccgtgccattgcactccagcctgggcaacaacagcaaaaccctgtatccaaaaaaaaaataaaaaagttaaayatatgcttgcactgcatgactcagcagttctactcccagatatgtactaaagacaaatgaaaacatatgtctacagaaagacatgaatgttcatagcagcgttattcataagagtcaaaaactaaaaatgagaccaatgttcatcaactggtgaatggataacaaaatgtgatctattcatgcaaaggatattttcaacattaaaaagaatgacctatttattcttgaaacaaatggataaaccccaaaaatattatgctaaatgaaataagtcagaaacaaaagactacatattgtacg

SEQ ID NO: 64868 - DNA, 601 bp, Human
gatacacatgcagttatgcattctgtaagtatttaagatctactatctgccagacccacgccagatagggagatagagcaggaagtaaaataaagtccttgtctctggcagtaaaatgagtttggtggggaaaaaaaaaaaaaaagccttgctttcaaagaacttacagtctaatagggtagagattataaacaaatacaaaaatgaatttttaaaatgtcatataatggcaagtgtcatgcagaaactgaaacaaggtaagaggaaacagagtgactgatggtgctattttagataaaaragttacagaaagtatctctgagaagctaacatttaaggagagatctgaataacataaacaaataagccatgtgagtatgaggatgaggggcacatcaggcaaaggaaccagtagttgcaaaggccctgaggtggacgcacacttggtatttgcaaggaacaaaaccagaataacaaaggaggatagagcaatgggaaagtggcaggaaataaagttagagaggttgccaggaaccagattttatggggccttgtagaccattgtatagacttcggcttttaagtgtaaggggaagtcact

SEQ ID NO: 64869 - DNA, 601 bp, Human
gggtgacagagcaaaactccatctcaaagaaaaaacaaaacaaaacaaccaaaaaaaaaaaaaaaaccccacaagaaataaagcctgcctcattctgacacactgatatcatttaataacctgaatgcctcatgaatatcactactattagtaagtcatgaacacatatagatacacatgcagttatgcattctgtaagtatttaagatctactatctgccagacccacgccagatagggagatagagcaggaagtaaaataaagtccttgtctctggcagtaaaatgagtttggtggggaaaaaaaaaaaaaaagccttgctttcaaagaacttacagtctaatagggtagagattataaacaaatacaaaaatgaatttttaaaatgtcatataatggcaagtgtcatgcagaaactgaaacaaggtaagaggaaacagagtgactgatggtgctattttagataaaaaagttacagaaagtatctctgagaagctaacatttaaggagagatctgaataacataaacaaataagccatgtgagtatgaggatgaggggcacatcaggcaaaggaaccagtagttgcaaaggccctgag

SEQ ID NO: 64870 - DNA, 601 bp, Human
tataaatggtattgctttttaaaatttcatttcctaattgctgctaatatacagaaatgccactgatttttttaaagtgatctatgtcctgcaatactgctaactttgttagttctagtactttgctttgtagattccttagcattttctatgtacacaatcacgtcatctatgaataaagaaaattttaatatttccttttcgatctgaatgcctttaatttctttttctcgtattactgcactagctaggatcactagtaaaatgctgaatagatgcactaagagtgacattcttgcaytgttcccaatattaaggtaaaatgttcagtcttttaacattaagtatgatggtagctaggtaggtttttcatagatgtgcattttcagattgagaaggtaccctctattcctaactttctgagagtttttaaaaatgtgaattgagggttgaattttgtcaaatgcctaagatcattttccttctcctcgaaacataccctttacaaattcctttagcgaggttcctttagtagtgagcatttttattcatctgcaaatgtttttgtctttgcctttcttgacaggtattttctcactgg

SEQ ID NO: 64871 - DNA, 601 bp, Human
tctttacttctatatcaattatttagaaataatttctctgtatgccctcaatggaaagacaatgtggtatactacttggtggtaaaaagaatgaaatcctggcatttgaagcaacatggatggaactgaagattatatgttaactgaaataagccagacacagacaaatatcacatattctcagtcataggtgggagctaaaaatgttgatcccatacaggtagagagtagaatgatggtcacccagaggctgagaagggtgtgtgagggtggggaaggatgaagagaggttggttaatgsgtacaaacacagagttagatgggaggaacaagttccaatgttcaacagcagagcaggggggtgactatagttaacaataatgtattgtatatttcaaaatagaaaagagaacttgaaatgttcccaacacacagcaatgataaatattcaaggtgacggataccctaaataccgagttgttttttttttaacttttaagttcatgagtacacgtgcaggatgtgtgggtttgtcatacaggtaaacatgtttcatgggggtttgttgtacagatgatttcatcacccaggtattaagctt

SEQ ID NO: 64872 - DNA, 601 bp, Human
aggaagaaaggaaggaaaagaaagaaagaaatttaaccaaagtgtgaagcttgtatactgaaaattataaaacatcattgaaagaaagaacacctaaataaatggaaagatttcacatgttcatagatttcatattgctaagatagcaatattccccaaatagatctattgattcagtacaattcctaacaaaatcacaaaatacctttttgcaaaacttgatgagctgactctaaatgcacatggaaacgcaacagacatagcccaaaaagcgtcttccaaaagaagaacaaatttagagacacaaactttccaatttcaaacttactactaactttcaaagtgggttagtttgcttcaggtccaaaggttcagagatattcataaattgcccattactctctccagtgacaaataattcataattgatatctgaaatgattggctttgaaaaagtttctaagcctaaatactgtataatgattgactgatagatcatggatcctctctaagtaactatccaaactggcatccacgtcactgctatgagctcactccacaccccacctgtctgcattggagtaccccaggtggaagtaca

SEQ ID NO: 64873 - DNA, 601 bp, Human
gtttgagattatgagattgaaataccataattttataatgaaaacatatcaaggtcaggcatggtggctcactcctgtaatcccagtactttaggaggccaaggcgggtggatcacctgaggtcaggagtttgagaccagcctagccaacatggtgaaacactgtctctactaaaaataggaaaattagccaggcatggtggcagggtgcctgtaatcccagctactcgggaggctgaggcaggagaatcgcttgaaccggggaggcggaggacgcactcagtcgagatcgtgtcattgcaaaaaaaaaaaccaaacaaacaaaaacaaaaacaaccatatcaggaaggaaaggggggcagtggagagtgggaaaaagtttgggaaaattggttctggctccaactctgatactaagtggattatgtgacctgcatgactttggacaatgaagccctgtgtgtctcagctaactggtctgtgaaatgacaggggctggttctagagcactgattttcacatgctgtgctctggggatctgaggatgccacatggtgcttcagtgaccatgatgaacagcaaggggaacagacgaaggatgt

SEQ ID NO: 64874 - DNA, 601 bp, Human
acaagaagagatatagtggggctgggcgcagtggctcacacctgtaatctcagcactttgggaggctgaggcaggcggatcacctgaggtcaaaagttcaagacgagcgtggccaacatgtaaagccctatctctactaaaaatacaaaaattagccaggcatggtggtgggtgcctgtaatcccagctacttgggaggctaaggctggagaatcgcttgaacccgggaggccgatgttgcaatgagctgagattgcaccactgcactccagcctgggtgacagagtgagactctgtttcaaaaaaaaaaaaaaaaaagataatagtgggctgcccatttaatagaaactccctgggaagttctaggggctctagcatcttgccaaaaataaacacaatcatcattagcccagtgcttaaggtggcaaaaatataaaggcgaagaataactattaaaccttcacactctgtagcaaagccttcttctttctctacagatctggcttctaatgcattacgctgctgttgtctctaaggaaacagaacaatcacatgacgaagggtcttctctacaaggtagtcttccccacagagcattttg

SEQ ID NO: 64875 - DNA, 601 bp, Human
ctcttcaaaaatttgtggttagagacctattcgtggacccttaagtgaaaacaatatattgtctagaaagaaaaccagttttcttattattccattatgatgaagaggacataagggattacattgatctataatgctggtaagctgcagctctggtgaaatattaaggagcccaggttctaaaagccctttcattgcaatgattctcgtgtggatagtgtggatcattcttgatctccttgagtagcatgctctttgtctatctctatgtaatggaccaaccatttcttgttacctcacrgggttctatggttatctgccaaagcaaggaagttaaacaaacaagcaaaaacaccttttggaaaaccatgatgttaaaaaaataagcatctggtactgtaagtgtagcataaatatcatgttacatacctacaatgaggtttctgacttccgggaagtgcatttaagtttactgatcatttacaattaattaaccaattggttaatataaaaaactcccctatcagcagacatatatgcctcaatttatattcgtagcaatttagcatagccatttgtggtatcagacttgtttaatgaa

SEQ ID NO: 64876 - DNA, 601 bp, Human
aagggaggctgcagaacaaatctacaacaaaaaaatgttcacttacttaaagattaactttcttccaaagaaaagtgtcaaatgacagtgctcagggtgcaggcacttcagcatctctgctgcacaatgcgtcagaatgaaggtggtatttctctttttttttttgagtcagggtctcgttctgtcacccaggctggagtgcagcggtgcaatcttggcccactgcaacctccacctcccaggctcaagtgattctcttgcttcagcctcccaagtagctgtgactacaggcacatgccaycacaccagctaatttctgtatttttcatagagttgggggttgtgtcatgctgcccaggctggtctcgaactcctgggctcaagtgatccatctgctttggcctcccaaagtgctaggattacaggcatgagccattgtgcccagccttctctctctctttttagttactactactcttcaaaaatttgtggttagagacctattcgtggacccttaagtgaaaacaatatattgtctagaaagaaaaccagttttcttattattccattatgatgaagaggacataagggattacattga

SEQ ID NO: 64877 - DNA, 601 bp, Human
aatcagcagagtggagagtgtctttactaataatagcaatatttattgagtgcttcctatacggcagactaagtttgaacattttccatggattcactcatttaaccttacaccaagccaatgaagtagataccattatctttattttacagatggaaaaaaaaaaaactgaggcatggagaaaagtaatgtttttgaggtcacagagccaaatcgtgggagcaagaggatttgaaccgaggcagtgtggctctgagtgtgtgtgctcagtcattcgagtgtactgtctactatctttcayggctgcactttcaggaaaacacttaaggatatttactctatataaaaaaagccaacagcatgacgttagatcatagttcctgttgtttctataggaagataagatagtaatagttacaaagtatagttttggagtgatttaccctttccccatcatattattagaactctgtgtcctaaatggctctctgaacgtaaaccatctggcttgagagcttaacaggattaactttaaaatctaatcttcatttcaaagatcttttaggttcctaatctcagcctagcaaaatacatacattta

SEQ ID NO: 64878 - DNA, 601 bp, Human
aattagaaaaacaccagttaatttgaattgttaaaaccatcagaaaagaaaaaaaaatttgaggaactacctgaacaaatgtgacacagcaaaaattaaatgccttaatacataaaggattcacacaaacttaaaagaaaactatagggattccaattagataaatgggtaaagtaaaaatacatgtttaaaaagaagaaatacaaatgactcaaaagaaatttaattaaaaattacaggctgtgcacagtggctcatgcctgtaatcccagcactctgggaagccaaggcaggaggatcrcttgagcccaggagttcgagaccagcctgagcaacatggcaagaccccatctctacaaaaaattaaaaaatcagctaggtgtggtggcatatgcctatggtctcagctactcaggaggctgaggtgagaggactgcttgagcctaggagttaaaggttgtagtcagccaagatcaaaccactgcacttcagcctgggtgacagagtgagatcctgtctcggtggcgggcagggggaattatagaccactttctctgggaaaaataatgatctttttaaaaaggcaatccttaagagtgga

SEQ ID NO: 64879 - DNA, 601 bp, Human
gctactcaggaggctggggtgggaggatcacctgagcacagggaggttgaggtttcagtgaaactgacattgtgccactgcacttcaggctgggtgacaagtgagatcctgtctcaaaaaaataaaaaataaaaatgagtctggcatggttgcacgtgctgtagtcctagctactcaggaggcagaggtgggaggatcatttgagcctaggaggttaaggctgcagtgagctgtgattgcaccactgcactccagcttgggcgacagagcaagaccctgtctcaaaaaaaaaaaaaaaaaagtaatacactaaaaatgacttctggctcaaacaaacatacaaaaccttcatggttcttgtaagacataactgaaaagagtatttccaggtgtaaagcagacattaatgctacaaattatagaaacttaaaaaaacagaattggcacaacattagattggttttgttgatctttaacatgtaaaaccagttgaataccttgagcaccagatgttctgtatcttcctttggtacagatctcagcaaggtataggcactattgagtttcatgatactgaaatggccaccatctatcgcttggt

SEQ ID NO: 64880 - DNA, 601 bp, Human
aaccaaaagagagagactcaggctttccaacttaaatgtttataaatcatacacagaatgattcaggagaaaattttataagggattaattcaatttacacagtctaatcaaagagcaaaaatgatctttgacaaagaattcaaaggcaaaactgttgaaactcacgactaccaaaatattgtttaaggttaaaaaaacggatctgaaacgtgcctaatctgctctgacactgccaccactgcttgtcacaaatgaagtttccacctgaggcaccactgaaagccaaacttcagttgctatatttgtgagtcggtgggggaaaaaaggaaaataaaaagtagaaattaagactaaaagacggtcaaaggaagagaaagcaaaccagtcctttctgccctgtggaacaacctgcttttcaggcctcatttctggcaggggcatcgcaaatcagtagcagaggccaacacccaagtcgaaggcacaagacatacgtacctcttggtgggagtgggcactccagaggacatgtggctaaccatggtgtcattcatattagtcagagggcgaggaggactgaaagaaaagacatttaccttatat

SEQ ID NO: 64881 - DNA, 601 bp, Human
gttctcattccttgaaggcccctaaagcaaactccttgcataaccaaaagagagagactcaggctttccaacttaaatgtttataaatcatacacagaatgattcaggagaaaattttataagggattaattcaatttacacagtctaatcaaagagcaaaaatgatctttgacaaagaattcaaaggcaaaactgttgaaactcacgactaccaaaatattgtttaaggttaaaaaaacggatctgaaacgtgcctaatctgctctgacactgccaccactgcttgtcacaaatgaagtytccacctgaggcaccactgaaagccaaacttcagttgctatatttgtgagtcggtgggggaaaaaaggaaaataaaaagtagaaattaagactaaaagacggtcaaaggaagagaaagcaaaccagtcctttctgccctgtggaacaacctgcttttcaggcctcatttctggcaggggcatcgcaaatcagtagcagaggccaacacccaagtcgaaggcacaagacatacgtacctcttggtgggagtgggcactccagaggacatgtggctaaccatggtgtcattcatattagtca

SEQ ID NO: 64882 - DNA, 601 bp, Human
tcgcttgaacctgggaggtggaggttgcagtgagctaagattgggccactgcactccagcctgggtgacagacagagacagtgtctccaaatttaaaaaaaaaaaaaaaaatgaagacaagaacatttcaaggtaagcaaagagccagattccaactcagaaagagtctggctcaagagtccatgctctggtgccctgtaccactcagctctgtccagaagcagtggcctgactctcttgctgctggaaagtgccctagcaaggctaaaggcaagtactcttacctggtcaggtcctgagtctccatgcgggtaatgtgttatcaggccactctgatttattaagtccctaacttctctcttcagggtagtcctacactttactcgttagcttccttgtcaggctattgcccaaacttgcttgatgataagaatcagctggaataaaaatgtagcttctcaagatcctatcttcagaaattccagttcactgggtctgatgttgtcccagaaatctgttttcaacaagtgacccaggtgattcttctcatcagtcaggtttgataaacactgacgtaggagttttagccaatgggaacaaa

SEQ ID NO: 64883 - DNA, 601 bp, Human
tccagaaagccatgctccttctaatagcctctagcagccacattcagctgtggtcgccctcatgtactcgggtgacttagcgtgacagaactagtaaatgatgagaagaattcagatgggaaatgctactgaatgagatggtattcttataattaacaggaaaactatgacctgaattctttgaatcggccaccttatctgcctggttttgaaacggaaacatctttgatctggagtctgggtttgaatgctatgggtgttaaacataaaaaactgaagtccaaggacagcaagggttatygtaatatctaggtaggtgggacaggcttaattgctttgtattcgtccataaaaattcctttcctgcttgagagggcattgctggtaaattattctgtctcttcctcacttattctcacattccagtttatttcctaagtcataaaaataatacattaaattctcacataaaccccaaaaggtagatattatttttgtccccattttagagataaaaaattgaaaacaaggccaggtatggtggctcgtgcccgtaatccagcactttgggagtctgaggcagttggatcacttgagatca

SEQ ID NO: 64884 - DNA, 601 bp, Human
attctgaaaattttagggcctttcagaattatgctaaatttaccttgcctgcactccataaaaggaagaataaagcccggatgacagcacatctgtttacagcacggtttaatgaatattttaagcctactgttgagacctactgttcagaaaaaaagattgctttcaaaacagtactgctcattcattgacaatgcatgtggctcctaagagctctgaagaagatgtacaaggagatgaatgttgctttcacacctgctaacacaacatccatcctgcagcccctggatcaagaagtaattttttttttttttttttgagaagtagtttcgctcttgtcacctaggctggagtgcaatggcacaatctcggctcactgcaacctccacctcccgggttcaagtaattctcctgcctcagcctcccaagtggctgggattacaggcaggtgccaccatgccaagctaatttttgtagttttagtagaggcagggtttcaccatgttggccaggctggtctggaactcctgacctcaggtgatccacctgcctcggcctcccaaagtgctggggttataggccaccacacccagccaagaaa

SEQ ID NO: 64885 - DNA, 601 bp, Human
ggctttaaagcttcaaaaggacaggctgattctcttgctggggctaatgcagctggtgactttaacttgaagccaatgctcatttaccattctgaaaattttagggcctttcagaattatgctaaatttaccttgcctgcactccataaaaggaagaataaagcccggatgacagcacatctgtttacagcacggtttaatgaatattttaagcctactgttgagacctactgttcagaaaaaaagattgctttcaaaacagtactgctcattcattgacaatgcatgtggctcctaagarctctgaagaagatgtacaaggagatgaatgttgctttcacacctgctaacacaacatccatcctgcagcccctggatcaagaagtaattttttttttttttttttgagaagtagtttcgctcttgtcacctaggctggagtgcaatggcacaatctcggctcactgcaacctccacctcccgggttcaagtaattctcctgcctcagcctcccaagtggctgggattacaggcaggtgccaccatgccaagctaatttttgtagttttagtagaggcagggtttcaccatgttggccagg

SEQ ID NO: 64886 - DNA, 601 bp, Human
tgcttttcaaacaaactctatttttctcatttcacaggtgggaagagaatccatgcactgagtccacatatggatagtttctgacttgatcacttttgttttattccttttcttagtttcccccaacatctctgttgtccttggtcttaaaaaaacaaaaacatagtgatttttgtcattctgctatattctatagataataagataaactctttaccttgtcacccagtcagaaagccattttaatacaggcacacattgttttattgtgctttgctttatcatgcttcacagatactgkgctttttacaaattgaacatttgtggcaaccctgagttgagcaaggccactggtgccattttttccaacagcatgtgctcacttggtgtctctgtgccacattttggtaattctggcaatgcttcaaacttctccattattatcatcatatcggttatggtgatctgtgatcagtcatctttggtgttactattgtaattgttttggagtgccacaaaccatgcccacataagatagccaacttaatcaatcaatatgtgttctgaccgtttcactgaccatctctctctctctcttctc

SEQ ID NO: 64887 - DNA, 601 bp, Human
agtggggagtagactggagattccccaataagatccatgaaaaagttgagaactgtaccacagcactgatttgctttaagtgtttgctttactagctgaagtgagctgaaatattttactagtttggtattaagaggagtgaaaaaaaatctctggttaaacatagtaggtctaggctggatcagcacgggaatttcagcatttggaaatgtttgttctgtgtgccaggctatggcccatcaccatcacttgatggaagcaactacaatgagtcagcttcttaggagataaggtcaaaacatatttcagtgaaaagccccaaagcatgtgtgtgtaaaaatgtgttttttaaaagcatgtgtgtgttcatgtgtgtatcagaaagagagacagacagagacattacatagtaagagaggaagagagtatgtgtgggggctgctagagagaaaaggggtgtgtgcgcatgtatgcatgtcaggttctactggtcatttgttggctctaagtatttgtatctcctttgctggtgtgagattcgctggaagaatctggatgacaaaaacgatggtctggttcccaaccttgttcttctggcaca

SEQ ID NO: 64888 - DNA, 601 bp, Human
aaaaatcttttttttttttttttcccgagacggagtctcactcactctgttgctcaggctggagtgcagcggcccaatctcaattgctcactgaaacctccgtctcccaggttcaagcaattctcctacctcagcctcctgagtagctgggactacaggtgtgcaccacaaagcccggctaatttttgtatttttcgttgagacagggtttcgctatgttggccaggttggtctcaaacttctggcctcaagcaatccagatccacctgcctcgacctcccaaagtgctgggattacaggygtgagccaccgcatctggcctgcatcaaaaatctttaccaaataaatgtcatattgaacaagaaaacatatctagtccttccactttcttccctccccacccccccatttatgttttctcctgagtaaataagctcaatgaggttaaggacccgctatcaatcaatgcttgggtttaatgtacataaaattctagtaatcggttaaccttcctactagttagtcatgtgaaacgcaatgtaatattatatttacacataatatgtataaaatagaggaataatacctttctttttaattt

SEQ ID NO: 64889 - DNA, 601 bp, Human
attacaagctaatgagaaaaaatagtactgtcccatgagggcgtgtgagagagacaaacaagcccaatgacatgccaggctctataggttctctggcacagccaggttatggacagaatgaaggacctggagtgacatggggctctctaagaactgttcaccactactcacctttcctgtgcttatctacccagcggggtctcgtcttgatgaagtagcagtcgtgatgctatctaaatttgtcaaatgacctctttcccaacacgaagtgcatgaaaaatcttttttttttttttttccygagacggagtctcactcactctgttgctcaggctggagtgcagcggcccaatctcaattgctcactgaaacctccgtctcccaggttcaagcaattctcctacctcagcctcctgagtagctgggactacaggtgtgcaccacaaagcccggctaatttttgtatttttcgttgagacagggtttcgctatgttggccaggttggtctcaaacttctggcctcaagcaatccagatccacctgcctcgacctcccaaagtgctgggattacaggcgtgagccaccgcatctggcctgcat

SEQ ID NO: 64890 - DNA, 601 bp, Human
aggccagctgattctaacagtaaattgtaagacaattctctgactctggaaagtcctgaagtgtgaagaaatatcagtagttctgtcatgatgggagaaatctgtaggaaccaccaaagcaggaggaagacgtacaaaaaaatattccagtgaaaacccgaacacccagaataatcagtgactttagtaaggaaaccctaggtaagtggatgcaggctagggattagcactgaaagtagcacatttcagagtagattcttacacgacaattttttttttttttttttttttgagacagagwcttgctctgttgtgcccaggctggagtgcagtggtgtgatctcagctcactgcaacctctgcctcccaggttcaggcaattctcctgcctcggtctcccaagtagctgggattacaggcatccaccaccacacccagctaattttttgtatttttagtagagatggggtttcaccattttggacaggccagtcttgaactcctgacctcaggtgatccacccgccttggcctcccaaagtgccaggattacaggtgtgagccactgcacccggcctgaagacaacaattttggatcacag

SEQ ID NO: 64891 - DNA, 601 bp, Human
gcatttctgtgtcctccacaataaatgcacaaggccagctgattctaacagtaaattgtaagacaattctctgactctggaaagtcctgaagtgtgaagaaatatcagtagttctgtcatgatgggagaaatctgtaggaaccaccaaagcaggaggaagacgtacaaaaaaatattccagtgaaaacccgaacacccagaataatcagtgactttagtaaggaaaccctaggtaagtggatgcaggctagggattagcactgaaagtagcacatttcagagtagattcttacacgacaattttttttttttttttttttttgagacagagtcttgctctgttgtgcccaggctggagtgcagtggtgtgatctcagctcactgcaacctctgcctcccaggttcaggcaattctcctgcctcggtctcccaagtagctgggattacaggcatccaccaccacacccagctaattttttgtatttttagtagagatggggtttcaccattttggacaggccagtcttgaactcctgacctcaggtgatccacccgccttggcctcccaaagtgccaggattacaggtgtgagccactgcac

SEQ ID NO: 64892 - DNA, 601 bp, Human
ggccaaatagtaaatatttagttgtactgagttttcaatatatttaccgagtatctatgtgccagatctacatcagtactggaactacggtgataaacaaatgtagctccatccttgtgaagtgcccagccttgagaggaatactgaaatactgacattaatcaagtatttataagggtagggaatgttataaaaggatgtttgcggagatcatatatagaatatttgacctagtccaggagatcagaaaagtcctccctcagaaagtgacatcaaagttgaaacttgggtgataaacagkgttggctaggtgaagatgttggataaagagggtgccgggcagagggaagggtatgtgcaaaagtgcaggtgagagaatttacagcatactccaggtactgaagagtcccagcttgaagagtaggggagagcattggaaaatgaggctggggagacaggctgggcaccatgaagggttgcccaagcctattcattcattcattcattcacttacttatttgagatggagtctcactcttgtcacacaggctggagtgcagtggtgtgatctcagctcactgcaacctccgcctcctgggtt

SEQ ID NO: 64893 - DNA, 601 bp, Human
gaccgagggccaaagcgcaaggacgggagtccaaagagaaccacagcaagaaactggcccctttggagtctgacaaggggtcaacacgagtttataaagccaagtttaagaaataagccaggagtaacaagttaaatcagggtcaagtgcaaaataaagaagctgctagacatgaacactagaaatctgtttcggaacaatgctcttgccttgccttctgtcttcggggctcatgaaagcactttttgtgtgttcttggtcaatgacagggtccctaatatgtggttattttagaaaacasatataaactctaaagtgtttacctataaggtcagaaaataggataatgacttatcctacaaatataagctataaatgcatcaagttcaatgtagtcacagttggaattgtgattgggggacaaaactgaattgcatgacacagagtggccaaatagtaaatatttagttgtactgagttttcaatatatttaccgagtatctatgtgccagatctacatcagtactggaactacggtgataaacaaatgtagctccatccttgtgaagtgcccagccttgagaggaatactgaaatactg

SEQ ID NO: 64894 - DNA, 601 bp, Human
ttgcagtggtgtgatcactgcagaggctcactacaacctctgcctcctgggttcaagcaattctcttgcctcagcctcctgagcagctgggactacaggtgtgtgccaccacgcccagctaatttttgtatttttagtagagatggggttttgccatgttggccaggctggtcttgtactcccgaccttaggtgatccgcccgccttggtctcccaaagtgttgggattacaggcgtgagccaccaggcctggcctataggaagacttctattcagaaccagtattgtttgtcatataatyagagatctggaacacaatgaaaagcattcttagtagttagataaggaagttaaatgaccatgaattttctgataattttgtttggggtgtggggtgtaatgttcttcccccattcaaagttgtacctagtttaccagattaagaaaatttaaactctttcctttttgataaaatataaatatacatatatacataaatatgcaacatatatataacccccaactaacaaacaaggtttgtttcagaaatttgtttttccaaagcagagtcaatagtttacaattcagatttttttcctat

SEQ ID NO: 64895 - DNA, 601 bp, Human
aggcgtttcaagtagaaaggagagatctatgtcaaacgctactgacagatcaagtaaggttaactactgaaaactgaccactggattctgtggtttagaagtcaccagtgtgcttgacataaatagttttggcaaaataacaggaggtgaaagtctgactgggtgtgtttgaaaggaaatggcagaacagaaattgaagtttctttctacagataaccctttaaagaagtttttttgaaatgggaaggagagatatagagggtacctagaaagggaactgaggccaagaaaggttttttgtttttttttttttgagacggagtctcactctgtcacccaggctgcattgcagtggtgtgatcactgcagaggctcactacaacctctgcctcctgggttcaagcaattctcttgcctcagcctcctgagcagctgggactacaggtgtgtgccaccacgcccagctaatttttgtatttttagtagagatggggttttgccatgttggccaggctggtcttgtactcccgaccttaggtgatccgcccgccttggtctcccaaagtgttgggattacaggcgtgagccaccaggcctggcc

SEQ ID NO: 64896 - DNA, 601 bp, Human
gaaaagggttaatgagaaatcaacagttaaaaaaaaaaaaagagagagagaaatcaacagttgttcttatctttgtttcctggtacgtaacatgtcttttttttaggcagggtcttgctctgtcacccaggctggagtgccatggtgcaatcatggatcaatgcagcctcaacctcctgggctgaagcaatcctcctgcctcagtctccagagtagctggggctacaggtgtgtacccccacacccggctaatatttatttatttatttatttatttttgagatggagtcttgctctgtcrcccaggctggagtgcagtggtgcaatctctgttcactgcaagctctacctcccgggttcacgccattctcctgcctcagcctcctgattaactgggactacaggtgcccgccaccaaggctggccaacttttttgtatttttagtagagacggggtttcaccgtgttagccaggatggtctcgatctcccgacctcgtgatccgcctgcctcggcctcccaaagtgctgggattacaggcatgagccaccatgcccagctctaatttttaaatcttttgtagagacagggtctcactttg

SEQ ID NO: 64897 - DNA, 601 bp, Human
taagtcctctcagtgctttcaaggtaccgttccattttcttctggcttgcattgcttttaatccttttcccatttgtcccgagaatactcactggcagcgcttgcagatacagcatttaccctgagataactttcccatgaaatatctcgcttttattattattctctcatcactctagtacacggactttggaaagaaaagacatcattctatttatagcattctattcttagtagtggtatttccatttacaaaatactgtaattcttgattgctgaaaatgccaaagcttagaaagcrtagcattcctgtgcatgatgttaattattattattattttttgagacagagtattactctgtcaccaggctagagtgcagtggcgtgatctcagctcactgcaacctctgcctcccgggttcaagccatcctcctgcctcagcctcccaagtagctggaactacaggtgcacgccaccatgctcagctaattttttgtatttttagtagagatgaggtttcaccatgttggccaggatggtctcgatctcttgaccttgtgatccacccacctctgcctcccaaagtgctgggattacag

SEQ ID NO: 64898 - DNA, 601 bp, Human
gtccatctgccaatttcctcaaatcttaaaaaatgtccatttacaattaaagtcaagatccaaacaaagtccccactttgcaaatggctggtaggtttcttttatgtttgtatgtgactgatacatttctgggtttttttttgtttttgtttttttgtttttttgagacagagtctcgctttgtctcccaggctagagtgcaatggcatgatctcgggtcactgcaacctctgcctcctgggttcaagcgattctcctgtctcagcctcccaagtagctgggattacaggcgtgcaccacmagctaatttttgtatttttagtagagacgggttttcgcctctgttggccaggctggtcttgaactcctgacctcaagtgatctccctgcctcagcttctcaaagtgctgggattacaggtgtgagccactgcgcccggccccagtcacctttctgaagctcaaactctcctacctttggccagtgggagctcctgtaataggctcttgtgttcttttgatataaccattagaccttattagctttcctgctttctagcacaataaaatgctctagttttttttcttttttttcttttttt

SEQ ID NO: 64899 - DNA, 601 bp, Human
acttattttcagatcccaactcaagtaacactttctcacagaagctatcccttactctccagaatagatcaggcacctgctctacacttccacagctccctgcatttttcctccactgcacataataatttgtagttatgtttagtagtgtgattatttgtttaatgtttgtctctgtcactacactgttagttccatgagggcaggaatcatttgtccaccatagtatccaatctggcacagtacagcaacaaaagaagtatttgctgaatgaataaaatgagtgtgtgtggctggttgkgggtgggtgaatattaatgtgaacataactcctcaaagaaagtaaagaattgaaaaaggagaaggaaaagagaaaacattttattatgaatatttcaaaattgcaggaaacacactgcaaatccctggggagccacttcctatttcaatcaaacccttattcaacattcttggttcctttttgttttaattgagatataatacttagatcttaagtattccattgacgggcgcggtggctcacgcctgtaatcccagcactttgggaggccgaggcaggcggatcatgaggtcaggagat

SEQ ID NO: 64900 - DNA, 601 bp, Human
ttttaatctctctgaagcttagtttcctcaacaagaacgttttgaataataaactagctaatacatgcaaagcacttagaataatgactggcacaaagtaaatattcaataaatactagctattagtattactcttttaggatgaatcttactgtgacctctctgtccttgtgagaaagggtctttatttctccttttgacagttcatctagttccttttggtatactattcaaccgtctgtttttataaggaaaattcttaaggttttttcacaaacactggtaacattggatgtaatcractgttttatttaatttttgagacagggtcttgctgtgttgcccagcctggagtgtagtggcatgatcacagttcactgcaaccttgaacttctgggctcaagcaattctcccacgtcagcctcccaagcagctgtgactacaggcacatgccaccacacctggctatttttgttttttttttctaacttttcatcttttagtagagacgaggtctcactatgttgctgagactggtcttgaactcctgggctcaagcaatctgcccaccttggcctcccaaagtgctgggattacaggt

SEQ ID NO: 64901 - DNA, 601 bp, Human
gttctctgcattctagccacaatgtcaactttcaggtcatgcgacctccagcctcagggcctttacatatgctgaaataccccgctgggcatacacttcattctctttacctggttaatgcttggacactctgttgttttggcttcagctcattcctccttccatctcactctttgcatctaggtttaattccttatctcccaaattataacctccggtagttaaatcttagtagttaggagacaggacagtatccctgtcccagcttggccacttagcacaccatgtgaccctgggtagtttttttttttttttttttaatctctctgaagcttagtttcctcaacaagaacgttttgaataataaactagctaatacatgcaaagcacttagaataatgactggcacaaagtaaatattcaataaatactagctattagtattactcttttaggatgaatcttactgtgacctctctgtccttgtgagaaagggtctttatttctccttttgacagttcatctagttccttttggtatactattcaaccgtctgtttttataaggaaaattcttaaggttttttcacaaacactggtaa

SEQ ID NO: 64902 - DNA, 601 bp, Human
tggagcagctgacaaggagatgggggctgtgcagcctgggatctgaaagaaagctgctcagaaatattttaagtgtgaggtagcatgacaatgggtgatagtttcccctttctttcacctttcttccaagttttccataatgaattttaaatttttttataagggaaaaaaaacccttaaaggtaaacaaaacatctgattacatcttggtgacgtttgtgatgacactttaagaatttgctattacgactacaatttaccacacattatagttttgtttttaaaaaaggaatttaggacygggcgcggtggctcacacctgtaatcccagcactttgggaggctgaggcaggtggatcacctgacgtcaggagttcaagaccagcctggccaacatggtgaaaccctgtctctattaaaaacatacaaaaaattagccgggtgtggtggcaggtgcctgtaatcccagctacttgggaggaagctgaggcaggagaatttcttgaacctgggaggaggaggttgcagtaagccgagattgggccactgcactccagcctgggcaacagagtgagactccatctcaaaaaaaaaaaaaaaa

SEQ ID NO: 64903 - DNA, 601 bp, Human
agccaaggatctatatatttttaaaatacttcatacatgattacaacatgtagggaggtttggagccattacatgtgtgcgaaacatcataggagactgtcgatctttaattataatgggccatgagggtatttctgaatgctgcatgcctggagcagctgacaaggagatgggggctgtgcagcctgggatctgaaagaaagctgctcagaaatattttaagtgtgaggtagcatgacaatgggtgatagtttcccctttctttcacctttcttccaagttttccataatgaattttaawtttttttataagggaaaaaaaacccttaaaggtaaacaaaacatctgattacatcttggtgacgtttgtgatgacactttaagaatttgctattacgactacaatttaccacacattatagttttgtttttaaaaaaggaatttaggaccgggcgcggtggctcacacctgtaatcccagcactttgggaggctgaggcaggtggatcacctgacgtcaggagttcaagaccagcctggccaacatggtgaaaccctgtctctattaaaaacatacaaaaaattagccgggtgtggtggc

SEQ ID NO: 64904 - DNA, 601 bp, Human
ctgaaggtaagacagctgtaaagatttggaaaaattataaagagaaattttgtactcttgcatcgtaagttagtaagttctcatttcattgtaaaggactgaaaaaggaagctgaacttgcaacatgtgagaacattttgtgcaaaggagacaacctggagctccagaggacctacactcagtgaatgggcttggtcctacatccaaatatacatgaggacatgcagagaaatgttcaagtatataggtatcatttttgtggttccctattttaacttatttaaaaatgtagtaacagtatttttaacataggcaaaaggagagaaaataatgtatttccatatactcaaactaggttaaacagttacaaagatttttgacacatttgcttcatctatcccatattttatttctctctcaagtattttaatgcaaattcttgaaaacaatcacccctacagacgtcagcagacatctgcagaaatattttaagccagcttttgattgctgaccaacctgtggtacaggtaacaggactcctactgggtaccaagtcattcacctacaggcctacctttcccctctctttgcttcaacccag

SEQ ID NO: 64905 - DNA, 601 bp, Human
aggatgaaaagagggtttctatttctaggaaaaccaagttgaatgagttggagactccatagagatgggcttctagaataaaatggcactgacttagctgaaggtaagacagctgtaaagatttggaaaaattataaagagaaattttgtactcttgcatcgtaagttagtaagttctcatttcattgtaaaggactgaaaaaggaagctgaacttgcaacatgtgagaacattttgtgcaaaggagacaacctggagctccagaggacctacactcagtgaatgggcttggtcctacatycaaatatacatgaggacatgcagagaaatgttcaagtatataggtatcatttttgtggttccctattttaacttatttaaaaatgtagtaacagtatttttaacataggcaaaaggagagaaaataatgtatttccatatactcaaactaggttaaacagttacaaagatttttgacacatttgcttcatctatcccatattttatttctctctcaagtattttaatgcaaattcttgaaaacaatcacccctacagacgtcagcagacatctgcagaaatattttaagccagcttttga

SEQ ID NO: 64906 - DNA, 601 bp, Human
cagctgatgaacatttgggttgttaccacttttcagctgttttgaatagtgctgctttgagcatgtatgttgagttatgttattatttctcttgggtacgtacctaggaatggaattactgggtcatatggtaactgccttttgagaaactgccaaactgttttcaaaagtgactgtattattttacattcctgccagcaatgtatcaaggttctattttttccacatcatcctaatgggtgtgaagtggtatctcattgtaaggcaattcgtatttccccaatgactagtatgttgagcrtactttcatgtgcttactggccatttgtatatgttttgtggagaaattatgtgattgtgatttgcatatccactgatatttctgacccttgttaactcctttaagaatatggtagccagcaggtgcggtggctcacacttgtaatccagcacttcgggaagccgaggcaggaggatcatgaggtcaggagttcaagaccagcatggccaacatggtgaaaccttgtctctagtaaaaatacaaaaattagccaggtgtggtggtgggcgcctgtaatctcagctacttgggaggctgagg

SEQ ID NO: 64907 - DNA, 601 bp, Human
agtaggtatcaagttctcaatagtaaattttttaaaaattaagatataattttcctaccataaaatccacttttaaaaagcatataattcagtaattttttttcctttttgaaacagagtctcactctgtcaccaggctggactgcaacggcatgatcttagttcactgcaacctctgcctcccgagttcaagcaattctcctgcctcagcctcccgggtagctgggactacaggtgtgcaccaccatgctcagctcattgtttgtatttttagtagagacagggtttcaccatattggcsaggctggtctcaaactcctgacctcaaataatccacccaccttggcctcccaaagtcctgggattacaggtgtgagccatcaggcttggccgaattcagtagttttaatgtattcatgaggttgtgaagccaccaccccaaaaagaaacagcatacccattaagtagtcattccccatcccccttccctcgcccttgacctccattatccatctctatgaatttgcctattctggatatttcatataaatggagccatacaatattgaccttttatgtctatcttctttcacttagcaaa

SEQ ID NO: 64908 - DNA, 601 bp, Human
tgaattatatgataactataattaacatctgaggaactcccaaactgctttctaaagtggctgtaccattttacaattgcattaataataaatgagatttccaatttctctacatcttcaccaacacctgttgttttatttactttttattttttatttacttactacttttttcttttaaccatcctagtaggtatcaagttctcaatagtaaattttttaaaaattaagatataattttcctaccataaaatccacttttaaaaagcatataattcagtaattttttttcctttttgaracagagtctcactctgtcaccaggctggactgcaacggcatgatcttagttcactgcaacctctgcctcccgagttcaagcaattctcctgcctcagcctcccgggtagctgggactacaggtgtgcaccaccatgctcagctcattgtttgtatttttagtagagacagggtttcaccatattggccaggctggtctcaaactcctgacctcaaataatccacccaccttggcctcccaaagtcctgggattacaggtgtgagccatcaggcttggccgaattcagtagttttaatgta

SEQ ID NO: 64909 - DNA, 601 bp, Human
gtcaccagtcgccactcccacccccaacctcaggcagccatgcgtctgctttctgtctatagttctgccttttctagaaacttcatataaacacatagtctttggtttctggcttccacttggcataatgtttttggggttaattcatgtttttccatgaactagtcttttttttttttttttttttttgagataaggtcttgctctatcacacaggctggtatgcaggatgcagtggcatgatcacagctcactgcactcttgaactcctgggctctcaccttggcctctgagtagatgkgactaaaggcacatgccaccgtgcctggcctagtagtcccttcttttttattgctgtatagtattctattgtttccagcttttggttattatctattgtttccagcttttggttattacaaatgaagatgctatgaactttcattcacaagtatttgtctatgtatgttttcatttctcttgggtagacacctaggagtaaaattgctgaattatatgataactataattaacatctgaggaactcccaaactgctttctaaagtggctgtaccattttacaattgcattaataataaat

SEQ ID NO: 64910 - DNA, 601 bp, Human
tggactaccagaatcaacagcatgcagacagacacaaatcagcgtccagggcattccctggacttgggctagcctaggttcactgaggcaaggtcttccttggcggtcaaaagccacctagtatccaaggaaaatgagaatcagatacgcacgtgataatcctggactctggaagtgggctcagcctctgcgttcttacctgtttttgttttccagttctgcaataagctgtctttgttgtttgttggcatcaaagttaaagctcaagtcagtgggaggacgagtctaaagtggggaagtsgggagaaagtttttttttttctgatccaaatatacccagagttctagattgactgatttttaaaaaagatttttgacatataatttacatatcataaatccacccgttttaagtatacaattcaatgagtcttagtaaatttaaacagttgtgcaaccaatcaccacagtccagttttagaacattttccatcaccgcaaaaaattccctcatgccagtttgtcaccagtcgccactcccacccccaacctcaggcagccatgcgtctgctttctgtctatagttctgccttttctagaa

SEQ ID NO: 64911 - DNA, 601 bp, Human
tgaatctcctgcaggatctctctagagaggatgggtgaacggaaaggggctgcacagtgcttctcactcacgctccctctttccctattacaacttttcaactctagcagtgcctcctctaccaatcttgttttgattgcttccaaatggccaagaggtgaaatggacaccttctcaatactgcttcacctgacatttcctcaacaaagcaatcctttgtggtggaaaaagtcataaaaatactcttctcaaggacctgaaaaatctccaagaaaggaaaattacagccagaatactttayttactccgttccactcaggcaggaggaaaagggaactccttgcaacctcctaatgcaggtcctgtgctgacttcccttaatccttccctgccccttccttccctctgtccccgatgccccagtagacagctatgttgcttctatctatgcctgttaccttaggtcgggtctccacatcctggcttctacctttcagtacataatggtgtgctgtctgctctctgtgccgttaaatggcattaatttttttttttttttaaggagagaccagacagtcctacatagcataatgggtcagga

SEQ ID NO: 64912 - DNA, 601 bp, Human
tcttcttaaagcaatcacagaagtataaacagtgccctgctggtcctggagctgggagactggtatttaccaagttctgtgataatggctgacattcttagagtgatctctaatggaacccagacatctgaagcagcaacagaatgggtgaactcttcagtggtctgcgctcacaggattgtttatactgaacaacagattctaccccactcctttggtttcctcagataagttccatccatagtagattacatgtggcaagtggtagagtgtccctactcacctcagcagccgcagctcygccagcagcgtggggttctgctgtgccttctcaggggtgggctgggaggcctgctcgtgttccaggcggagacgctgaatctcctgcaggatctctctagagaggatgggtgaacggaaaggggctgcacagtgcttctcactcacgctccctctttccctattacaacttttcaactctagcagtgcctcctctaccaatcttgttttgattgcttccaaatggccaagaggtgaaatggacaccttctcaatactgcttcacctgacatttcctcaacaaagcaatcctttgtggtgg

SEQ ID NO: 64913 - DNA, 601 bp, Human
aacaatggatcagatcacttctgtgaagacttccccattccctccaaaacaccatcaaacatggtggtgacgctgctctctattcccattctcatcctatgtccttagtttcctgattcttgagacactttgtttagaagccatggtgcaagggtttcatgtctcagagatgcgcacaggaagcatccttctccttcggcagagccctgcattgactgtaaagtgccaggagaatatactcacagcaaaggcaaagcattcttcccgccaagtgtctctaaagtcagacaaattagcaagktaagagacagactgcagcacagtggtcttcttaaagcaatcacagaagtataaacagtgccctgctggtcctggagctgggagactggtatttaccaagttctgtgataatggctgacattcttagagtgatctctaatggaacccagacatctgaagcagcaacagaatgggtgaactcttcagtggtctgcgctcacaggattgtttatactgaacaacagattctaccccactcctttggtttcctcagataagttccatccatagtagattacatgtggcaagtggtagagtgtcc

SEQ ID NO: 64914 - DNA, 601 bp, Human
cacacacacacacacacacacacccctttctaaggctcataggcaataagaccctaacaatggatcagatcacttctgtgaagacttccccattccctccaaaacaccatcaaacatggtggtgacgctgctctctattcccattctcatcctatgtccttagtttcctgattcttgagacactttgtttagaagccatggtgcaagggtttcatgtctcagagatgcgcacaggaagcatccttctccttcggcagagccctgcattgactgtaaagtgccaggagaatatactcacagsaaaggcaaagcattcttcccgccaagtgtctctaaagtcagacaaattagcaagttaagagacagactgcagcacagtggtcttcttaaagcaatcacagaagtataaacagtgccctgctggtcctggagctgggagactggtatttaccaagttctgtgataatggctgacattcttagagtgatctctaatggaacccagacatctgaagcagcaacagaatgggtgaactcttcagtggtctgcgctcacaggattgtttatactgaacaacagattctaccccactcctttggtt

SEQ ID NO: 64915 - DNA, 601 bp, Human
tttaagagaacgaaaatctctatacatctaatgattttttttcacctgcacagtttaaattctttatgactctactatgacaacttttattgatgatataaatctaaacagtagaacatctacagaaaacaataatctccattctctgggaaaagaaacaagaggctacacagaatcctagatgatagcaaattaaaaatcaacctaaacagaaagaatccactatttgaaaatctagaaatctggtgagaagtcactaaatgtagtttccataatgtcttaacttacagaagagtgcgtccacacacacacacacacacacacacacacacacacccctttctaaggctcataggcaataagaccctaacaatggatcagatcacttctgtgaagacttccccattccctccaaaacaccatcaaacatggtggtgacgctgctctctattcccattctcatcctatgtccttagtttcctgattcttgagacactttgtttagaagccatggtgcaagggtttcatgtctcagagatgcgcacaggaagcatccttctccttcggcagagccctgcattgactgtaaagtgccaggaga

SEQ ID NO: 64916 - DNA, 601 bp, Human
aaggaagaaaaggcatccctggtggtcaaggctcatagccactcaccctatgggtgaagttgtctaccttgttttattatactagctgggtgctggcagtccctggcctcatatatactgatcaaaaccagacagatgtcagatacctacaagtgaatccagccctttatgtgtcttttgataagcaaaagttcttaatattaatataaatggatttaccaacttcttctttcatggtaattctgagatactactttctattccaaaatcctgaggacattctcctactttcttctagaatttttttttttttgagatggagttttgctcttgttgcccaggctggagtgcaatggcatgatcttggctcaccgcaacctccgcctcccaggttcaagcaattctcctgcctcagcctcccgagtcttctagaagttttaaagttctgtattcatgttgaatccatctggtgtcggtttttgtaattagtgtgaagtagaagaccagtatgttttgtacataggcatagaaaactgtcccagcacactttaaaatagtccctcctttcttcagtgatataggaactgcttttgaggttaaa

SEQ ID NO: 64917 - DNA, 601 bp, Human
aatattgttttaaacacaaggtaatgataaaccaaattctggataggcgttcacccagtggggaaggtggaggcaaggaaatggggtaagggagaggtacttctatggatggcattgttttagtcatattatgagttctcaaataggatgtgggtttataagtattcatttgactattacgcttcatatacgtttgtcgcacacacattcgtcatacattttattgtaagcaacgtaccattaaaaataataataaaggaagaaaaggcatccctggtggtcaaggctcatagccactcaycctatgggtgaagttgtctaccttgttttattatactagctgggtgctggcagtccctggcctcatatatactgatcaaaaccagacagatgtcagatacctacaagtgaatccagccctttatgtgtcttttgataagcaaaagttcttaatattaatataaatggatttaccaacttcttctttcatggtaattctgagatactactttctattccaaaatcctgaggacattctcctactttcttctagaatttttttttttttgagatggagttttgctcttgttgcccaggctgg

SEQ ID NO: 64918 - DNA, 601 bp, Human
cagacctgatcctgctacttaccagttatgagacgctgagcaagtcatttagcatccaatacctcataaaatggtgataatgtctgttttgcctacttcctggactgttctgagaataataggtaaaagtgctttggaaagtttagatgactatataaaggtattacttatattaccagagtgaattaatgattaaaaaactctttagaaaatcaatgccttttgaaaaatatataaaattagcccaaatttagattaatagtaaagaaaccatattaaactgctcagagaaaacagggtycagtagtaagtactttcagcactagacagattcaagaaggatgacagatcaggacggctccctgtgttcaagaacagtcacttttccttgaggatagattttatgccatctactccagctcaatatgtccaaaaccagacttaagactttattccctaaatggttttcttgtctctgtctctttttttttccttgtctctgtctcttttccctgtctctgctatttttccttccaggtgtcatggttgaaaaactcagtcctctttgttactttcttctttatatcctgtattcaatcaa

SEQ ID NO: 64919 - DNA, 601 bp, Human
atgacaagaactgagcgtgggccacgggctcttaccttcagcaacttcatcagctcttccagctggaccatcagctcccgcctgctctcctgcagggccgacatcctctgctccagttcatccttcctttgcctatccaagacgagaagcctatcagataaagagaccctcaaagatggatctaaggccaggtgaaatggatttcagacctgatcctgctacttaccagttatgagacgctgagcaagtcatttagcatccaatacctcataaaatggtgataatgtctgttttgcctacttcctggactgttctgagaataataggtaaaagtgctttggaaagtttagatgactatataaaggtattacttatattaccagagtgaattaatgattaaaaaactctttagaaaatcaatgccttttgaaaaatatataaaattagcccaaatttagattaatagtaaagaaaccatattaaactgctcagagaaaacagggtccagtagtaagtactttcagcactagacagattcaagaaggatgacagatcaggacggctccctgtgttcaagaacagtcacttttccttgaggata

SEQ ID NO: 64920 - DNA, 601 bp, Human
cacagggaggcagcagctgaggctgtggtgggagaagaatgacaagaactgagcgtgggccacgggctcttaccttcagcaacttcatcagctcttccagctggaccatcagctcccgcctgctctcctgcagggccgacatcctctgctccagttcatccttcctttgcctatccaagacgagaagcctatcagataaagagaccctcaaagatggatctaaggccaggtgaaatggatttcagacctgatcctgctacttaccagttatgagacgctgagcaagtcatttagcatccartacctcataaaatggtgataatgtctgttttgcctacttcctggactgttctgagaataataggtaaaagtgctttggaaagtttagatgactatataaaggtattacttatattaccagagtgaattaatgattaaaaaactctttagaaaatcaatgccttttgaaaaatatataaaattagcccaaatttagattaatagtaaagaaaccatattaaactgctcagagaaaacagggtccagtagtaagtactttcagcactagacagattcaagaaggatgacagatcaggacggc

SEQ ID NO: 64921 - DNA, 601 bp, Human
acagtgagctatgatcacgccacaagatagacctgacttattatgcatgtatttagttccccagtatcccaaacctacagctaatatgctatcttactcttaatatagtgaagttactgattagaatggtttaattaggttggtttgtgtgatggttatttttatgtgtcaactttaccagattaaaggatagtcagatagctggtaaaacataatttctgggtgtgtctgtgagggtgtttccaaaagagattggcatttgaatcattagactgaaaaaagatctgccttcaccaacatragcagcatcatccaatccactgaggacttggatagaagaaatcgcttgggtgtagctctagtttgtacaatttaattattatacaatttcatggtataaataggctataacttcataatccattctactgctgatgatcatttggattagttccaatgtttgactgttgtgaatagtcaatgccctcagacatgtgagctccccaggttcttgggcctttggactctgggacttaaaccagcaacccaacaccacccatctcccaacccacctcccagattcggaatcacaccgtcagtt

SEQ ID NO: 64922 - DNA, 601 bp, Human
ggggttaagatccttgtcacttcgggcctggaggatgaaattagtctcctattatcctttagtttcttcccactctaacttgccctgcgcattttcctaaactgttatttttaaaacctccaatgactccactttatcacaagattaaattcactcctgtcatctggctttgggggcactccacactttgtgattttctctggctgttaactcgatatcatactacaaaatgcagggagttctcagcatcgctgggcaggacctgagaaagtaatagcaggagcaagtatcctggtattgytgctatgtaaccaggtagatatttctgttcgatgccaataaaattgtccagggggagggcattcaaatgccaaccatgcctttctttgctcaggggtacaggggttgtaatataactttcaacaacaatagatagacttcatatgcctgtagtcctagccactcaggaggctgaggaaggaggatcccttggacccagctcaagcaaggttacagtgagctatgatcacgccacaagatagacctgacttattatgcatgtatttagttccccagtatcccaaacctacagctaatatgc

SEQ ID NO: 64923 - DNA, 601 bp, Human
aggggagatacactctggcttccctgcagtttacataaaccttttgccttttacaaaaatcacactggggcactgggactttcccatctatgcttgggtaatatttgagaacatctttctgaaaagggagatgtgacacagggaagaggtgagtggatcccctattttttttttttttgagactgagtcttactctctgaccctggctggagtgcagtggtgtaatctctgctcactgcagcctccacctcctgggcttaagcgatcctcccacctcagcctcctgagtagctgggattayaggcacgtgccaccgtgcccggctaatttttgtgtttttagtagagatggggttttgccatgtcagccaggctgaactcctggcctcaagtgatccacccatcttggcctcccaaagtgctggtattacaggtgttagccactgcgcccgactggataccctattatctcccatcccacaggtgtactaactccatggcagcagggcttttaaagccccacgaggctgcagatgttacacaggccatgtatgtttaagtacatccctgctgtttagatgaggggctaggttgcttagctg

SEQ ID NO: 64924 - DNA, 601 bp, Human
atgtattttaatttatgagtatctcagaccatgtggcttgattgtccatctgactaactgcttccgactattttatgagagaattaaatgctagcatactgaacatcaataaaagcagacaaccccttttaaattaaaattaggattttcttttcttttttttttttcttgctctgttgcccaggctggggtgcagtggtgtgatctcggctcactgcaacctccacctcctgggttcaagcgattctcctgtctcagcctcccaagtagctgggattacaggcgcgcaccaccacgctcrggtaacttttgtatttttggtagagatggggcttcaccactttggccaggctggtctcaaactcctgacctcaggtgatccacccaccttggccttccaaagtgctgggattgcaggtgtgagtcactgtacctggcctaaaattaggattctaaagggtacttttatgggttgatgaatatatatttctaatagtaggaaaacactgaaattttaacagaagtcagtaattcctgtgtatgacctttcaggtatgcatataatacaaaaattaagattacgtggtaattcttttaggaa

SEQ ID NO: 64925 - DNA, 601 bp, Human
gtgccactgcaccccagcctgggcaacagagtgagactccatctcagacaaaaaaacaaaaaaacaaagaaggagggtccttgatactccttgattgatcagggattgagtctagtcaccatgatatgccaaataactaatgtgacacttaggaactcaatagatttttgttaaagaaacaaaaaaattaattttaaccctgctttattccaaaaaaggattaagatttttgttgaatgaattaacagtgatgtcacttcttatgtatgcttctttaaattatcatttcagatagaagatraagtacataatagtttcctgaagcagcagaatgaaagaactctctgtggcatgaaaatttactgtgagatgtattttaatttatgagtatctcagaccatgtggcttgattgtccatctgactaactgcttccgactattttatgagagaattaaatgctagcatactgaacatcaataaaagcagacaaccccttttaaattaaaattaggattttcttttcttttttttttttcttgctctgttgcccaggctggggtgcagtggtgtgatctcggctcactgcaacctccacctcct

SEQ ID NO: 64926 - DNA, 601 bp, Human
ctgctgtggctcaacagaatagggaaattcagaaagcaatgtttcatacttggacatctggtgattgcaatttaagtttgtcagaagagaaaccgtaatttgcagtagatatatcaggttaggctggggacagtgggcagggcagcgcttccaggacttacaggccttccatgtggcctggtactggggagagaatggactttggcaaagtgttatttaggatagtgttgtataatttaaactcacaaaacttattcagataaagcccttaaggctctgtcaacacagtaaacaggtcagwtcccaggtctgagaacctctgtgttatcaactagtcaggtggggtcactaaatattgactgatgacaagggatagagccaacgtgatttaaaagggggtaataccttaattataaagtgtaaacttagaactgcttatgtcacctaaaaacatgtgagtctcttccacatgaatgaggtctggcaaggtggccaaagcaatgacatagccactgtagtcatttacataaaaatttacactcaaactagataagcatttgcaaatgaggttgaaattcaaaactgcagaattcatctggta

SEQ ID NO: 64927 - DNA, 601 bp, Human
accaaagccaaactcacaggagcctaggcacagagcgctgaacactggctctggcagcgggaaggaattagagcgcttctgcttttgcacctgctttgcagttaggaagcaagctctcttccttgccagacttccctttggggcaggacacttttcttatattcttgaggcaaggcaaacagtcataggacagttattaaacaattataaaatgtgttttcattgctggcactgtgttgaagtggaaagtgcgatggttggggagggatggggcaatcctaacaggctgaaattgtatccraggtcaaaagaccagtatgtaatttcttagaactgtttctaagacatctccctacttccacagttttctccaggtttggtattaaagagaacactgctgtggctcaacagaatagggaaattcagaaagcaatgtttcatacttggacatctggtgattgcaatttaagtttgtcagaagagaaaccgtaatttgcagtagatatatcaggttaggctggggacagtgggcagggcagcgcttccaggacttacaggccttccatgtggcctggtactggggagagaatggactttggca

SEQ ID NO: 64928 - DNA, 601 bp, Human
agtatgtaaatctaaaagctgtgcaatggttctatttaaattggaacaattcatgcagccagtctttactgaacatgtacgtgcctaggaagtctcaggaatgggtaagtgctcctgctcccacacagtctacagacctgggtgcaatggtgagaaagacctcagtaaagcaaaggaattacgaaagggagagggtgagtaaacacttggagaacataatttttattactgcaagggacagacagggactagaaataaatgggcaccgagaaatctcttaaggagactcccaactcagcaygggaaggtgctcttcacaatcaaagccagatgctggatgcctgaccaaagccaaactcacaggagcctaggcacagagcgctgaacactggctctggcagcgggaaggaattagagcgcttctgcttttgcacctgctttgcagttaggaagcaagctctcttccttgccagacttccctttggggcaggacacttttcttatattcttgaggcaaggcaaacagtcataggacagttattaaacaattataaaatgtgttttcattgctggcactgtgttgaagtggaaagtgcgatgg

SEQ ID NO: 64929 - DNA, 601 bp, Human
acctggccggtctctgtcttttagaaccttatggtgatggaacacagagcaggcacttgctggctattagctgactgcccaaatgaatgcactatcagacactgcaggaaaaaggataaagagaacactttcaagtttctctttcttcagttctttgctactcatctactctgtcttttaatgggcctcttccacttcctccttctgtgcctcaccatgggtcactgtggtcagggagactcagctctttggcctagtatgtaaatctaaaagctgtgcaatggttctatttaaattggarcaattcatgcagccagtctttactgaacatgtacgtgcctaggaagtctcaggaatgggtaagtgctcctgctcccacacagtctacagacctgggtgcaatggtgagaaagacctcagtaaagcaaaggaattacgaaagggagagggtgagtaaacacttggagaacataatttttattactgcaagggacagacagggactagaaataaatgggcaccgagaaatctcttaaggagactcccaactcagcatgggaaggtgctcttcacaatcaaagccagatgctggatgcctgac

SEQ ID NO: 64930 - DNA, 601 bp, Human
tcattttcatgcacattcattcatgacatgaggtcaccccagcaccctgaaagttgtttcaagcaattaaaatcactccagacacacaacaacagagaatgaaagagcaggaaaatgcaatggtagcctggctaatcatgcacacttcaatgcgcacaacagatgggtacttacaagctctggttttaagtaagaacatgctctactgggtaaacatgccttgaacttttaggccattttacaacaccatggggagaaccgctgggggttttacacataaaaccctcttcagagatgatgygcggggagaagaggagaaacatttatatgaggaaaggaagaacgtgcaaaggagcgagagtccggcgggaaattccgaagttcacttactgcctgcttttgctcttcctcctggagtgttgaagatgaaaaaaaaaggcagaggaaaaaaggagagaaattaatgcccattaatgcccatcaccacaaacattggtcagaaatgatagaaaaatcaggcaaaccaggccaggcccacaggtgctgagatcaaaggccccatcccccacaggagcatcagaggacgaagcaagcagcaggc

SEQ ID NO: 64931 - DNA, 601 bp, Human
cttcttttttttttttttttttttttgagacagagtctcgctccgttgctcaggctggagtgcagtggcgtgatcttggctcactgcaacatccacctcccaggttcaagcgattctcctgcctcagcctcccgagtagctgggactacgggtgcatgctaccatgcctggctaatttttgtatttttaatagagatggggtttcactatgttggccaggctggaccagagtttctaaaacccgtggaatctccagagtgatatgcgtgtcttttgcatgctaatgagatgaccgggcttygggaatcttggatagcttcaggatggggactggttgccagaaagaccacggcattattagagggttgaaagtttcagccccttccaccaggccttggggaggggagaggggctaaagattgagttaatcaccaatggccaatgaatgaatcaatcatgcatacataatggaacccccataaagaccctaactgaggggttcagagagcttccggttggtgagcatgtctatatgccaggaggtggtatataccccaactccatggggactgaagctcctggacccttctggaacttgccc

SEQ ID NO: 64932 - DNA, 601 bp, Human
agtgaagtcttatctgaaatagccaggcagtttgcccctccattataacccttagatctgagaaaaacagaagggaaagaggggggaagagagagaggaaagacagaagaatcagtggaggtactgatgccacgcaaagcaccacaaaagtggctgaggctgaaggcagaatcacagcacccaagcttttaaagtaacagttattgcccatttctctcaagtttcccaaatgccaaagtaaccctgtgatactatgatataaccaatatatatttggtctccattccaggttcctggcatragagcttcttttttttttttttttttttttgagacagagtctcgctccgttgctcaggctggagtgcagtggcgtgatcttggctcactgcaacatccacctcccaggttcaagcgattctcctgcctcagcctcccgagtagctgggactacgggtgcatgctaccatgcctggctaatttttgtatttttaatagagatggggtttcactatgttggccaggctggaccagagtttctaaaacccgtggaatctccagagtgatatgcgtgtcttttgcatgctaatgagatgaccgg

SEQ ID NO: 64933 - DNA, 601 bp, Human
aatcctacaaccgtatttctgactgtaagcactgggcttttactgagcaatatttaaaatattttcaaacgatgcaaataactatagatatcctgcattttatagattattatctttaaaagacaaggtgatttttatgccatgtatcagtatattttctttagctagaaataacaacattaataattaataataatactaatcagcttggtgtttgtatttttttggtaacaaatttttttcagattcctttttaaaaaaattattttcattatttgctttcttgggaaatcagacaccttttttttttaatactttaagttctagggtacatgtgcacaacgtgcaggtttgttacatatgtatacatctgccatgttggtgtgctgcacccactaactcgtcatttacattaggtgtatctcctaatgctatccctcccccctccccccaccccacgacaggccccggtgtgtgatgttccccttcctgtgtccaagtgttctcactgttcaattcccacctatgagtgagaacatgcggtgtttggttttttgttcttgcgatagtttgctgagaatgacggtttccagcttcatcc

SEQ ID NO: 64934 - DNA, 601 bp, Human
ttaagtctttaagccagatgatcattattagataattaacttctaataggagagatcagataaatgttggaggaaacaaatccttcatgaataaacagaacccctttccttggatagctcagtgaatgtggtattagagatccagcagtgaaattttatggtgcactgagtcactgggaaaaatggaaccctaaaatgttcctagatgaacttgtacatctgaactgtttccagactaggattgggatattgtttgattgaggccagagaggcccatagctcaaatgcaccaatggtcatraacaccattgccagtagggacttcatcagtctctggtgaccctagtgtccctctgtaacatgctgatgaatcctacaaccgtatttctgactgtaagcactgggcttttactgagcaatatttaaaatattttcaaacgatgcaaataactatagatatcctgcattttatagattattatctttaaaagacaaggtgatttttatgccatgtatcagtatattttctttagctagaaataacaacattaataattaataataatactaatcagcttggtgtttgtatttttttggtaac

SEQ ID NO: 64935 - DNA, 601 bp, Human
tttgtctgggtcttggaaatcagatagggcatgatggcaagatcccacgtgatagccaaactcactgaagtaaaaggaaaggtcccaagtgtggcaaagttctcttggccaattccccaagattccactaatcacattattttcagagtgccaggtatattatcctttggcccactgccccactacctaagctgggccaaggccaccctgaaggagcttcctatccttacataacttttactgtctaaagttacagtctttaagcctgatgatcattatataaaatgttctattaaacatrtataaagtctttttaagtctttaagccagatgatcattattagataattaacttctaataggagagatcagataaatgttggaggaaacaaatccttcatgaataaacagaacccctttccttggatagctcagtgaatgtggtattagagatccagcagtgaaattttatggtgcactgagtcactgggaaaaatggaaccctaaaatgttcctagatgaacttgtacatctgaactgtttccagactaggattgggatattgtttgattgaggccagagaggcccatagctcaaatgc

SEQ ID NO: 64936 - DNA, 601 bp, Human
tctgaaagtactttctcttaaacttacaaagttagtattcatgaggtttatgtgagcccttgtgggtcgaccattgctaactaaacattaagtgcccttcctttgaggtatatttggtagagctgtgatcagaaaggggggcttcctggagccaggccaaaccatgctctctttggtatagctgtaggtgggtatttgtctgggtcttggaaatcagatagggcatgatggcaagatcccacgtgatagccaaactcactgaagtaaaaggaaaggtcccaagtgtggcaaagttctcttrgccaattccccaagattccactaatcacattattttcagagtgccaggtatattatcctttggcccactgccccactacctaagctgggccaaggccaccctgaaggagcttcctatccttacataacttttactgtctaaagttacagtctttaagcctgatgatcattatataaaatgttctattaaacatatataaagtctttttaagtctttaagccagatgatcattattagataattaacttctaataggagagatcagataaatgttggaggaaacaaatccttcatgaataa

SEQ ID NO: 64937 - DNA, 601 bp, Human
gagggccgcagtggtgcctgaggcccgggataccactggcccggcttgtgtttctgcatttagggtatcatgtcaaccatgaaataactttcagactatttgatggtggtatttgtgtacgatttctctttttatcctccaaaaggccaggctcactgtcttgaacatatatagtaaaacaccgctaaataaataaatgaatggcaatcctttgccttttgggaagtagactcaggcttctatttcggaagattaagagccacggagcccagaagattgcagaagcatgtgaatctgaatygcttcccagtgagactgtatccaaaggctaagaagggaacgtgacccatgaggcatgctaacatcaaggggttcaccaacaatctctttaatggccaaagaggaggtttctttttcttgttgcataggtttgtttttctgaaagtactttctcttaaacttacaaagttagtattcatgaggtttatgtgagcccttgtgggtcgaccattgctaactaaacattaagtgcccttcctttgaggtatatttggtagagctgtgatcagaaaggggggcttcctggagccaggccaaacca

SEQ ID NO: 64938 - DNA, 601 bp, Human
gaaaaaccatagctgggcgcggtggctcatggctgtaaccccagcactttgggaggtcgaggcaggcagatcacctgaggtcaggagtttgagaccagcctggccaacatggcaaaaccccatctctactaaaaatacaaagattagctgggcgtggtggcgtgcgcctgtaatcccagctacttggtaggctgaggcaggagagtcacttgaacccgggatgcagaggttgcagtgagctgagatcatgccattgtactccagactaggcaagaagagtgaaactccgtttcaaaaaaaraaaagaaaagaaaaaccaaacctatttttagtattatagtgatatttcctctttttggaaaaaaaataacaacaaactgccaggtccctacggtgagtacaggtgccaagaccgatgaatacaccctgccaactcttgcaaggccatgtgtgggagggagccagcagtagcagacagtctatgcacatatcctgggactgcgacccaggataaaggtttgtgggagagtcctacgtatagcacagcgatcctcatttaccaacagacatctgtaccatttgccaacttaggagggccgca

SEQ ID NO: 64939 - DNA, 601 bp, Human
ctttatcaggtccccagagacacaggtatggggcttcagtcacgccaccctgccatgacgaggcgggggggcaatggtttaaaggcattttgttactgactagctgcttcactcattagcttcatgttcctggaatgtgcgataaaaagaacaatgtatagataatcaatagcttatgttattatttttttaaaacgtatctggcctgtgacacaaccctcaggagatcctgagaacacatgccctgcttatgttactttaatgtaagttcttggtaaacaacttaggaactgccttttcttttttttttttttttttaaacccactgtaactgctgctaatcagaatgtatattcagggcaatttgaatctttgctcctggggggccatcctcaagctttgggctcaaatagacttatacttaaccataaagaaaaaccatagctgggcgcggtggctcatggctgtaaccccagcactttgggaggtcgaggcaggcagatcacctgaggtcaggagtttgagaccagcctggccaacatggcaaaaccccatctctactaaaaatacaaagattagctgggcgtggtggcgtgcgcct

SEQ ID NO: 64940 - DNA, 601 bp, Human
gaggccctgaaggatggttttcatatgctgtgtgcattctggtcaggagaggaaaagacagaaatatagtacaggagggaaatttaggaagtaggtaaggaaatctctcagcctgacattgatgagtgatgaaaaatattggggggtgtggcacacaccccaaagctacttttctcttgtatcctcggactcttgttaggtgctcagggagttttgggggagtgaaatacaaacacccatcccccatccccaccacgcaagacaggaccatctggaaatgaaccttctgggtatgcaagastaagttcctgaacataaaagaaaccaaaaccatttttgttcatctatgatgctttcccagaaggatcttgatgaaaagaggggaaatgagaacaaaaataactcggggaagtctgaattatatgaggtattcaaactttatcaggtccccagagacacaggtatggggcttcagtcacgccaccctgccatgacgaggcgggggggcaatggtttaaaggcattttgttactgactagctgcttcactcattagcttcatgttcctggaatgtgcgataaaaagaacaatgtatagataa

SEQ ID NO: 64941 - DNA, 601 bp, Human
tccttttctgttaatgctttgctgagattcagtctgtagtattctgggggaggcagtgtgtcctaggaattcaatattcttccagtggaagaatttctccagttggctgaggagataatgtttttggaggccctgaaggatggttttcatatgctgtgtgcattctggtcaggagaggaaaagacagaaatatagtacaggagggaaatttaggaagtaggtaaggaaatctctcagcctgacattgatgagtgatgaaaaatattggggggtgtggcacacaccccaaagctacttttcycttgtatcctcggactcttgttaggtgctcagggagttttgggggagtgaaatacaaacacccatcccccatccccaccacgcaagacaggaccatctggaaatgaaccttctgggtatgcaagagtaagttcctgaacataaaagaaaccaaaaccatttttgttcatctatgatgctttcccagaaggatcttgatgaaaagaggggaaatgagaacaaaaataactcggggaagtctgaattatatgaggtattcaaactttatcaggtccccagagacacaggtatggggcttcag

SEQ ID NO: 64942 - DNA, 601 bp, Human
cctgagagtagaggctactactggtgcttagtgggtaaagttaaggatgctgctaaacatccttaacagcctgaccaacatggagaaaccctgtctctactaaaaatacaaaaaaaattagccaggtgtggtggtgcatgcctgtaattccagctgcttgggaggctgaggcaggagaatcgcttgaacctgggaggcggaggttgcggtgagccgagatcgtgccattgcactccagcctgggaaacaagagtgaaactccgtctcaaaaaaaaaaaaaaaaattcgagaccagcttggscaacattggccaacatagtgaaatcccatctctaccaaaaaaacacatatgtttttctataacacatacaacaactacttgcaaaaagagagttaactggccccgaatgtcactaatgctgagaatgagaaggatggctgagggtgacttagtcatgaggtcctacagaggatggtctgcccagggctattttcctgggtggtgagctgctgtggaaagaagggtaggcagccagcatcctcaggttagttagaccttcaaagggcccaagaatagactgccgtatcttctgcacacttg

SEQ ID NO: 64943 - DNA, 601 bp, Human
tactgtctaatcttttaagaaaatgcctgctgactcctgctacaggcaaaggcaagaggagccggtgaaggtttctaaggaggggagggatgtggccagtctggtctgtgctcaggaatcaagctctgggcaatggcacagagggactgagaaacgagagacaggagacaggggttctatcaataaagtggcttttccaaaacccggtgacagataatggaggctggaatggggtataggaatagaaagagggagagcaacttttgggagaaaaaatggacttgaagttggcaactgagarggaagagcaggaggctggcgatggctggcagggatatggtgggtgctgataacggcatcagcagaagcaggaaatacgtgcagaggagggatctgtggggcccacccttccgatagccaaacctcagaataaggggttctgagaatgccgtggaggcgcatatttgtatcacagggaaaggttctctggactcagagcagggcttccaattaacaagggggcaattttacctgctagggccctgagagtagaggctactactggtgcttagtgggtaaagttaaggatgctgctaaacat

SEQ ID NO: 64944 - DNA, 601 bp, Human
agcgattcttgtgcctcagcctccagaatagctgggattacgggcgcccgccaccacaccccgctaatttttgtatttttagtagagatggggttccgccatgttggccagggtggtctcgaactcctgacctcaagtgatccacctgcctcggcctcctaaagtgctgggattacaggcatgagccactgtgcctggcccgtatcccactagtcttcactgcaagatttcaaagccagttctctgcaaaatgatgagagacctcaccaaccaagagaaaaatacctatacaatgaatgcygaacactcagatagcatactagaaacagaaactaggctaggttctcaggaggatgtggtccttattcagacagctaaatctattagcaggaagccagctgggacctatcagtggggttttaaaattctatgagtctaatttaaatgttacttatgggtaagccaaatttgtgtggtgaggtatggcacccttattcaacaatgacactctgcactttgttaagtccctgttatatgtaacatagtggttagagtccaggctttgcagttggataaacctagtttgtttgtttgttttttg

SEQ ID NO: 64945 - DNA, 601 bp, Human
tttctgtttgtttctcccagtttgcctagccctatttgaaaatggtatcccagtagtctttttttttgagacagagtcttgctctgtcacccaggctggagcgcagtggcgcaatctcggctcactgcaacctccgcctcctgggttcaagcgattcttgtgcctcagcctccagaatagctgggattacgggcgcccgccaccacaccccgctaatttttgtatttttagtagagatggggttccgccatgttggccagggtggtctcgaactcctgacctcaagtgatccacctgcctyggcctcctaaagtgctgggattacaggcatgagccactgtgcctggcccgtatcccactagtcttcactgcaagatttcaaagccagttctctgcaaaatgatgagagacctcaccaaccaagagaaaaatacctatacaatgaatgctgaacactcagatagcatactagaaacagaaactaggctaggttctcaggaggatgtggtccttattcagacagctaaatctattagcaggaagccagctgggacctatcagtggggttttaaaattctatgagtctaatttaaatgttact

SEQ ID NO: 64946 - DNA, 601 bp, Human
ttctatctccctgactcatggacacctgccaggtagcagatggcctgtgtggacaattaccttcattttgctgccgtgtatttaaattaaacaaagtggtctctttgctgccgattttcagaggccctctcagagaaacaaaaaacaatgatgggagagagttgctgcaagtctgaaatttaggcaaccgtgaatgtatagagaactgggatatgtagagaacagcctttgtccatttttctcttcaagaaaaagttaaaaaccccacataactattttgagctggtgctggtggtgaccrtgctaggaagatgcagctgtctcatcaaagtggacgtgaaacgagggagaggtgatggggctatctgatgctgcactgtctgtcctgctgtgagagttggaaataaccgcctcacacgacaagagttaagactattgggagttaggactggcaatggaagtgctcagagaatggagaatgagggtgaaggagagaggcaacccaatggccgtgagcaaggaagcaggcaatgaatgtgcctggacaccttccctgcttagcagaggcgcccacctgcaagcttaagtgctgcggagtctt

SEQ ID NO: 64947 - DNA, 601 bp, Human
accccagcaaactagcttgttttagtccaacattcatttttcatttgaggaggctgaggtcaagagaggtcacaaggtcacacacaaaatcagtagacaggctaggactggtccctgggtctgctaattgcctcaaactgctggcggaaaactaagcatattgggatcacagcacaatgtttctgagactaaaaggaacatggatcagtcaagacttctgatgactgacactaaccgtgattttccaggggacagtcaatttcattcccagtaaggaaatgtgagaaaggagaatacaggrattatgaaaatctcttatgtataaaaacaatctcttgttggagccaaaacaggtatagaaaatgccagagaaggtgccctgaggacacggggatccttcaccagctctgcatctgagcacagaggcagggacgcacatgctgtggcagagagaactggccaggagaccagctgcacggagagaaaggcagtgtctttagtaggaaaatgatactgcactgttcttggccatgcttgggtggccccagcatgatgcctggcacttagtaggggctccaaaaataggacttcccttctttct

SEQ ID NO: 64948 - DNA, 601 bp, Human
tccaatgataggcacaaaagactcttgtgcctctgggtttcagctgccaggagagggcaattcgcctggagaagcaagggaagctctgcaatgtgctactcagtgttttaaggtttcctgatataaggagtggaatcttgttgtagtacaagctgtaacaaaggcttgagtccagcacaggccaatcatgggtctaaccaataactaaacacaataaatgccctgtgactcaggttctctcaatacagaggtcccttgtataacagttggaaacaattctgttgcaaatgtagagccagtraaacattacaatctgataagctctctagactgctggctcttcattttcaaatcagcaaagaccctgagaacccgagaaagctctgcatcatgttccaagaaaagtgttcagaaattacaaaatcagagggttcatgaccccagcaaactagcttgttttagtccaacattcatttttcatttgaggaggctgaggtcaagagaggtcacaaggtcacacacaaaatcagtagacaggctaggactggtccctgggtctgctaattgcctcaaactgctggcggaaaactaagcatattgg

SEQ ID NO: 64949 - DNA, 601 bp, Human
tcaacgcgaaccagtctagaatacgcggcacagtgggagacttggggagggggaggcatcacagttggcaccctgagattacaggaaacctgagaaacacctagaaatctgcaaaggtagagcaactagtcaggtggctccaaggatggggatatgttgtccaatgataggcacaaaagactcttgtgcctctgggtttcagctgccaggagagggcaattcgcctggagaagcaagggaagctctgcaatgtgctactcagtgttttaaggtttcctgatataaggagtggaatcttgtygtagtacaagctgtaacaaaggcttgagtccagcacaggccaatcatgggtctaaccaataactaaacacaataaatgccctgtgactcaggttctctcaatacagaggtcccttgtataacagttggaaacaattctgttgcaaatgtagagccagtgaaacattacaatctgataagctctctagactgctggctcttcattttcaaatcagcaaagaccctgagaacccgagaaagctctgcatcatgttccaagaaaagtgttcagaaattacaaaatcagagggttcatgacccc

SEQ ID NO: 64950 - DNA, 601 bp, Human
atctcttggcctcatgatccacctgcctcgcttggcttcccaaagtgctgggattacaggcgtgagccatcgcccctgaccttttttttttttttagacaggatcttgctgtttcccaggctagagcacagtggtgtgatcttggctcactgcaacctccacctcctgggttcaagtgattctcgtgcctcagcttcctgagtagctgggattacagacatgcaccaccacatctggctaatttttgtatttttagtagagatggagttttgccatgttggccaggctggtcttgaactcytgttctcatgtgatctgcccacctcagcctcccaaagtgctgtgattacaggagtgctgggcccagccaaccagtgaatctttatgtgagatactttaactagataagcaaatgtggtcaccagacctctgagatggccccaagggaccctcccctgcattcatatccgggtggagtctcctccccttcaatgtgggctaggcctagtgactcgctgctaatgaatcagacaagtgggatatcacttgtctgggataaaaactgtatttttcagatataaaattctgtgacctatgatct

SEQ ID NO: 64951 - DNA, 601 bp, Human
gggtcttatgccccagcccttggcgttaggatcacactggatgaaaatgaagccaggacagagctgtcagggccctccgtgaattctggtttgtgtagggtaataccagtttgcaatcctgggtgggtcagaggcacaagtgatagctcaccaatatgcatgggctttcgccaggcctgaggctaagggttcaggaagcctggagaccggagccgatcttggatgagatatacatcacgcaagggatgtcaaccaactctgttccttggtggttttgacaaaaaagcaaaagtgtgggccyatccacacttgactctgttgatgggactctgctctctcttgccactccctctgctgggagcactactctcccccatgctgtctgattggctcctgctggtcccctgggcatcagtctcactactatctcctctaggatgagacaatgtctttctgagatactcccacggaatcttgtgtgtctccatcacagcactatctcacttcttaaattccatcctctgaatccctgtgctcagcacaggtaaattcttaataaatacttgttaaatgacaatgaagtgcatcacatttttggccc

SEQ ID NO: 64952 - DNA, 601 bp, Human
agcctggatgacagaaagagactctgtctcaaaaaaaaaaaaaaaaaagaaagaaaacagtatgctacgtgcaagaagccagtcacagaagccagtcacagaagaccacatatcgtatgatcccatttatataaaatgtccagaataggcaaatctcagggcacaggaagcaggataagaatctctgagggctggtttcgagtttgcctggaaatgcctagattaagtgaccagttcagacagcgtaggaactcaagatggaaattaaatccacttaaagaacaaaaatgggccgggcccrgtggctcatgcctgtaatcccagcactttgggaggccgaggtaggtgcatcacctaaggtgaggagtttgagaccagcctggccaacatggcgaaaccctgtctctactaaacatacaaaaattagctgggcatggtggcgcatgcctataatcccagctactcagaaggctgacgcaggagaatcgcttgaacccaggaggtggagcttgcagtgagccaaaatcctgccactgccctccagcctgggtgacagagcaagactgtctcaaaaaaaaaaaaaaaaaaaaaaaagaatgac

SEQ ID NO: 64953 - DNA, 601 bp, Human
gaattgggtgtagcagtctacagaggagaaaactaggaagggttgtcatttgccatccaacccgtgaaaggcgagcctgcagaggagggactgagcttatcctgggtagcttgagaggacagggataaatcagttacagaaagtgagattttggctccccactgaggaagaagtttccagtgattagagttgatcatgaatgagctcgctggaaatattcagaggactgttttattgggtggcgagttggattaaatgacttctaacatcctttacaatttttttcttttcttttcttttyttttttttgagatggagttttgctcgttgcccaggctggactacagcggcgcgatcttggctcactgcaatctctgcatcccaggttcaagcgattctcctgcctcagcctcccgagtagctgggattacagacatgcaccaccatgccaggctaattttgtatttttagtagagacggggtttcaccatgttggtcaggctggtcttaaactcctgagcttaggtgatccacctgcctcagcctcccaaagtgctgggattacaggtgtgagccactgtgcctgtggcctcgatccttt

SEQ ID NO: 64954 - DNA, 601 bp, Human
ttggtcttttttttttttttttttggagatggagtttcactcttgttgcccaggacggagtgcagtggtgtgatctcggctcactgcaatctctgcctcccaggttcaagtgattctcctgcctcattctccccaagtagctgggactacaggcgcctgccaccacacctggctaattttttgtatttttagtagagatgaggtttcactatgttggccagcctgctggtcttgaactcctgaccttgtgatccacccgcctcagcctcccaaagtgctgggattacaggcgtgagccacygcacctggcctggtcttgctttattaactagatcataaacttctccagtcaaagggtcatcttttgtgttctacttgtatctacttcctgtatcccaactacctatcccaggatcaggaaatgaggaagctcttggtgatcgactgaccttgtcacctggaaggtaaaacctgactgtcagatgggaaaagtaggtacagggacctcgggtccgaaagctctgggaaaggtggtggcagggaggaatgcagaaacaaagtggggggcggctgatccatgagctcgggctccccatttaaa

SEQ ID NO: 64955 - DNA, 601 bp, Human
gaaacccttattatacttatatgctgaaagttttatgattagctttttctgccacttcatttgatctatttattttgcatttttggtcttttttttttttttttttggagatggagtttcactcttgttgcccaggacggagtgcagtggtgtgatctcggctcactgcaatctctgcctcccaggttcaagtgattctcctgcctcattctccccaagtagctgggactacaggcgcctgccaccacacctggctaattttttgtatttttagtagagatgaggtttcactatgttggcmagcctgctggtcttgaactcctgaccttgtgatccacccgcctcagcctcccaaagtgctgggattacaggcgtgagccaccgcacctggcctggtcttgctttattaactagatcataaacttctccagtcaaagggtcatcttttgtgttctacttgtatctacttcctgtatcccaactacctatcccaggatcaggaaatgaggaagctcttggtgatcgactgaccttgtcacctggaaggtaaaacctgactgtcagatgggaaaagtaggtacagggacctcgggtccgaaag

SEQ ID NO: 64956 - DNA, 601 bp, Human
acaggtgtgagccaccacgtctggcctaaatctctgccgtttaacagctacatgaacaacatctctctgagcctatttcctcatgggtaaaatggggatattcgaatctgtctcacagtgttaaggattagatgagatcatcatacgtgaaaatcattccctgcagctcttcccagatgtcatgtgttaagcaggttcgatatataatgaaactaggaaggcactactgtcctttgctgacaccttcccttcttggttttattcttccatgaagccacaaaaccatttggctattctagtycacaacaatctcttccttttcagaaacccttattatacttatatgctgaaagttttatgattagctttttctgccacttcatttgatctatttattttgcatttttggtcttttttttttttttttttggagatggagtttcactcttgttgcccaggacggagtgcagtggtgtgatctcggctcactgcaatctctgcctcccaggttcaagtgattctcctgcctcattctccccaagtagctgggactacaggcgcctgccaccacacctggctaattttttgtatttttagtaga

SEQ ID NO: 64957 - DNA, 601 bp, Human
tgtactcacctgagcttcctctgtgtccggctcctctgctaacctgtggcagcatgggcagaaacaacacactgaggtcacggccaggtcttctcatgccccagactatctcaaaggggcttccctgaccaacccaccccaggggcttccttgcttctcccgttactcgtttgttgacttttcccacccaggtatgacagcagggtagagtcatactttctactactgtagccaacccgaggcagccatggagacagatgcttctcaggagaaggaaagtcattaaaaaatggaatcaaarctccttaaatccagggagcagttacatgaggggggcaaagcccactcagctctgaaagttccccaagggaacatgactgcgccttgagtgagggcggtccccctcctgcagatggtctgctttgaaaagccctgcgcttgctcacccgaggctcgagcactgcctggcccctcctgagcctgttctgttctctgagggccattgctgtccagccttgcaccagggctctttatggatgcaaactggatttacagcccccacaccgggatggcagggtatgggaggggagactgtgaagga

SEQ ID NO: 64958 - DNA, 601 bp, Human; identical to SEQ ID NO: 18153

SEQ ID NO: 64959 - DNA, 601 bp, Human; identical to SEQ ID NO: 18154

SEQ ID NO: 64960 - DNA, 601 bp, Human; identical to SEQ ID NO: 18155

SEQ ID NO: 64961 - DNA, 601 bp, Human; identical to SEQ ID NO: 18156

SEQ ID NO: 64962 - DNA, 601 bp, Human; identical to SEQ ID NO: 18157

SEQ ID NO: 64963 - DNA, 601 bp, Human; identical to SEQ ID NO: 18158

SEQ ID NO: 64964 - DNA, 601 bp, Human; identical to SEQ ID NO: 18159

SEQ ID NO: 64965 - DNA, 601 bp, Human; identical to SEQ ID NO: 18160

SEQ ID NO: 64966 - DNA, 601 bp, Human; identical to SEQ ID NO: 18161

SEQ ID NO: 64967 - DNA, 601 bp, Human; identical to SEQ ID NO: 18162

SEQ ID NO: 64968 - DNA, 601 bp, Human; identical to SEQ ID NO: 18163

SEQ ID NO: 64969 - DNA, 601 bp, Human; identical to SEQ ID NO: 18164

SEQ ID NO: 64970 - DNA, 601 bp, Human; identical to SEQ ID NO: 18165

SEQ ID NO: 64971 - DNA, 601 bp, Human; identical to SEQ ID NO: 18166

SEQ ID NO: 64972 - DNA, 601 bp, Human; identical to SEQ ID NO: 18167

SEQ ID NO: 64973 - DNA, 601 bp, Human
ataacatgtaaggcattatctcttcattttccactgacactttgcctttgtgtcttcaaccagccacagttctttcttagtttggagaaacccttcagttgacctttctgtccattctaactctatgtttgttttttttttcttcctgcaatacctcaagcatgagtgaaagagcagttgtttctgtttccttattattagtttcctctgtctaattgtataatcattatttccattttccctttgttttacagaaaccatactttagaatcttctcttaataatggttttatgattgctmaatgtactgatcctttctcagtcctctgtctctgtactttatagcacttgacactgtaagctataatcacctctcttctgttgacttcttagtaatatgcctttatgatttttctttttcttctgtatcctgactgattcttctgtagcttttttttttttttttttgagacggagtctcgctctgtcacccaggctggagtgcagtggcgtgatttcggctcactgcaagctctgcctgccgggttcacgccattctcctgcctcagcctcccgagtacctgggactacaggcgcctgc

SEQ ID NO: 64974 - DNA, 601 bp, Human
ttctaaccctctttttagtttttttaattgataaaaaactacagattttacagatttttatttatttatttcattgtagccaagtttagtcattactcattttgaagctcagcttattccacattttatctggcactccttcaagttggctcctgtgtgccttttgttttttagtataatgctggttgttgatatataatttgcatgcaataaagtgcacagattttaagtgtatagtttgatgagttttgacaaatgtatataccccgtgttcctgtttttgatatggtcccatttgtcttttttttttttttttgacacagagtttcgctcttgttgcgcaaattggagtgcagtggcacgatctcggctcactgcagcctccgcctcccaggttcaagcaattctcctgcctcagccttccgagtagctggaattacaggcacatgccaccagtcttggctaattttttttgtatttttagtagagacggggttttgctgtgttagccaggctggtctcgaactcctgtcctcaagtgatccgcctgcctcggcctcccaaagtgctaggattacaggcttaaaccactgtgcccggc

SEQ ID NO: 64975 - DNA, 601 bp, Human
tagccccagctactcaggaggctgaggtgagagaaccacttaaacccaggaggtggaggttgcagtgagccgagattgtgccagtacactccatccagcctgggtgaaagggcaagattcttatctcaaaaaaaaaaaaaggaaaccaagtctgggttcagggagtgctcattcctactggagtgttattgtgtctagtttctattcatgggcacaactagaatatatgtattatttcaatcatttgttgatactgatatttcaaactaaaatttaacatacccaggacttcttttttttwaattttttttaatagtcttaagggagactttgctttatctctttgattgaatatttgtctctctttttcactgcaaactttggtttctactaacattaattaacattaatttataggtttcttatctattttattctattccaaattattttttattctctaacttctcattaccaattcagcatcaaatgttgacttttaaaatcactctttcattcatttcttctttgagaaggtgccaaatgcttgtcaaattaaagaaaagatacagtctctgtccttttaaattcaaggctaacc

SEQ ID NO: 64976 - DNA, 601 bp, Human
ggttgcagtgagccgagattgtgccagtacactccatccagcctgggtgaaagggcaagattcttatctcaaaaaaaaaaaaaggaaaccaagtctgggttcagggagtgctcattcctactggagtgttattgtgtctagtttctattcatgggcacaactagaatatatgtattatttcaatcatttgttgatactgatatttcaaactaaaatttaacatacccaggacttctttttttttaattttttttaatagtcttaagggagactttgctttatctctttgattgaatatttstctctctttttcactgcaaactttggtttctactaacattaattaacattaatttataggtttcttatctattttattctattccaaattattttttattctctaacttctcattaccaattcagcatcaaatgttgacttttaaaatcactctttcattcatttcttctttgagaaggtgccaaatgcttgtcaaattaaagaaaagatacagtctctgtccttttaaattcaaggctaacctttttcaaggagcgcagtgttttgtgtgatgatctctggcactgccttgatgtgtga

SEQ ID NO: 64977 - DNA, 601 bp, Human; identical to SEQ ID NO: 18168

SEQ ID NO: 64978 - DNA, 601 bp, Human; identical to SEQ ID NO: 18169

SEQ ID NO: 64979 - DNA, 601 bp, Human; identical to SEQ ID NO: 18170

SEQ ID NO: 64980 - DNA, 601 bp, Human; identical to SEQ ID NO: 18171

SEQ ID NO: 64981 - DNA, 601 bp, Human; identical to SEQ ID NO: 18172

SEQ ID NO: 64982 - DNA, 601 bp, Human; identical to SEQ ID NO: 18173

SEQ ID NO: 64983 - DNA, 601 bp, Human; identical to SEQ ID NO: 18174

SEQ ID NO: 64984 - DNA, 601 bp, Human; identical to SEQ ID NO: 18175

SEQ ID NO: 64985 - DNA, 601 bp, Human; identical to SEQ ID NO: 18176

SEQ ID NO: 64986 - DNA, 601 bp, Human; identical to SEQ ID NO: 18177

SEQ ID NO: 64987 - DNA, 601 bp, Human
aagttcgaggaatattaaaggtaaatacaataatcttaccagatttgtaaacgtaatataaatatgcttttgaacttactctaaatccaaacattaattttccctcggtttttacaaagaaaaaaaattttaattccactaaaatacctttttaaatgtaacagttccttaccaatcaatgtctgcagttatgcttatgcttaagtgacaccacactgatagaaaaaaccttccttcgcagcaatgtttccccagttttctcacttcaatcaatatttatttattattttattatctctcycactgctatggtaagggagaaaaacaatatatcattgagggacaaaaatataaaagcttcgacgggccagaattagaataagtgaactaaaagtgaggtgaggttccttattgaaatcctatcttcccttttctactgtggcctagatacttaatgtactacaggtattcccctattattaagaatacagacatcacaaaattgctaaaaatgagaagacacatttatagaattctaacattccttttaggtgttttatatatatgacatcacttatccttttaaatttagtaaatgcaa

SEQ ID NO: 64988 - DNA, 601 bp, Human
ctattgacaatgagtttagacaggatgtattaatggccaataagttcgaggaatattaaaggtaaatacaataatcttaccagatttgtaaacgtaatataaatatgcttttgaacttactctaaatccaaacattaattttccctcggtttttacaaagaaaaaaaattttaattccactaaaatacctttttaaatgtaacagttccttaccaatcaatgtctgcagttatgcttatgcttaagtgacaccacactgatagaaaaaaccttccttcgcagcaatgtttccccagttttstcacttcaatcaatatttatttattattttattatctctcccactgctatggtaagggagaaaaacaatatatcattgagggacaaaaatataaaagcttcgacgggccagaattagaataagtgaactaaaagtgaggtgaggttccttattgaaatcctatcttcccttttctactgtggcctagatacttaatgtactacaggtattcccctattattaagaatacagacatcacaaaattgctaaaaatgagaagacacatttatagaattctaacattccttttaggtgttttat

SEQ ID NO: 64989 - DNA, 601 bp, Human
actaaggaatatgtaagcgttgactattttaatccttaaaaaatactctgggaaaagggtgctgatcattcaatgaggaaaagacagtgttttcgataaacggtgttggaaaaattggatatccacatgccaaaaaatgaactggaccctaactttatgacatataccaaaattaactcaaaatggatcaaggacctaaacttaagagctaaaactataaaactcttagatgaaaacatagggagaaatcttcatgacattgaatcttgcaatgatttcttgaatatgacaccaaaagcayaggcaacaaaagtatagataaattggacttcatcaaaatttaaaactcatgcatcaaaggacaccatcaagaaaaagacaacccaaagaatgggacaaagtatttgcaaattaaatattaacatccggcatatataaagaactcctgcaactcaacccaaaaacaaaccactcaattcaaaaatgggcacagaaggcccagcgcagtgactcacacctgtaaccccagcaatttgggatgctgacgtgggagggtcgcttgaagccaggatttagaccagcctgggcaacaaagtgagac

SEQ ID NO: 64990 - DNA, 601 bp, Human
aaaaaaaaaaaaaaaaaaaatcagtgcatggtaaacattatctacaaaagtgatacattcatcaattcaagataaaaaccattggctgggtgtggtggctcacacctgtaatcccagcactttgagaggccgaggcgggcagatcacgaggtcaggagttcgagaccagcctgaccaacatggtgaaaccccgtctctactaaaaatacaaaaattagccatgtgtggtggcgcatacctgtaatcccagctcctcaggaggctgaggcaggagaattgcttgaacctgggaggcagaggytgcagtgagctgagatcatgccactgcactccagcctggatgacagagcaagactccatctcaaaaaaaaaaaaaaaaaaaaaaaaaatcattcacactgtttaatggtggggaggggggagaccagggacaacgaacgacacaatgtatattcttttaactctttagtaacaacaaaactggtactactcataaccactaaaatgtatctgggcataagtaacaatttggagacactgtttaaaaatattaccaaaaagaatatcagagagtgaaatgaattgcaggcagaggtgtaaa

SEQ ID NO: 64991 - DNA, 601 bp, Human
gtaagtaagaagtgaagatcataagatgacctgcccaacaccaaacatcctagttggcggcagggccaccactagaacaggcaattcataaatataatccaagatcagctttctttgaaagagcattagcttctttttaatacactttttactacagtcataatataaaacaaattccatttcatgaactagctaactgtccttcccttcaagataagtgtcttatcttgagcaacaacttgtgtcaatatacacaactggtaagtggataatatgctttctaaagccacagttaaagaatttttttttcttttttcctgcagggtaaaactttaagcaatttatacatgtgctatgtttactaatcggcaggcttaatcacaattggtattattaattacataaaacagctagcattcattgggcacttactgtatgttacgcattcacaaactcatgtcacctcatttaagctttatgactctaaaaaacaacaaattagtaagtttaaattagatcccagaacccaactcttaacagctatgctaaaaagtccaaaacaatgtcctacacagtgcctttcattgttatttccaaatca

SEQ ID NO: 64992 - DNA, 601 bp, Human
caataaatactgctagatcaactatatactcatacaggaaaagaaatgaatctcaacacaccatacacaaaaaccaattccagatgggttgtagatctaaatgtaaaaggtgaaacaaggagggttttaggaaaaaatacaggaagacactttcaaaacctcaaactaagcaatgatttcttatacaaaacacaagaagtactaaaaaaaaaaaaggtttgacagactggactatatttgataaactggaagattaaaaccttttattcatcaaaaaatgtctttaagagactaggaaaargtatttgcaaaacatatcaaacaaaggacttatacttctaatacgtaaagaactcctacaaaacaaggagaagactgaaacccaaaagaaaaagaatgaacccttgaataggtacttgacaaatgagattatccaaacagtcaataaataaagtcaaaaactttctataaagcaggaaagatgttctacttcattagtcatcagggatacccgggaaatgcagattaaaaccaactcagcaaaaatagctacaagaagaattaagtattgtcaagaatgcagagcaactaaacttttata

SEQ ID NO: 64993 - DNA, 601 bp, Human
tcgagaccagcctggccaacatggtgaaacctcgtctctacgaaaaatacaaaaattagctgggcatggtggcaggtgcctgtaatcccagctactggggaggctgaggcaggagaatagcttgaaccctggaggtggaggttgcagtgagctgagatcgtgccactgcactccagcctgggtgacagagggactccgcctcaaaaaaaaaaaaaaaaaagatattaactttaacttgaggtaactttttttaaaattcattctttgatctgccagtgcagtaactttgtaaccagagaamttaaaaactatatatatctcttagtatacaagatttacctatttgtataagcaaatctaataccatgaagtgctacttccaaattttgcttccttcttgaatagctctcaaattaaaaatgctgcattctaactatttatactctgcagtttccacacactatcctttagattcttaagtctttatgttgttatttgaaataacttactcttaaaacctagaatacatgtgataacaaagtcaaatttgattctaaaacaaaatcagtaattagacttttttttttttttaaatacagtg

SEQ ID NO: 64994 - DNA, 601 bp, Human
aagtgtgtttgatgtacgtacctatgcatctaccctgggaagatttcctgagcaggaaaatttcatgaagcctgaaccagtcctgctgattagcattattacattatttttagggcaccatttacaagaaacacaatgtgaatgatactctcaaagctgaaaaacatggtggctctggggttacagcatggaaagatggggtttggatttatgatttcagaatcatgttgtggtttatctgcctaagaaaataactaggctatttcctttagttacaccaatactttttatacttgacccwtaatagtgtatcaaaaaataataagcatgacattattagggaactgaactgtaggtgaagagcagaagagatgagaaagttaaaaacagatcaagtcagcctcctcctaaagccagtgaagagtcattttactcttctaaggaatggaaacatgcaactttatattttagaaaaataacttctgttaccgtatagaagatgaactggaatgggacaaatcagtgacaatggaagagaaagtaaactgagaaaagtaacagccaaaatgaagatttaaaaagcttgatcaaggtggtaaca

SEQ ID NO: 64995 - DNA, 601 bp, Human
cgaaactcttctggatcatttgctcaatcttctttccagccaaaagtgtgtttgatgtacgtacctatgcatctaccctgggaagatttcctgagcaggaaaatttcatgaagcctgaaccagtcctgctgattagcattattacattatttttagggcaccatttacaagaaacacaatgtgaatgatactctcaaagctgaaaaacatggtggctctggggttacagcatggaaagatggggtttggatttatgatttcagaatcatgttgtggtttatctgcctaagaaaataactasgctatttcctttagttacaccaatactttttatacttgacccataatagtgtatcaaaaaataataagcatgacattattagggaactgaactgtaggtgaagagcagaagagatgagaaagttaaaaacagatcaagtcagcctcctcctaaagccagtgaagagtcattttactcttctaaggaatggaaacatgcaactttatattttagaaaaataacttctgttaccgtatagaagatgaactggaatgggacaaatcagtgacaatggaagagaaagtaaactgagaaaagtaa

SEQ ID NO: 64996 - DNA, 601 bp, Human
aaaaaaccaacctaattcatcgaacaaaaccaacgtaatatgaaaaatcagcaagtggagagtcacttgattagataacatctgagaactactactattagttatgtatataagggaatacaagaaaaaattaatcaagtaaatactaaaactatgcataggaatgtaaggtcttatgagctataaactggcaagcaacctgctttctaacaaatcaaacaaaattctcaaaataaaatttaaactaacattttagcacatagctctacgatggtttatttgtcaagtatctatccacatyacttgacgatttagaggcaatacacaggttatgcagagactagccctgaaatggactctaatcccaaactcaagagaatagggttcttacagctctgaagtaacctccaaacttccattctacatttacttgactgactgaatctggaaggccacataagggaagaggaatatgaaacactgtcagaatgtttctctctccgaaactcttctggatcatttgctcaatcttctttccagccaaaagtgtgtttgatgtacgtacctatgcatctaccctgggaagatttcctgagcagga

SEQ ID NO: 64997 - DNA, 601 bp, Human
cttgagtacataaactactgaagcagaatgaaaataacaggcaagaaaaaaaaaaccaacctaattcatcgaacaaaaccaacgtaatatgaaaaatcagcaagtggagagtcacttgattagataacatctgagaactactactattagttatgtatataagggaatacaagaaaaaattaatcaagtaaatactaaaactatgcataggaatgtaaggtcttatgagctataaactggcaagcaacctgctttctaacaaatcaaacaaaattctcaaaataaaatttaaactaacatyttagcacatagctctacgatggtttatttgtcaagtatctatccacatcacttgacgatttagaggcaatacacaggttatgcagagactagccctgaaatggactctaatcccaaactcaagagaatagggttcttacagctctgaagtaacctccaaacttccattctacatttacttgactgactgaatctggaaggccacataagggaagaggaatatgaaacactgtcagaatgtttctctctccgaaactcttctggatcatttgctcaatcttctttccagccaaaagtgtgt

SEQ ID NO: 64998 - DNA, 601 bp, Human
aaaatgatactattaatagggcacaaacaggaatatctggagcctcagtttcctcaaaataaaaggaatttgaaataaatctttcagttttgattctaaaatacggctgctcaaaagctacagttttagaacagttggaaaaaaggattcagcacttctcagattaaaaggaaacaaattttaaaatgaaaaagtataaaaataactaagttctctttctttcatactttcagtacctaataatctcacattatttactcattcatttacatcttgcttcgttccaaaacaagccaggtgyggtgctcatgcctataatcttagcactctgggaggccaaggtgggtggatcacttggggtcaggagttcaagaacagcctggccaacagatggtgaaatcctgtactaaacacaaaaatcagccaggcgtggtggcgcctgcctgtagtcccagtcccagctacctgggaggcagaggtgggagaatcacttgaacccaggaggcagagattacagtgagctaagattgcaccaccgcactccagcctgggcaatagcacaagactctgtctcaaaaaaaaaaaaaaagaaaaaacaagt

SEQ ID NO: 64999 - DNA, 601 bp, Human
acaacaaagcaagaacctgcctcaaaggaagaaaaaattcagatataccttaggtcatcttataaaatgtagtattatctttttaaaagtcatttttaagccaggtgcagtggtgcatgcctgtaatcccagcttctcaggaggctgaggcgggaagattatttgagcccaagagttcaagtcagcccgggcaacacagcgagactccatctcaaaaaaaaataaataaataaaaagtcatttttactaagatcatgaccaccacacttaaaaactccatattcaagaaaagtaaataagwttttacaaacacatcactactataccaggtataaagaataaagcacaaatatcttcagttttagtataaagttgtagaataaacttccagcaaaacttaccatatacatataaaataactgacaaaaccccacaaatattcaaaaatcaatctgtccttcctctttagggtacataaattaaaaagaagaaaatttatcccattaaacattttactcatttcaaactgagtgaataaataccactttaaagaatcacttagacttacctaggatactgaaaatagtattgttactcacaa

SEQ ID NO: 65000 - DNA, 601 bp, Human
gaaccaaggtcgtgccactgtactccagcctggacaacaaagcaagaacctgcctcaaaggaagaaaaaattcagatataccttaggtcatcttataaaatgtagtattatctttttaaaagtcatttttaagccaggtgcagtggtgcatgcctgtaatcccagcttctcaggaggctgaggcgggaagattatttgagcccaagagttcaagtcagcccgggcaacacagcgagactccatctcaaaaaaaaataaataaataaaaagtcatttttactaagatcatgaccaccacacktaaaaactccatattcaagaaaagtaaataagattttacaaacacatcactactataccaggtataaagaataaagcacaaatatcttcagttttagtataaagttgtagaataaacttccagcaaaacttaccatatacatataaaataactgacaaaaccccacaaatattcaaaaatcaatctgtccttcctctttagggtacataaattaaaaagaagaaaatttatcccattaaacattttactcatttcaaactgagtgaataaataccactttaaagaatcacttagacttac

SEQ ID NO: 65001 - DNA, 601 bp, Human
aggcacatgctgccacgcccggctaattttttttttttttttttttttttaaatttagtagagacagggtttcactgtgttgcccagggtggtctcgaacttctgagctcaggcaatcctcctgcctcagcctcccaaagtgctgggattacaggtgtgagccaccgcgcccagcaattaaattctttatagagaatgttgaaagggtattaagagttacaattacaatgggacagactatcattggaaattttattaaaatcatagtttttcactgaggaaaatctctaaagtgatattmtttctgatattcctgtatccattctatttcctagaatattaaaagaaaaaatagtattgggaatcagctcctaaaacaatactatgtgcctcattttttttttaagcttgactctatatttaataactcccctcagcacgataaaaactaaaagttttactcattgatcctttgtcatacattggatttttgaaatttgctccatttctaaaaacacaatattctaggtgctgtctactttaaaatattgcacctatctcttttttgagacaaggtctcattatgttacctaggctggtc

SEQ ID NO: 65002 - DNA, 601 bp, Human
gtggtgccatctcagctcactgcaacctccacctctcaggttcaagcaagtctcctgcctcagcctcctgaggaggggggactacaggcacatgctgccacgcccggctaattttttttttttttttttttttttaaatttagtagagacagggtttcactgtgttgcccagggtggtctcgaacttctgagctcaggcaatcctcctgcctcagcctcccaaagtgctgggattacaggtgtgagccaccgcgcccagcaattaaattctttatagagaatgttgaaagggtattaagakttacaattacaatgggacagactatcattggaaattttattaaaatcatagtttttcactgaggaaaatctctaaagtgatattctttctgatattcctgtatccattctatttcctagaatattaaaagaaaaaatagtattgggaatcagctcctaaaacaatactatgtgcctcattttttttttaagcttgactctatatttaataactcccctcagcacgataaaaactaaaagttttactcattgatcctttgtcatacattggatttttgaaatttgctccatttctaaaaac

SEQ ID NO: 65003 - DNA, 601 bp, Human
tttttttttttttttttttaagagatggagtcttgctctgttgcccaggctggggtgcagtggtgccatctcagctcactgcaacctccacctctcaggttcaagcaagtctcctgcctcagcctcctgaggaggggggactacaggcacatgctgccacgcccggctaattttttttttttttttttttttttaaatttagtagagacagggtttcactgtgttgcccagggtggtctcgaacttctgagctcaggcaatcctcctgcctcagcctcccaaagtgctgggattacaggtrtgagccaccgcgcccagcaattaaattctttatagagaatgttgaaagggtattaagagttacaattacaatgggacagactatcattggaaattttattaaaatcatagtttttcactgaggaaaatctctaaagtgatattctttctgatattcctgtatccattctatttcctagaatattaaaagaaaaaatagtattgggaatcagctcctaaaacaatactatgtgcctcattttttttttaagcttgactctatatttaataactcccctcagcacgataaaaactaaaagtt

SEQ ID NO: 65004 - DNA, 601 bp, Human
taaatcgttttttgccttttagactcttattctcttcacaagtatccaggggagttttccaggggctatatgatgtgtgacaggaaagctgactgaatgcagaagcagatatgagaaggaaaggacactataaggctcgtaaacagagaagcctgggcaacatagtaagaccctgtccccacacaaaaataaaacattagccgagtgtggtggcacacgcctgtagtctcagctactcgtgaggctgaggctggaggatcacttgagcccaggagtttgaggttgcagtaagccataactrtgcctctgcactgcagcatgggtgacagaacaaaaccctgtctcaaaaaaaaaaaaaaaaaaatcataaaattctgaatcaatgctcttcttaccaaattggtttttcttttagaaaatatgcttatttctaatttaaaaatattcattaacatgtgttcattatttacaaatattttttatatttcccacttttaacttataaatggcaaatatcagataaatatagcccacataaacaaaagttctttttggccttcaatagtatttaataatataaagaggtcctgagatcaaaaag

SEQ ID NO: 65005 - DNA, 601 bp, Human
acaggtgctagatgagcagagaagcaaggaggggagtagagtgagacaaggtcaatctttatattacttcattttaaaatatcttctgtttttagttcatttgagttggattaaaaaagctgaaaaataaacagacagaaatgttacaaaaatagctgatacggtgaatggccagtttagaaaagtctatttttattatagtgataaaaatcttttcacatgcacctcatttcctaagaagcagaagcccctataattttctcatttttgtatttttataaaattgtaattaaaaattctrtattaaaataaagcaatccatataaagagcatattttagcaaaaacatctacttccaattaagatggcaatggcaagcttttcatgctgcaacacaaaaaatccattgacaacaacaaacagccaaagtatagattataatctgtgcgtgatgcctataagagccaaaaccagacaagtggaaggggtattctagtctgtcaaaccttaaaagtctaaccttcaaagttgtaatagcatgaaaggttgtctaagatttctgtccacattggagattcaacagcattaccttagcttctgt

SEQ ID NO: 65006 - DNA, 601 bp, Human
tgcaccaacaatggcgagaacatgggaagggtgagagcagacaggtgctagatgagcagagaagcaaggaggggagtagagtgagacaaggtcaatctttatattacttcattttaaaatatcttctgtttttagttcatttgagttggattaaaaaagctgaaaaataaacagacagaaatgttacaaaaatagctgatacggtgaatggccagtttagaaaagtctatttttattatagtgataaaaatcttttcacatgcacctcatttcctaagaagcagaagcccctataattttctcatttttgtatttttataaaattgtaattaaaaattctgtattaaaataaagcaatccatataaagagcatattttagcaaaaacatctacttccaattaagatggcaatggcaagcttttcatgctgcaacacaaaaaatccattgacaacaacaaacagccaaagtatagattataatctgtgcgtgatgcctataagagccaaaaccagacaagtggaaggggtattctagtctgtcaaaccttaaaagtctaaccttcaaagttgtaatagcatgaaaggttgtctaagatttct

SEQ ID NO: 65007 - DNA, 601 bp, Human
atcttgcaccaacaatggcgagaacatgggaagggtgagagcagacaggtgctagatgagcagagaagcaaggaggggagtagagtgagacaaggtcaatctttatattacttcattttaaaatatcttctgtttttagttcatttgagttggattaaaaaagctgaaaaataaacagacagaaatgttacaaaaatagctgatacggtgaatggccagtttagaaaagtctatttttattatagtgataaaaatcttttcacatgcacctcatttcctaagaagcagaagcccctataattttctcatttttgtatttttataaaattgtaattaaaaattctgtattaaaataaagcaatccatataaagagcatattttagcaaaaacatctacttccaattaagatggcaatggcaagcttttcatgctgcaacacaaaaaatccattgacaacaacaaacagccaaagtatagattataatctgtgcgtgatgcctataagagccaaaaccagacaagtggaaggggtattctagtctgtcaaaccttaaaagtctaaccttcaaagttgtaatagcatgaaaggttgtctaagat

SEQ ID NO: 65008 - DNA, 601 bp, Human
tatctataccagcaaaactcataaaggtcatcagtacatgtctggtctaaaatataacatagctgggtcaacatcattcatgagagacctgaaagctttccactgaaatcccaatcacacaatcctagaaatgtttttcccaccctaagaaaactcacttctagtaccttaaaagaactcccctttggtccaaagacaccatgttagaaagctcacaaggtagcaagatgataaaaaggcagtttcatataaaagaatgtggataagagtaagaaattcaggttttaagagccactagaaggggaactggcattatctctatcacaagtaaattttgtgctgataaacactgagagcattattgatcattgtattacttgggaaacacaaaacacaaagctattagattaagcaaaagaaaacaaaaacaaatattaaaaattaaacttctagcagatgtgatacagaagacacaaatctgcatactgtttcacaggttgataactctcaacttgccaatgtgtattttctgtaaaaaagaagaaattcaacattccaacatggattgtcatcccaaacgtaaagctcttttattcattct

SEQ ID NO: 65009 - DNA, 601 bp, Human
gaaagaaacctacttgcaaaatactgaatgtatgtttgtgtagaaagatttctgtgtacatttatatatttaattttcgtattttacattgattctattctaaatggcagtatctataccagcaaaactcataaaggtcatcagtacatgtctggtctaaaatataacatagctgggtcaacatcattcatgagagacctgaaagctttccactgaaatcccaatcacacaatcctagaaatgtttttcccaccctaagaaaactcacttctagtaccttaaaagaactcccctttggtcmaaagacaccatgttagaaagctcacaaggtagcaagatgataaaaaggcagtttcatataaaagaatgtggataagagtaagaaattcaggttttaagagccactagaaggggaactggcattatctctatcacaagtaaattttgtgctgataaacactgagagcattattgatcattgtattacttgggaaacacaaaacacaaagctattagattaagcaaaagaaaacaaaaacaaatattaaaaattaaacttctagcagatgtgatacagaagacacaaatctgcatactgttt

SEQ ID NO: 65010 - DNA, 601 bp, Human
taccaacaaatctagaaaacaaattctctgcaggagagtttgaaaactatgttctaattgagaaatgtactgacaacttacagtttatcattagataatgtattcttagggcaaaaatgccttgaaagaaacctacttgcaaaatactgaatgtatgtttgtgtagaaagatttctgtgtacatttatatatttaattttcgtattttacattgattctattctaaatggcagtatctataccagcaaaactcataaaggtcatcagtacatgtctggtctaaaatataacatagctgggwcaacatcattcatgagagacctgaaagctttccactgaaatcccaatcacacaatcctagaaatgtttttcccaccctaagaaaactcacttctagtaccttaaaagaactcccctttggtccaaagacaccatgttagaaagctcacaaggtagcaagatgataaaaaggcagtttcatataaaagaatgtggataagagtaagaaattcaggttttaagagccactagaaggggaactggcattatctctatcacaagtaaattttgtgctgataaacactgagagcattattgatca

SEQ ID NO: 65011 - DNA, 601 bp, Human
tactcaacatcaccagttggatatctgacatgcatatcagatctgacatgtccagcacaggatcccctcttgtcccaacctccttcacctccataaacagcagctccattgtccctggacccatatgccaaaaaccatggttctgtcttgattcttctcattcactcatatcccacaccccaattcatcaacaactcctgtggcttcacctgcaaaatacatcacaacctgaccacttcccgccactcccagccccgactcccatcctggtccaagccgccatcatctttggcttggattrttgcagaagcttcctcagtcatcctccctcctgtctattctgcactcagcagccagggtgagacttccacagtataaggtagattacgtcactcctttgcttcaagggctcctcagtgcaaaagccaaagtcatagcagtggccagagatcctgcttgttgtagctcctcccttccctgtccctaccgccacttttctgacttcgtctcccatccttctttccctccctcaaagcattcaagctcctctggcttccatgatgctccttgaacatgctaagtgcattcctgcctatttgca

SEQ ID NO: 65012 - DNA, 601 bp, Human
atgtcttgggactcaagcctttggaaagaaagaggagaagaaacagctccatgctggctagcagcacagactttaggctcaaacaggcctgtaggtgcatgctggctctggcactcactagctgggtgacagtgcacagggcatgtcacctctttgggactcagtttcctcatttctaattcatcgctccagggagttactatgagatttacatgaaatgaaataagatcacacttgcaccacttggttcgcagcaggtaaacagtagccttctttagcagatgaatccagaagcatgtakgaattccatctctaggggactctccaggtctgtccctgccccacacatcctcacaaggatgacttaaggatgaaggcagggaccaggcagcggtcagtgccctcagtggctcttctctcccttttccctttcctgcttgctctttttgtgacttatggcagaccattagctctctgtacatagagctacatggagatggctctgttcatgcagatggctatgttgtcccgtttgtgtttccctacaatgtagtgcttgccaagaccaagaactgagttttggtgtggtgtggtgactcac

SEQ ID NO: 65013 - DNA, 601 bp, Human
aagcaggagtttgagaccagccttggcaatacagcaagactctgactctataaaaaaatttaaaacttagcagggcatggtggtatgttcctgggttccagctacttgggaggctgaggtgggaggaccgtttgagccctggagttcaaggttgccaggagccatgattgtgccactgcattccagcctgggtgacagagtgagaccctgtctctaaaataaaaaaataatgaagaagaaaatcccattggcctctaccttctgtatgccacctactgcatgctccgagcttcagcagccytattgtgactatgagctgaaggccaagagagctgtggcaatactgacccagcaccctgactttgtcaagctgctaaatcatcccaggaaaggcccatctccagaattcttgtcagtgagataacggtttattgcttgagtcaatgtgagttgggctgtctgttacttgcagccaaaacatcctgatggacacaatctccaaagcaaacacagccaaagcccactgtggagtatttcccactccatgggtttgatgacccatacattgtcctgccctttgacatatctggattctgggagc

SEQ ID NO: 65014 - DNA, 601 bp, Human
cccataggaccactgcacctggagtctgactcagaacttgggcaactgatcctccatgctaaccaggggatctcagcctgtttcttcatccacaaatggggttcaatcccctttctaggacccagtgaaatagttcacataaaatacccagcctcacatgcagaggaagcttaatgaggctgcttcctttcaaaaggggagacctactagttctgggcatcttgttacacagagggaggctgaagggagcattttatcccctagaagaggatatttaaaaatagtcttttctgcctaggaytcaaaaagtatggccctcttctctcccccttttcccccgatcccagccaggacctcctcatcccttgcctcctaggagcagctgagcagcggtcagcctgtctgtcgtgggccaggcaggtcctgccaagggtccaggagaacagggtctcaacgcaggtgaggctggctgtagccccgccctgcagctctgggtctgggggcagggtgggctggtgaaggaaggaggcagagaggggaagcaggtggagggagaagccaggtgtccctaagctaggagagatggcggcagaggacgtgg

SEQ ID NO: 65015 - DNA, 601 bp, Human
ccagaccactctgctgctctacagggcccacagtcccggggagacaacactggtgggggctgtggggcactcacctccttgatgaagttcatgaagcggccgccaaagcgccaggccttgtgccgatggcactgcagggagttcacggtcatctgtggtgcccgctggtagcacacggacacgatatggacggcgtcgtacagtaaggctgcatcagtctgcagggaagggcctgcctgagagcggctcccaaggccctccagtcctcagcccaccctgccctgtcccccttctcctcccytgccacaggtacatgatgtcctggtgagcgaacaggcccagaggccctggaggtgactctgtctacgcctctgaggagtggccaggcttggctgactctgctgctctacaaacatcctgagcacccccctctgcagcttagaccttctcctgcccacccaccccacccctgctacctaggccctgaccacaccttcttctttctgccttctcggccttcacacctgtgtgtcacagcctgagttcctctgtgacctgcatctctgggccttattcctgttctttgtgaccttttgcttac

SEQ ID NO: 65016 - DNA, 601 bp, Human
ctctccagctcgcccaaggtcatacagcgaggaagcaaacaccctcatctgttgtactttcaagcccacgctgcatcttgctggcaatgctgaccagctgctgagcacttaccacatgcccaagatgtatgcccctcaatcatgccataagtttggtcctatggagcccattttcacacgggaaactgaggctcggagacatgaggcaacttgcctgaggtcacatggatgagaatcaatccttcctgactcccagaccactctgctgctctacagggcccacagtcccggggagacaacmctggtgggggctgtggggcactcacctccttgatgaagttcatgaagcggccgccaaagcgccaggccttgtgccgatggcactgcagggagttcacggtcatctgtggtgcccgctggtagcacacggacacgatatggacggcgtcgtacagtaaggctgcatcagtctgcagggaagggcctgcctgagagcggctcccaaggccctccagtcctcagcccaccctgccctgtcccccttctcctcccttgccacaggtacatgatgtcctggtgagcgaacaggcccagaggccct

SEQ ID NO: 65017 - DNA, 601 bp, Human
ccttgatagaaaatgcttcagtcaagttgagggccctgagctggaaggcaggtcatgtttattgtgtgccaggtaagcctgtggaaatggtgccttatttaattcccccaacaaccacaggagctacggtagttgctaatgactcctattttaggcagggcatggtggctcatgcctgtaatctcagcactttgggaggccaaggcaggaggattacttgaatccaggagtttgagaacagtctggacaacaaagtgagaccctgctctccaccaaaaaaaaaaaaaaaaaaaaaaaaaawttagccaggtggagtgcctcgtgcctgtagccccagctactcaggagactaaggcaggtggctcacttgagcccaggagtttgaggctacagtgagctgtgatggcaccactgcactccaccttgggtgattctgtctctaacaacagcaacaattactcctattttagaaataaagaaattgagccttagtgagattgatgaacttacccggtcacacaacaaaactgaggcttgaacccagacctgctgggccacagcctgggcgtctgagaactatgatgtgtttgctcacagcatc

SEQ ID NO: 65018 - DNA, 601 bp, Human
tcaggtccttgaattcagcagcagctccttgatagaaaatgcttcagtcaagttgagggccctgagctggaaggcaggtcatgtttattgtgtgccaggtaagcctgtggaaatggtgccttatttaattcccccaacaaccacaggagctacggtagttgctaatgactcctattttaggcagggcatggtggctcatgcctgtaatctcagcactttgggaggccaaggcaggaggattacttgaatccaggagtttgagaacagtctggacaacaaagtgagaccctgctctccaccaaaaaaaaaaaaaaaaaaaaaaaaaaattagccaggtggagtgcctcgtgcctgtagccccagctactcaggagactaaggcaggtggctcacttgagcccaggagtttgaggctacagtgagctgtgatggcaccactgcactccaccttgggtgattctgtctctaacaacagcaacaattactcctattttagaaataaagaaattgagccttagtgagattgatgaacttacccggtcacacaacaaaactgaggcttgaacccagacctgctgggccacagcctgggcgtctgaga

SEQ ID NO: 65019 - DNA, 601 bp, Human
ggtgctcccggctgggagcagctgggaaatacaactttgacactgcctacccaatgtttctccttctaaaggcagcccccacaccccatcactgacacttggagtccaaggatttgatgaccttcagaacctgggaaagatagggaggaggagcctattagaaatggtctttcttttgtaaatgtctgaatgtgtgagttggaatttgcctggctgaaggcagaaggaggaatggggcaagctgccgccaccccagctcctggagtcctttcagttcagggtatatacaaaagaaagcagaaaaaaaaaaaaaaactctcagggagggtgtagagtggtgagcaagagaccgagtccctggtatcatggagcttccagttagtgagcccctgctggggctgtagataggatcccttggtggggtgggagcctgagtgagataccctgaaaggttcctttcagtcctcaagttctaggattctctgtaatgttgacgtgagagagatgtagaaggtctttgattccagaacttggcgtccccaagtcctgtcccttcaaagtccagtcatgtgctgcctaactctcttggtcaacagtggac

SEQ ID NO: 65020 - DNA, 601 bp, Human
atggctgtgagtttactgggcactgttccccctgctgttgtggcttggatagacacaccctgttttccaagttctaagccacccactgggccacccaatgtcctgagtctgctgcaccaggtgcctagctcatgtggtgccactttgggcaaccacttgacctctacgagcctgccaatgggacctgaggtgcaactgcttcatctcagagttatagacacagacgagggtgaggaccaggtgattcaagcgtgggggtggggagggccaaggcatggaatgttccttgagggatacaaargaatctgagccatagggagtggaagaggagtgggtacagcagtggcctgagccttgggctttctgtgccaggggctgaggagatgaggacctgcctaacccctagaccttcaaccttgggcccgatgtctggccaaggaattgccttacctggcgatgacgaagaggacacagctgacccccaggtaggcgaggagaacatacatccagatgtctggggacaggggattgaggaaggagaagacgctggggttggtgccattgggctttcgatacaggatgctcacaccaagtgtcatga

SEQ ID NO: 65021 - DNA, 601 bp, Human
aatttgaactttatatctggtctgggtttgaagcccaactctgtcaaagaaaagctttctgattctgggcaatgacttaacctctccaagcctcagtttctgtttctataaactggggataattatacccacctcaagagaggtgtgagtggtggtgtgagggtgttgggcgaggtgacaagtgcactctgatgctcttcctagctcggcggccaaaactcttgtccctctcctctcttctcaggggtctcctatcattacagcagctctaggaaacccatctcttctagaaagtctcccagcctaaccttgggaaggaggctcccaccttccgagcctggaggcagggtgggaagaaggcttgctagtgaagggccaggaatgagagggggatgggacacacatcaaaagggcagagcggatgccagaaaagcccgagaaggtgggagctgagagacccctggagccgctaaaatcatgctgcgagctctggagagtggctcctggctttcaaaggcttgttagaccattagagacaagaggcataaatgaaggcctctctgtggcaggctcagcggctgctgcgcccaccaggcagggt

SEQ ID NO: 65022 - DNA, 601 bp, Human
ctgtcaccgaacaaagacgatggacaaaaaaacaaggtgaggctccaggacactcattaatagcaaggacagattgaggcacttcccttgaaagctgcctgtcacttcctagctgctagagaccactggggctctgtgtcccctccccaactggccactcccagcctccccaggttgctccaaaccaggctttgggctgctcttagagggagagcagcttatttgagtcacttgattgctgagttctgccagccttgccagacctctgcccaagtccctgccctggcctctgccatggccragaggtttctcgcatgtgggacagatttgcttttttcctctcctccttcattcaagtgcccagcacagagcctggcatgtagtgggtgcccaggacacattgggataatgccatttgctcattcatttggtgtttactgatggatatctactgaggaccagggtttgtgaaggttatacacagatgactgagggacaaggacattttctctgtccctggaagccccttccctgcctgccccctaagcaggtccctcagtgaaactctaacagcaaaaacttgtctgcactccctaagata

SEQ ID NO: 65023 - DNA, 601 bp, Human
gggaggcagggacatccaatcagcggcaatgagcctgcaccaggcttatttatgccgtttcactttgatcgggagccctgcttagagatgggttcatgcgttatgcatgagagatgctctggcacaaagggctgggccacagcctggggataggcaggagcaggcaggcatgtgtgcacatacacacacatacacatgcagacacatatgcatgtacagttcattatacacacacacacccagagacacattcatatgcatgcatggaccattatacacatacatagaccccccccccccmcacacagagacacatatgcatgcatgggccattatacacacatacatccagacatatatacatgcatggatcattatacatgcacacacagatacatatgtatgcacaggccattatacacacacacactcagattcatgcatgcataggccattacacaggcatacacacacaaaggcgagtatacacacacatgcctgcacaggccattacacacacacaggtccatctgccctccacttatctagacatacccatgaggatatccaagcagacagacaaatgtattttctctgtacc

SEQ ID NO: 65024 - DNA, 601 bp, Human
agagccccccgagagcccagcatcccgcttcctgctgttgtcgtctttggacagaaacaggttccctcccttgtgagttctactctcagtcagggcgtttttttaagactgtgtgcttcctaatcaggaacatgctaaccacagaaatcaagttcatctgtcctgcactctggaccttcaatacaggctgcccactcagttcctagtcctcgatattatctcctgcacttgtgccacttggctgccgccatctttaaatcccatcctttcactcaataacagtatccactcaacacgtatyattagagcaactacgacgtgccagggctgtgcagggctgggtatgtggtcaactgactgtggcttcacttttccccaactgcctcctgaggactgtggctgggtccttagagaagccatatgaacacagtgaccaagagcataggcactagagccaggttgcttgggttcaaatcccagctctgcatttcactagctgtgggatgttaggcaagtcagttagcctctctgggccttcctttcgtcatgtttcaaatggagatgataataacaatctacgttccagggctgttattgagga

SEQ ID NO: 65025 - DNA, 601 bp, Human
gcttcagcctcctgactagctgggactacagacgcgagacaccatgcccagctaatttttgtattttttgtagagatggggtttcaccatgttggccaggctggtctcaaactcctgacctcaggtgatccacccacctcggcctcctaaagtgctgagattacagtcatgaaccaccgtgcccaacccggcccccagttcttaacaatgacactgttttacctttcacagtgctataaggaaatgaacacacacagacacacacacacccctaggctgaactccctgaacacaccgtttrctctgaaatttggctcttttagctcatgagcttgctattgctcaggtctcttatagctacttctttgggaatggattgcagaggtttatttgtcacattatcaattggtcttactaccctctcatcatatgtcatttgtactctaaatactattatttagaggagtgatagacttattctaggtggatagacttagctttgaatattttttctattgttaactggctgttgcgacatcaggcaagtcagcattctcatctgaaaatggggatggatatatcttcttcacatgatttttat

SEQ ID NO: 65026 - DNA, 601 bp, Human
tcctttgaactcggtttctttttttttttttttttttttttttgagacggagtctcactctgtcgcccaggctggagtgcaatggcatgatcttggctcactgcaagctccgcctcctgggttcatgccattctcctgcctcagcctcccgagtagctgggactacaggtgcctgccaccacgcctggctaattttttgtatttttagtagagacggggtttcaccgtgttaggatggtctcaatctcctgaccttgtgatctgcccgcctcggcctcccaaagtgctgggattacaggcrtgagccactgtgcccggcctgaactcggtttctttatttgcaaagtggggatgataaagcatatctcatagggatctgtagattccatataggtggaagcaaccaaccttggattgaaaatatttgggaaaaaaagaaaaataacaatacaacaataaaaaagcaaataatacagtacaatgactgtttacatagcatctacattgtattaggtattataagtagtttagagatgatttaaagtgtacaggaggatgtgtgtaggttatatgcaaatatgaccccattttatatcaggga

SEQ ID NO: 65027 - DNA, 601 bp, Human
gacaaagattacaagactagcagtgcaccaacaaccctaccttttgacatagcaaaatccaagaccagctgcagcaccaaagaagaggagagcaagcactagcagagccgtggggacacctgcaaggaacagagacaaggcctgttggtccttcacttaaacattgtgtgtaatgctcattgcatgatccaggtgattgagacagtagacagtacaggagaaaaaccttctctgtagccctttatgatattgggcccacaccagcttctttgcttcatgcttgtagaatcattggccttgsttctcacactctcaattctatcagttgcaatatgacagagttcatttctcctccatggccttgagacctactctagtcaacaagcctgcctgagaaagagatgactagaataaagtcataggcctttagggtatatattttaaaaagaacttatgcataggaacagatagtgatttatttttaaaagtcttgagttttcaacagtgaaattcttttatacttacactttttagcttaatcactaaggttctttacagctctcagattctatgacttcatgaaagttgagtttgtgttaag

SEQ ID NO: 65028 - DNA, 601 bp, Human
tctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctg

SEQ ID NO: 65029 - DNA, 601 bp, Human
acctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgcygtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtg

SEQ ID NO: 65030 - DNA, 601 bp, Human
gctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtsattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtccta

SEQ ID NO: 65031 - DNA, 601 bp, Human
ttgttcaggtggaagctagagccggtgaaaattgggctcttacagctaacgtgagcctctttgtaccctcaggtttacaaggcacttcagaggatgctgcactgtccgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagaraaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggc

SEQ ID NO: 65032 - DNA, 601 bp, Human
ctctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccggtaattaaagtcaagctgcctgggtttgaatttagcctcaaccacttccttagctatgtcacccactgcacattacttttctgtgcttaaattctttatctgttactggaaatactaatagttttcccaggagtattgcragaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacgtttctatgagcctttcctgtaccttctggaactccctggctgcttggtcatcctcctcttcttaaaggacagac

SEQ ID NO: 65033 - DNA, 601 bp, Human
gaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccastagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgc

SEQ ID NO: 65034 - DNA, 601 bp, Human
gggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcrcctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctcccc

SEQ ID NO: 65035 - DNA, 601 bp, Human
accacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctrctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttataga

SEQ ID NO: 65036 - DNA, 601 bp, Human
gggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctccccyggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctcctt

SEQ ID NO: 65037 - DNA, 601 bp, Human
ccaccaccaaggccaccttcacccggctccactccctctcaccctctgcttctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaagrccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaa

SEQ ID NO: 65038 - DNA, 601 bp, Human
tctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacttactggcttaggggcttcagggcctcaggctcagaagccayactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctg

SEQ ID NO: 65039 - DNA, 601 bp, Human
gactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctcyttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacttactggcttaggggcttcagggcctcaggctcagaagccacacta

SEQ ID NO: 65040 - DNA, 601 bp, Human
atacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcayacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggc

SEQ ID NO: 65041 - DNA, 601 bp, Human
agaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttakagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctga

SEQ ID NO: 65042 - DNA, 601 bp, Human
aggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctrttcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggt

SEQ ID NO: 65043 - DNA, 601 bp, Human
gttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagttggccaagagggagtgacaagaagtcagcacgtgcttgtggctgaaaccaagactggctgacctgtcctcatgatcccaragctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaa

SEQ ID NO: 65044 - DNA, 601 bp, Human
cagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctrtcatcccctataggaattctgaggagctccctggtaaataggagctgtgtctccatttggaaacctagagttggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggc

SEQ ID NO: 65045 - DNA, 601 bp, Human
tgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgayatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaa

SEQ ID NO: 65046 - DNA, 601 bp, Human
cattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacaccccygaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctatt

SEQ ID NO: 65047 - DNA, 601 bp, Human
gttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagsgacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgcc

SEQ ID NO: 65048 - DNA, 601 bp, Human
ctggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccayaccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgg

SEQ ID NO: 65049 - DNA, 601 bp, Human
tatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttstttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgccca

SEQ ID NO: 65050 - DNA, 601 bp, Human
ctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggrcttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttcc

SEQ ID NO: 65051 - DNA, 601 bp, Human
ttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgmatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcgg

SEQ ID NO: 65052 - DNA, 601 bp, Human
caagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggaragccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcg

SEQ ID NO: 65053 - DNA, 601 bp, Human
caactataagagtaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagasttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagaga

SEQ ID NO: 65054 - DNA, 601 bp, Human
tgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatccttgggcctcagtttcctcaactataagagyaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaa

SEQ ID NO: 65055 - DNA, 601 bp, Human
ttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctsctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttg

SEQ ID NO: 65056 - DNA, 601 bp, Human
aaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctcyagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccc

SEQ ID NO: 65057 - DNA, 522 bp, Human
tgtggtggggtccgggggatgggggagggatagcattagtagatatccctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaaccccttgtataatatactacsatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaa

SEQ ID NO: 65058 - DNA, 413 bp, Human
ggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcartgttagacctaaaacctaaaaaccctagaagaaaacctaggcaataccattcaggacataggcatgggcaaggacttcatgtgtaaaacaccaaaagcaatggcaacaaaag

SEQ ID NO: 65059 - DNA, 601 bp, Human
ttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactamatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggata

SEQ ID NO: 65060 - DNA, 601 bp, Human
tcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatga

SEQ ID NO: 65061 - DNA, 601 bp, Human
taccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcmggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaaga

SEQ ID NO: 65062 - DNA, 601 bp, Human
ctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccratctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgag

SEQ ID NO: 65063 - DNA, 601 bp, Human
aacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggargactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagcc

SEQ ID NO: 65064 - DNA, 601 bp, Human
ttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggca

SEQ ID NO: 65065 - DNA, 601 bp, Human
acatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgcyaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattg

SEQ ID NO: 65066 - DNA, 601 bp, Human
gactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtacyggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatctt

SEQ ID NO: 65067 - DNA, 601 bp, Human
accacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtayaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgatt

SEQ ID NO: 65068 - DNA, 601 bp, Human
actgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacraagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaat

SEQ ID NO: 65069 - DNA, 601 bp, Human
acaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcrtctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacag

SEQ ID NO: 65070 - DNA, 601 bp, Human
gtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagycatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgac

SEQ ID NO: 65071 - DNA, 601 bp, Human
gaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagrgagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccac

SEQ ID NO: 65072 - DNA, 601 bp, Human
tggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagarcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgt

SEQ ID NO: 65073 - DNA, 601 bp, Human
actgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcayttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacac

SEQ ID NO: 65074 - DNA, 601 bp, Human
acaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattstattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggc

SEQ ID NO: 65075 - DNA, 601 bp, Human
caggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttktaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaa

SEQ ID NO: 65076 - DNA, 601 bp, Human
cattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagargagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaa

SEQ ID NO: 65077 - DNA, 601 bp, Human
tggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagawgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaag

SEQ ID NO: 65078 - DNA, 601 bp, Human
accaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggttyacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagct

SEQ ID NO: 65079 - DNA, 601 bp, Human
taagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttrtctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctca

SEQ ID NO: 65080 - DNA, 601 bp, Human
attgccttaattataccgtcacatgggaaagacttttaatctgttaaataaagctcactgtttttttacatgtttaacacacctgttgccagcagtcttgggatagtgctgaggtgcacccctacttcctcctccgcccgaagaagcactatttaaaagaaaaaaattgtttactgtatcccaactatgtctcactcaaaaagaataaagcatctattttgtgttttgctttgcttgtagagatgggggtctcgctattttgcccagactggagccaggcctgtattttagtgcttgtatattatgctacaaatgaagactgaactcggacccaaaggaaaggcaaataattgattttatttattcttcagatggcagttcttagaaggctgtcaatgaaaacttaagaacttttcaaatgaaaattgcagcccattaagtcggacttatttgctgtgttaactactttttgagactggccttttcaaaaggattccccaaaataaatctacaagtacctgaaacgagaagcacccccttctgcaatcgcactctccactttggcggcttgacaacgaagaatcttcaaaagaataatatt

SEQ ID NO: 65081 - DNA, 601 bp, Human
gttgagtgcgtactactttactaataacaatcagtaggaataatagctactgatttcagaaaaacacattagtaaaaataacccaaagaataaggaaaaaaataacagcttgagagtctcaactcacttagaaaatttggctaaggaataatcaggaactgatattctgtatttaggatacccaacagaaaccacgccccttaagattaggagtcttgatggctattgccttaattataccgtcacatgggaaagacttttaatctgttaaataaagctcactgtttttttacatgtttamcacacctgttgccagcagtcttgggatagtgctgaggtgcacccctacttcctcctccgcccgaagaagcactatttaaaagaaaaaaattgtttactgtatcccaactatgtctcactcaaaaagaataaagcatctattttgtgttttgctttgcttgtagagatgggggtctcgctattttgcccagactggagccaggcctgtattttagtgcttgtatattatgctacaaatgaagactgaactcggacccaaaggaaaggcaaataattgattttatttattcttcagatggca

SEQ ID NO: 65082 - DNA, 601 bp, Human
cataaattctcttacatagaaaaaagtaatttaggctttctcgacttcccctccaagaaagccaactctggaaattagtgcttctggaacagtagtgtgcatcagaatcacctgaagggcttgttaatacagattgctgggcccacccagtttctgctttcactggtttggggtggggcctaagaatttgcatgtctagtaaatattcccagtatcaacgctgtggaaccacattttgaaaattaacattttttttaagagatggggtcttgctgtcttgcccaggctgatctcaaactcytgggttcaagcgaccctcccacctttgcctcccaaagttgttgttgggattacaggtgtgagccactgtaccggctgccaataaacactttctaatgttttattgaccatgttgagtgcgtactactttactaataacaatcagtaggaataatagctactgatttcagaaaaacacattagtaaaaataacccaaagaataaggaaaaaaataacagcttgagagtctcaactcacttagaaaatttggctaaggaataatcaggaactgatattctgtatttaggatacccaacagaa

SEQ ID NO: 65083 - DNA, 601 bp, Human
ttgccttcttagtaatacagcacacacaccaaacacagctaatccacacctcccatcttttagtaaaacagaccttgaaacttaccctcttactttcctgaagattgcatcatgtcgttctttttcgtttgcggagttgtttgctgcggagttgtcatctcgtctagtgcttcgtgcaggaatccatttctgagcgttttgccctggggttttccccaggaactcgctgattaataaaaatcagcaaaaacacttattgtcacacaccaaatgttaaacatcataaattctcttacatagwaaaaagtaatttaggctttctcgacttcccctccaagaaagccaactctggaaattagtgcttctggaacagtagtgtgcatcagaatcacctgaagggcttgttaatacagattgctgggcccacccagtttctgctttcactggtttggggtggggcctaagaatttgcatgtctagtaaatattcccagtatcaacgctgtggaaccacattttgaaaattaacattttttttaagagatggggtcttgctgtcttgcccaggctgatctcaaactcctgggttcaagcgaccctcc

SEQ ID NO: 65084 - DNA, 601 bp, Human
gcctctctagtagctgggactacaggtgcctgccactacgtccggctaatttttgtatttttagtagagatggggtttcaacatgttggccaggctggtctcaaactcctgacctcaagtgatctgcccacctcggcctcccaaagtgctgggattacaggcgtgagccacagtgcctggccagttcaagatatttttaaaaattgctaccatgaggattcattaaaacatacatactctgggcatgaaccttgccttcttagtaatacagcacacacaccaaacacagctaatccacacytcccatcttttagtaaaacagaccttgaaacttaccctcttactttcctgaagattgcatcatgtcgttctttttcgtttgcggagttgtttgctgcggagttgtcatctcgtctagtgcttcgtgcaggaatccatttctgagcgttttgccctggggttttccccaggaactcgctgattaataaaaatcagcaaaaacacttattgtcacacaccaaatgttaaacatcataaattctcttacatagaaaaaagtaatttaggctttctcgacttcccctccaagaaagccaactct

SEQ ID NO: 65085 - DNA, 601 bp, Human
cctaaatgttagctattacagtctaccaaaaatgtccagttatacagatttcatctagtcacatccatctcctgggagtcagaaaatgccatggatatcaaaactttcaagtctacataaactgtcatacaatgcatttccaagacctaaatacggtgttttccacaaaagaaaaagaacagcttgctaagcactcccatttacctcttcaaccataccatgaacttaacatttacctcttcaatctaatgctactaaagtcagtggttctttttaatcaccatcagtattcaaaaatacrtacctatctaactcacacctaagggttttaagtagtaatccaagtgtaaaaaaacacaacttgagtttgttaaacagttccctctcccttttgagttaagccaatatttaaaacttaccagcagtatgacccctttaaggatgagtttagactctacacccacattgaggagctcaaggcatagcttgtcaaacttttcaggagtaagcttatttagtatgctggagaaaaaggaattacattttaagtgttagctaatacacagaatttgaattgaaaaactgcttttaaattatactg

SEQ ID NO: 65086 - DNA, 601 bp, Human
tctgctgctgggccatcaaagtttggtgcatcttctgccaatcgcagacatagctgagcatacagtgagctatactttggctcttctagggctttgtccacaatctacagaaaatgtcattgcttaaactaaatatgaaaacttctccaagaacccttcctttaggaaaaatacaaccacctaaatgttagctattacagtctaccaaaaatgtccagttatacagatttcatctagtcacatccatctcctgggagtcagaaaatgccatggatatcaaaactttcaagtctacataaaytgtcatacaatgcatttccaagacctaaatacggtgttttccacaaaagaaaaagaacagcttgctaagcactcccatttacctcttcaaccataccatgaacttaacatttacctcttcaatctaatgctactaaagtcagtggttctttttaatcaccatcagtattcaaaaatacgtacctatctaactcacacctaagggttttaagtagtaatccaagtgtaaaaaaacacaacttgagtttgttaaacagttccctctcccttttgagttaagccaatatttaaaacttaccag

SEQ ID NO: 65087 - DNA, 601 bp, Human
aagtggaagacgagacactaaaaacattaagctccaccactaagatgagacagacccctcaagcgtttggggtgggtgaggaggaaacccattctattctacacacacaaagtctatgtgacaaacaaaacaaaacccaatcttacttttactgcatcttgacgaatttgattgatcgtctttggtccattgtcaagaaaagccttgcgaggaacccaatggtgttctcgcaactctacggtatcctttaattgaaaaataattttattttaatattcctaaaccaaaaactcagcttacyaacaaatttaaagaaaccagtattacctgcagcaggaaacgaatccttgctggcaattccttacttaacatcaaggagcacattcgggcaaagtactgatccattaaggactgataagagaagaatacattcattggaagagctaaagcaaatgtgttcaatttacagctttaagacttctaaaattataacccagttaatggctaaatatggcaatcccttatgatgtcacaaaaatcaatagcttgatttaaagacaaactacttgtactactttcatcagctacacacgtaccttgg

SEQ ID NO: 65088 - DNA, 601 bp, Human
aaaaggagaaagaaagtctagataaaaaggggtccacaaattatggtaatcaagtaccaaagggatgagccaagccataaagttagtttaactgaatttgcccagagaaagtaaaagatgaaacagggaagaataaaaatctaacctatcaaataaagtgatgtgattttactaatactttactaatcttaaggataaacatttcagtttgaaataaatgttgcagataaggtttagaaaacatgcacactcctaaaatagtttcatgttttaatagcaaatgaaatcacatatattgcakaatttaacatttgttgcctaaacactcaaatattacttacctggcttttcataaacttgcctcccatctctccaaactgcgattgtgtgggaggcatgatgtgtcccccatggccattgaagagttgatttgaacgatgacgtcccatggtgggtgaaaatctatcctggataactcctggaccagtaccaattccgctaccttaaaatacatatacggacaactctcaaaactaaagttaactgatttttcagcttaatgcaaccattgttttttcaaaattacctggcatttgtccaa

SEQ ID NO: 65089 - DNA, 601 bp, Human
caggtttaatttttggcaaaaaatttaaagatctgatgcatacagtagtaagatactattataaatcttacattctcttagaattagcatgactaaaatattcaaataaaaaactgcaaatttaactacagtttagaaaatgccctgttttatccttagttaaatcacccttacaaagaaagaaaccacaatattttgacaaccagttttcttgctctaacagactttaggagacttgccctcatatctcataatcttcgctcacaggacgctggacattcaaagaaagaaaaagaagtayagaaaagagagaaaaacgtcaagaactccagcataaagtcctcttaataacgcgtctttttataatcatcgggcaataaatttctgaatggacaaactatggtatataagtaacataggcaaatgtacctcatctgcattaagctgtcctttcttagaaaaccgaggtggcatatccttcgactgtccttgcagctgggataagagtccctgactctggttatggtagagctggcttagcccctatttcagaaaaggagaaagaaagtctagataaaaaggggtccacaaattatggtaa

SEQ ID NO: 65090 - DNA, 601 bp, Human
ctcaccttttgggaagttgctgttatagcagtgcacctggagagcatacagggcactgacttgtagatcaacgtgatcatgaagaaatttctgcattactggcttgaaagatagtagtagttgtttttcctgctctaactgttctttggaaggagcagaggatgaatctgtttcatcgctgggggggtttacttcactagaaatgtactgtaagaagctggacagaaagaggtcttgttagaacccaacagtgagttttcttgctcaagagacaactcttagtctcctacgcttcttttcyagtacatgaaacattaccatatgcagaaaaccattcgtcttacctagtcattaagatgttcacaaatcctttatctacatgaagtttgggagagatgttatctttaatccatttatatatggtttgaggggatggatccaactttatttgcttcaacagttccttctccaatttgaggagtgggaataagaaactcagtccctttccttccaaaatctccaacatgcggtccttattctgatcaatttctgaagagacaaagccacctgcatcatctaatagttcattttaccaagttgt

SEQ ID NO: 65091 - DNA, 601 bp, Human; identical to SEQ ID NO: 35583

SEQ ID NO: 65092 - DNA, 601 bp, Human; identical to SEQ ID NO: 35584

SEQ ID NO: 65093 - DNA, 601 bp, Human; identical to SEQ ID NO: 35585

SEQ ID NO: 65094 - DNA, 601 bp, Human
ccataatgctgcatacccctcaaatatttaataagtgctagatgattaaatgacagatctgaatggttttctaacattttgtgactgcctagttctgtagttttaatataaaatgcagaatagtttaaaacttatgcaaaaaaataaataaaagagtgtacaaatcgaaaaggacaagttttctcttgatagtcaaacagttatgaaataaagcagtctcattaaatcataagtactttaaccttttcttgaaagaagagaaagatttaaagattcatgaagaaattttgcctaaactagkaaatgactcatatttgacatgtattgaaatgataatgctgatttcagtaggcactctaagagcattttatccccaagggagtaattcagtcatggttaccgctctgcatttagattttaaactttctttgtgaagcttttaatgtactactgcctgccaaaacatggcacagtttcacagataacacaaaataaaggcaagtaaagataattttttttgtcattgttgatacaaaaatatgcaacaaacatatctatttggcatcttctgcaaagatggcactgtctttaaaagtttcta

SEQ ID NO: 65095 - DNA, 601 bp, Human
gggcatttacactatttgctatgcatttatggaatgttcttatcaattctctttgcccagttggatcctatgcattcttttgaataaatcttactatcagttgaactgtgtcccatcaaaagtcatactgaagccctaaccctatgtgcctgtgactctgaccttatttgggtagtgtctttttggatgtaattgttaagatgagtcctaccgaattaggaagaatcctaatccagtacaactgatgtccttataagaagagaagacacacacgatcagaggagaggaccatatgataatkcagacagaggctggagtgatgtagctacaagctaaggagcatcaaggattgctgccagctctgtttctcatgcagtgggtggtggctacactgggcactcctcttttcttttctgggttcccggccttgctgtgggcagacaaaccccaggaggtagcacaatcacatactctggtgtctgtgcaaacaccagatgctggaagagacaaggaaggattctagaggtttcagaaagagcatggcccttctaacaacttgatttcagctttctagcctccagaactcttcaacaatgaatta

SEQ ID NO: 65096 - DNA, 601 bp, Human
atgggtcttgaattttgccccaaatccctagctatgtcacatgacttccatctctccttcctctcctccttccttcttttcttgctctcttctgtccttccctctttctttcccttcctcccaccccaggttgataacaattgaacactaagtataagcaaaactgaaccaattatttctttgtccttctagaacacactgtttgacttttttcagaagtatgtcatgtaatcattagagagcagaatgaaattgctgtctaacataagacattacatatatttatatatacatatttgtraatactaataatttttcacagttgttgttaaataattctaaaattagctaatctattaaagcttttcattcttggaaaagttgtcttaatttttttaatgttaattactctgtctttggcttatgtggatatttaaacttgccttgaacatatgcccttattatgcatccaggacactacagctgcatagaatacttttgaatgttgcactttagagaaagaaatgccaagggaaacagtaaggaaaaataaaactactcaagtccatgtttaaataaagtcataatctccattccacta

SEQ ID NO: 65097 - DNA, 601 bp, Human
gatggaacttttctgcaactcggctgtggtggataaaattttaataaaatcatatggatctaaacatatacacataggaatatatgaaaaatgggaaatgtgaataatattggttatattaatgtccatatcctggtcgtaatattgtaccatagttataaaagatgttactgatgagaacaaatgagtaaagggtacatgggacttctgtattatttctcacaagtgcctgtgaacctacaattatctcaggaaaaagtttaattaaaaataaacaaataggtggatatgtttatgccayagattatggtgatactttcatgggcatatatttatctttagactcattaagttgcatacatgcaacatggacagacttttctatgtcaatcagacctcaataaagtggttttaaaaatatgcaaaccaacaagcactacctatactagacctctccaagttcggtactccccagttttcaaagtgtatggggtcttgtgtttctttaatatttataaatgcatcttgccacctaccttgttctcagattgttgcaggtatttcagaggattaaattataatggtcactagttttctcaat

SEQ ID NO: 65098 - DNA, 601 bp, Human
cttgctatatgggttcaagggtaacaggaagatgacaggattcctgaacctgaaggaaatcaaaagaatttacctaatttgaacaaataagaaaagagagattaaaaggaaaaaaaaaaacttgaagagagcttcaagaaccagtgagttaaaaacaaaagagttaacatttgtataactggaatcctagaataagaggagagaatggcagtgaaaatgtattcaagaaagaatgtctgaaaatactgaaaatatggcaaaagacattaacaaacacatgcaagaagctgagcaaatctcrtacaataggataaaaccaaggaaactcatgctagggctttcactattaaactgctaaatacaaaacaagcaaagagaaaaccttgaaagcagccagaggaatgatgtaaaacttataagtaaataccagttcaaatgacaacagatttctcatctgaaaaattagaagccagaaggagtggcacaacatttatcaagtaatgaaagcaattaactgtcaatcataaattttatatccagcaaaaatatcctttcggaatgaaggaaaaatcaagacactctcagatgagtgaaaaataag

SEQ ID NO: 65099 - DNA, 601 bp, Human
cacccctaccctgcagcaacaaagtagtgtgaacaagcaatgaatttttcccttccgtggctcagtggggagttaggaatatgtcaccatgaggggcaacaaggcagcagcaataggcggcccgctttcactgggaaggggtcaacagggaagctgaagtttcaccctacccatctgctgcagtgtgagtcagtgctccacttctgctggatgatgttggcagtgacaacggggtgatgaatgaacatacacacccacctggcctctgtgcacacctcaatgtaaggacagcttctgaataaaaaagaagatgaatttggatccagagtctcatactacgatacccaaaacatccaggatataataaaaatcacttgtcatactaagaaccatcaaaataacaacttgaatgaaagaagaagatcaacagatgccatcagtgatatgaatcatatgttggaattatcaggcaaggattttaaaccagatacaataaaaatgcatcaacaagcaattgtgaattctttcaagcaagaaaaaaaatgagagaaaccccagcatagaaatagaagttatatatatatatatataaaagatccaa

SEQ ID NO: 65100 - DNA, 601 bp, Human
tctagtttttattttaaaatatagccatgcatttctactaatgctcaggtatcaggtgaacaaaataatagtgacttacatttacatcttgcttctgaactgtcagtacatttactagctgtcagtaaaagagaaaaataaaaaaaactgactgtcagttttaagacagtaagaaagagaaagtatgccagtaaatgtagagaaaataattttgaaaaatattttacctacttcagcatgagtttttgtcctgtgtgaaatgtataactacataatttgaattgtttgatatcttaaaacsatagattctaggaaatatggaaatgtgtgaggaaaacgtgtttgctttaaaatcatgatttccaagctaggtttaggctgatgcaaacaaaactgccattcacctagtcaaataaagggattccaaagctttgcagagttatttgtatagagcaggagatttaggctcagattattagatctatatgtcccttaaatttcccacccagcatcttaaaaattgaacataactgaaaagttgacaatacaataccataatgatgaatgaatccataccataattgcacctcttcttgaacat

SEQ ID NO: 65101 - DNA, 601 bp, Human
cttcagtacaaataccaatcacatcctaatgaggaaagtatgctatttctaaatgtaatgcaatcttgcctcaaacacatttttatttacagaggacagtttttctatacatcttcccttcagaaccattggaaataatctagtttttattttaaaatatagccatgcatttctactaatgctcaggtatcaggtgaacaaaataatagtgacttacatttacatcttgcttctgaactgtcagtacatttactagctgtcagtaaaagagaaaaataaaaaaaactgactgtcagttttaagacagtaagaaagagaaagtatgccagtaaatgtagagaaaataattttgaaaaatattttacctacttcagcatgagtttttgtcctgtgtgaaatgtataactacataatttgaattgtttgatatcttaaaacgatagattctaggaaatatggaaatgtgtgaggaaaacgtgtttgctttaaaatcatgatttccaagctaggtttaggctgatgcaaacaaaactgccattcacctagtcaaataaagggattccaaagctttgcagagttatttgtatagagcaggagattt

SEQ ID NO: 65102 - DNA, 601 bp, Human
catgaacaagttacatggctatttaaagttataaagcaacagacttccatacatttcacttcacgagtttaagtataaccattattttctcaaatgaattgaatgttcatgtaagacaagagcatctgtccaaaatgtgtcttcagattgagaagggaataaaacaagtaaatgtcagggaataataccttttctaaaaattgggattgttttaacggctgtccttcagtgctcactttaaagcaatacttaaggatcttctctttccagatttcctcttttgctggaaacccatgaattrcatatgttttggtgatgctgcttttcagttgttgctgctagtaaccaactaactttactgtttttgttgtttggtaggtttttttaaagaaaaatttccactctttgtatatgaatattatgacttggaaggaaaattacaaatacataagggaattccaagactcggaagatgaatttttgttgtgaacacagtgaacaagaaaacatatcacttttaacataaaagcagctttctacacatgccataaggcatttgcactggtccttgttctcagtgagacccaaatgcaaatgcagt

SEQ ID NO: 65103 - DNA, 601 bp, Human
atatagactttgctttaatacagtacattgtctcaagttgggccaaactgctttacaaattaatgaggtatatatcggcggtgtagtgatttcagtaggcaaacacagaatctattaagtactcaataataccctttatagatcctcaaacgttaaaatctattttatagcaacacttccaaaatgtgtcacagggtttttaatgctctgtgccaccagagacagaaatgaagacccttattttaacatttaacctgaaaggacacctccatctgccctccctctctctgcccttcccccrttattacactgtctgaattaggtatgaggcaaaattctggtgtgggaattctactcaaatatctagttgaatagcgtcaggctctcctgaccttctaaccctctcttttgtccaaacctcctgagaatcaagcatgtgtcacacaataactagcttccccttgaatagcattattggagaagagaaaaaaagtccttgcccaggacttgactatattctgccatgaacaagttacatggctatttaaagttataaagcaacagacttccatacatttcacttcacgagtttaagtataac

SEQ ID NO: 65104 - DNA, 601 bp, Human
caatgacttctcacttgcaatgcctaaatctgtttttactaagctacaaagtgatggacctcaaggacaatgacattttggcaataaaaacaaactatcagatgcattttcaacaatttagtttccattttctatttccacaatttactgtgatatagctgatctgatgaaaaaagaaacaactcttcaatatagatcaaatgtttctgtgtgaaatatttcacgcaagttaaactatccaagaccaatattgtcacatttagataattttcttcagatgctgaacgttttgtaattattrgccatgaaaatttgggatatagactttgctttaatacagtacattgtctcaagttgggccaaactgctttacaaattaatgaggtatatatcggcggtgtagtgatttcagtaggcaaacacagaatctattaagtactcaataataccctttatagatcctcaaacgttaaaatctattttatagcaacacttccaaaatgtgtcacagggtttttaatgctctgtgccaccagagacagaaatgaagacccttattttaacatttaacctgaaaggacacctccatctgccctccctc

SEQ ID NO: 65105 - DNA, 601 bp, Human
gatcacaaggtcaggagatcgagaccatcctggctaacacagtgaaaccccgtctctactaaaaatacaaaaaattagcctggcgtggtgacgggcacctgtagtcccagccactcgggaggctgaggcaggataatggagcgaacccgggaggcggagcttgccgtgagctgagatcacgccactgcaatccagcctgggcgacagagtgagactccgtctcaatgagaaaaaaataataataatagtaatttctgacttcgtttatactcttgcagctttcagtgaagagcttaagcaccaactccaccatttagcttctcaaactctaagaactttatcacagaacaacttgaaaactcttgacagatcatgaaggtgattttaagtaagataggaggaattacttcaagaacataatttaattactttgtatgaagcagaaaacaataaaagagataaagaatccagaatgtgtgaactttatacatctttgaagtaataggatataatttggaaaatagaaaagtgaagaaataggctgaacactggaaatacttctgaaacttaccaacttgataaataaattggttacaaggaa

SEQ ID NO: 65106 - DNA, 601 bp, Human
tcatttggttccctttgattattgaactgtatcctcagctttattccggtttctatcatctgacagtaaaattccttcagggtttcatcttactacgctcttgcataaaacctactcttggcaaacttgaccagtcactgtttgccatcatcacaagaatattttcacctttctgcctttctacatcctagtcccaaacctggaattcttctctccccatctctgcctcttgaaacctcatgttctaggttaaattttttataatccaagaagcactatcataatgagaagaaatcacaaytttcagcagctcctatttattattccataaatgttacagtcattagtgtttatgtcttatctctttcactaaattcctttggaccaagagcctagttaactggttttgtcacttctaaaacctccacacagtacagtcctgtacatagtgttctactagtgaaataaattaaattgcacaacaattatgaataacacaaaacaataaatagaagttattaaaaagaatagtcatttcaggccgggtgcagtggctcatgcctgtaatcccagcactttgggaggctaaggcaggcggatc

SEQ ID NO: 65107 - DNA, 601 bp, Human
ttcacagtaatagcatcttcaaccagctgctaatgtctaatcagattaaaactgtaaatctctttctccagcaaaaaaaaaaagcagaaaaccagttaacaaattgtaagaagtatatacaagtgctacttaagtgctttattcatgatgcacttgagatctcaaaatttcactgttccattagacttttaaactaccaggaatcagtgtctaagtcatttataccatcagaacagctggatgacagcaagttgtcaacagatttcccaaggatttctctgaggaactagagacttacaayggggagaaagtgtcattccatctgaatccaaccattacatcaattgacctgaaagctagaaaggttctatttctctaaggaaaagaaaacaattgaaaagcttgagtatccaatcaaacaaattacatttgcgaccctccccagagggctacaccacttaggccctaagcagagtttagttggaatatatattttaaaggacaagtttatcaaagaatactacaagggaacagaaaacaaaataaataagacaaatgtaattgaaccaaagagccatgtatgtgtaaactcccaaactta

SEQ ID NO: 65108 - DNA, 601 bp, Human
caacttatgctgagatcacaggacttctgatgttttcttagaacaagatgtagggatgaagagatataaggtagctgagtctttactgtcagatctcagtttacatattgacacctcagagagcccccgaatacccacacaagccttaataatcactcacaaactttgttatagtgtactattttaattctctaggtattatttttctctcaatatgtttcttatttgtttgagttttttttcttccctcacccacccctcaccaggcacacatgtatgcacccaaacaaataacatcagytctaatcaattcactgcattcgtctcaacatctactaatagaacaaagcccatttgactagaagactcatttcttttggcaactttaccagaattctttatatttttataattttttttctccatctgttttcattttctgaaactttttgtaggtggacattggatctgtctgcagatgtgtttctattcaccctagattggatttgataattgtggggcaaaggcaggtatgcaatacaacttattttttagccatggggactccactacatcctagtcccattcacctgccttcctg

SEQ ID NO: 65109 - DNA, 601 bp, Human
accttgtgaaccaatctctgctagcttccaacttttcttttgtagcttgctcacttctctcagccttcacataatggaatagttagggccttgtctggattagactttggtttaagagaatattgtagctggtctgatcttctatccagaccactcaaattttctccacatcagcaataaagctgtttcagtttttatcatttttgtggtcattagagtagcactttaattttccctcaagaaattttcctttgcattcaacttggctgtttggcgcaagaggactagctttcaacctgtmaactttctacatgccttcctcactaagcttactcatttctagcttttgatttcaagtgagagaaatgttactcttcctttcacttgaacactgagaggccactgtagggttattactcggtctaatttaatttcaatattgttgtgtctcagggaacagggaggcccaaggagaaggaacaagtcagaagaacattctgtcggtggagaagtcataacacacacaacatttattggttaactttgccatatcatattggtgtggttcatggcaccccctgaaattataataacatcaaaa

SEQ ID NO: 65110 - DNA, 601 bp, Human
gttatggaaactacttctttccttaaaccttgtgaaccaatctctgctagcttccaacttttcttttgtagcttgctcacttctctcagccttcacataatggaatagttagggccttgtctggattagactttggtttaagagaatattgtagctggtctgatcttctatccagaccactcaaattttctccacatcagcaataaagctgtttcagtttttatcatttttgtggtcattagagtagcactttaattttccctcaagaaattttcctttgcattcaacttggctgtttggygcaagaggactagctttcaacctgtcaactttctacatgccttcctcactaagcttactcatttctagcttttgatttcaagtgagagaaatgttactcttcctttcacttgaacactgagaggccactgtagggttattactcggtctaatttaatttcaatattgttgtgtctcagggaacagggaggcccaaggagaaggaacaagtcagaagaacattctgtcggtggagaagtcataacacacacaacatttattggttaactttgccatatcatattggtgtggttcatggcac

SEQ ID NO: 65111 - DNA, 601 bp, Human
cacttttatgttatggaaactacttctttccttaaaccttgtgaaccaatctctgctagcttccaacttttcttttgtagcttgctcacttctctcagccttcacataatggaatagttagggccttgtctggattagactttggtttaagagaatattgtagctggtctgatcttctatccagaccactcaaattttctccacatcagcaataaagctgtttcagtttttatcatttttgtggtcattagagtagcactttaattttccctcaagaaattttcctttgcattcaacttgkctgtttggcgcaagaggactagctttcaacctgtcaactttctacatgccttcctcactaagcttactcatttctagcttttgatttcaagtgagagaaatgttactcttcctttcacttgaacactgagaggccactgtagggttattactcggtctaatttaatttcaatattgttgtgtctcagggaacagggaggcccaaggagaaggaacaagtcagaagaacattctgtcggtggagaagtcataacacacacaacatttattggttaactttgccatatcatattggtgtggt

SEQ ID NO: 65112 - DNA, 601 bp, Human
agtattatttacggcagggtgcggtggctcacgcctgtaatcccagcactttgagaggccaaggtgggtggatcacctgaggccaggagttcgagaccagcctggccaacatggtgaaaccccatctctactaaaaatacaaaagttaggcgtggtggtgcacatctgtaatcccagctactcaggaggctgaggcaggagaatcacttgaacccaggagacagaggttgcagagagccgagattgcaccactgcactccagcctgggcgacaagagcgaaactccctgtcaaaaaaaaawaataataaaataataatattattattatttactgatatagtttagtaatttttttcaatatatagcatatatgttatcttcttaaactacatggccaatttttagtgtgcgaaaatataaaccacatagtccagttaattatatgttaatattatttctcagttttcatctaatactgtacagtcctactttaacaatgctgtacattaaaatccagccccatgcccaagaaagagaaaatatagtttatatacaggcattgtgcttagcacttcatccattcattcatttaacaaataa

SEQ ID NO: 65113 - DNA, 601 bp, Human
aagacatacgtaaaaagctactcaaactcattaatggccaaataattctgagtcagcattcaacaatatttttcacttagaggaatgtcaagggtgaaaaaaaagtggataatttgtaaggatagttagtgtttaaggaaacaagtacttggctatatattttaatgaggttataaattttcacaacctttctggaggtagcccattgttatgcattagagcaatctctgtaatatgtattaaaatataaaatgaccatatacttcaacccagccattcaacttctatggatttatttttwggaaataattataataacattaataatagtattatttacggcagggtgcggtggctcacgcctgtaatcccagcactttgagaggccaaggtgggtggatcacctgaggccaggagttcgagaccagcctggccaacatggtgaaaccccatctctactaaaaatacaaaagttaggcgtggtggtgcacatctgtaatcccagctactcaggaggctgaggcaggagaatcacttgaacccaggagacagaggttgcagagagccgagattgcaccactgcactccagcctgggcgaca

SEQ ID NO: 65114 - DNA, 601 bp, Human
tgcaaatgatcaagacatacgtaaaaagctactcaaactcattaatggccaaataattctgagtcagcattcaacaatatttttcacttagaggaatgtcaagggtgaaaaaaaagtggataatttgtaaggatagttagtgtttaaggaaacaagtacttggctatatattttaatgaggttataaattttcacaacctttctggaggtagcccattgttatgcattagagcaatctctgtaatatgtattaaaatataaaatgaccatatacttcaacccagccattcaacttctatgratttatttttaggaaataattataataacattaataatagtattatttacggcagggtgcggtggctcacgcctgtaatcccagcactttgagaggccaaggtgggtggatcacctgaggccaggagttcgagaccagcctggccaacatggtgaaaccccatctctactaaaaatacaaaagttaggcgtggtggtgcacatctgtaatcccagctactcaggaggctgaggcaggagaatcacttgaacccaggagacagaggttgcagagagccgagattgcaccactgcactccag

SEQ ID NO: 65115 - DNA, 601 bp, Human
aaaactcatcaagctataccttttatatttatgcactatcttgcatacatgttttattttgcttaaatattaaaggattactttaaaatatctagaccacaaagttcataagccatcaaaaaactgaagaaaacttatacaacataatattcttaacataaatgagtttttataaataaataaggaattatagagtataaatatggacacattgtatgaataaggaattcataaatgaaatgcaaatgatcaagacatacgtaaaaagctactcaaactcattaatggccaaataattctragtcagcattcaacaatatttttcacttagaggaatgtcaagggtgaaaaaaaagtggataatttgtaaggatagttagtgtttaaggaaacaagtacttggctatatattttaatgaggttataaattttcacaacctttctggaggtagcccattgttatgcattagagcaatctctgtaatatgtattaaaatataaaatgaccatatacttcaacccagccattcaacttctatggatttatttttaggaaataattataataacattaataatagtattatttacggcagggtgc

SEQ ID NO: 65116 - DNA, 601 bp, Human
tatggaaaaatctcattggcatagtgctaagcaaaaagaacacaaaagagtacctacttcatgattttatttgtatgatagtttgagaacaggcaacattaatctatggttatagagggctacattgatgctattctgtttttatctttacagtggatgttcattaggggactctgagattctggaaatattctacgactttttttaaatgagagttacacaggtgtatataaatattaaaaactcatcaagctataccttttatatttatgcactatcttgcatacatgttttattttgyttaaatattaaaggattactttaaaatatctagaccacaaagttcataagccatcaaaaaactgaagaaaacttatacaacataatattcttaacataaatgagtttttataaataaataaggaattatagagtataaatatggacacattgtatgaataaggaattcataaatgaaatgcaaatgatcaagacatacgtaaaaagctactcaaactcattaatggccaaataattctgagtcagcattcaacaatatttttcacttagaggaatgtcaagggtgaaaaaaaagtggata

SEQ ID NO: 65117 - DNA, 601 bp, Human
tctggcaaaactaacagttgataaggatgtggaacaactgaaatcctcaaatgttgcttgttgggacacccactttggaaaactttacagaattatttgctaaagctaaagatataactgcatacactatggaaaaatctcattggcatagtgctaagcaaaaagaacacaaaagagtacctacttcatgattttatttgtatgatagtttgagaacaggcaacattaatctatggttatagagggctacattgatgctattctgtttttatctttacagtggatgttcattaggggactytgagattctggaaatattctacgactttttttaaatgagagttacacaggtgtatataaatattaaaaactcatcaagctataccttttatatttatgcactatcttgcatacatgttttattttgcttaaatattaaaggattactttaaaatatctagaccacaaagttcataagccatcaaaaaactgaagaaaacttatacaacataatattcttaacataaatgagtttttataaataaataaggaattatagagtataaatatggacacattgtatgaataaggaattcataaa

SEQ ID NO: 65118 - DNA, 601 bp, Human
taatacggtcttcatattttctcttttgattggtacaacaatcatatggaaatatagtgttatccctatcttattgtttcacaataagaaaattgatgttcaaagagtttaaaaatagttaccacttaatgcacatttactatacaacaagcaacttatattctaaacatacatcatctcacataattcttataagattcctatgaattatatattaaaccaccatttaatagattagaaaccagacttaaagagagttaatattttgatcaaagaagcacacctgggttatatttaaacyagagcttggcaatttaaccacagtgttttgaatatcaaaaatatataccttcttttttaaaactagacattggtctaataactcaggtcatacagaaaaacaaaataacattttatattatttcagaattaataagtgcatcagacaaaaatatctacaggagatatttatggcatgtccattatatacatttattacaaacattcaaaaagagttgagttcctgatatgtgcaaatgataggattgtgtacctatcataataatgagtttggcaaggtcactaaacataggtaaatata

SEQ ID NO: 65119 - DNA, 601 bp, Human
cacatgagtttagcttgatctaagagcatacacaaactaaagtaatacggtcttcatattttctcttttgattggtacaacaatcatatggaaatatagtgttatccctatcttattgtttcacaataagaaaattgatgttcaaagagtttaaaaatagttaccacttaatgcacatttactatacaacaagcaacttatattctaaacatacatcatctcacataattcttataagattcctatgaattatatattaaaccaccatttaatagattagaaaccagacttaaagagagtkaatattttgatcaaagaagcacacctgggttatatttaaaccagagcttggcaatttaaccacagtgttttgaatatcaaaaatatataccttcttttttaaaactagacattggtctaataactcaggtcatacagaaaaacaaaataacattttatattatttcagaattaataagtgcatcagacaaaaatatctacaggagatatttatggcatgtccattatatacatttattacaaacattcaaaaagagttgagttcctgatatgtgcaaatgataggattgtgtacctatca

SEQ ID NO: 65120 - DNA, 601 bp, Human
ttttctaatcaggagtgaaatttatttctacacagtttaaaaatatcatcttcagttcacactgttcttttgaagcattaatccaacatttagtatactgaagtagaatagaagcaagccattttaaccctgcagtgcataggggactaatttatggcgctatcaaatactttgagcaacatttggtgcaataaaacacttttagaagtactaatggggattaaatattgaaataaggctcacaagatttaatgtgttatttaaaaattcttcacgcagagtattttataagattatgcawtatactaattactcaaaccaagttcctaaatatataagttccttaaaatattgcttcttcacatgagtttagcttgatctaagagcatacacaaactaaagtaatacggtcttcatattttctcttttgattggtacaacaatcatatggaaatatagtgttatccctatcttattgtttcacaataagaaaattgatgttcaaagagtttaaaaatagttaccacttaatgcacatttactatacaacaagcaacttatattctaaacatacatcatctcacataattcttataagatt

SEQ ID NO: 65121 - DNA, 601 bp, Human
agtaggtacgactgtacatataaattgatagaataaagataaaaattatttaaaatatccttttccttctgtagctctcagatgtcaagaacataaaggagaaagttgtaatgaaaactaaataatatttgaaataaaccggtttcctgttacatgttttctaatcaggagtgaaatttatttctacacagtttaaaaatatcatcttcagttcacactgttcttttgaagcattaatccaacatttagtatactgaagtagaatagaagcaagccattttaaccctgcagtgcatagggkactaatttatggcgctatcaaatactttgagcaacatttggtgcaataaaacacttttagaagtactaatggggattaaatattgaaataaggctcacaagatttaatgtgttatttaaaaattcttcacgcagagtattttataagattatgcattatactaattactcaaaccaagttcctaaatatataagttccttaaaatattgcttcttcacatgagtttagcttgatctaagagcatacacaaactaaagtaatacggtcttcatattttctcttttgattggtacaacaatc

SEQ ID NO: 65122 - DNA, 601 bp, Human
ttagaaatgtgaacccatgggaaactggtagaaattagaagtagcattccaactttagaatcaagtacaagcatatgggctaagacacacaacgttgaaaacacagaaaggaaggcaagtaggagttagctttagacgatgatccttttcttccctgcatattcactttaacagacactcaacaaatatttattgattccttaatgaccaatgatcttcttaagaaagtgctatgcacatttgaatgtataatgtagaaattctcacctttaatcggcaactagaactctgttgataaacragttcagaaataactgggaaaagttttgattcatgtagttctgtaattttaaatccaaaatttggagagctagtatggtttattaccacgatgacattgctgactcctcataactacatatctgctaacacaagtgctccaggttatatacccaattggaagcactaaaataaatctacaactaaaagaaaatgttctaaaaaggagccatcacactttggttgatatagatggtctaaggtgtttctatttgtatacataaaattcagcctgatcaaatcagattataccattaataag

SEQ ID NO: 65123 - DNA, 601 bp, Human
aataagccttttgtaggaaacacaaacatttactggacatgtaactcattggacgagacccagggctactcccatacttagctcagaggtaagaaatagaggattcaggcatagaaggagtaagaaagaagcagccatacagaggccagaatgacatattagaattctaaggaggccccaccagacatgtgtctaactattttcaattctatccacagatatctgaaaccagtagtgagctaaataatattaaaactgtagtaaagcccacgtacagatcaacttcaagtcagtttggtattttttctttcctactgcccacccccattcaaaaggtctcatagaaccagcagtgctcttctttgtaaagggaaaaacgccaaaaaatatgatttacttccacctctttcattcttttacgcaaagtgtttatcatacaataaaaatatttaagacacatgagaaatcaacacaatgtggccctttgtaaagagaggaaagagtcaatagaaggagatgcagacatggcccagatgttggaattatcaaatagggatttgaaaatacctataatataaatgctaaaagatctaggggtgat

SEQ ID NO: 65124 - DNA, 601 bp, Human
agtataattcagatacaagcattgagtaaatatttccattccaaacgggataaatcagccaaacaaaagaggctacagcccccatgcaagtctgaaacccaaaagggcagtcatcaaattttagtgctccaaaataatctcctttgactccacgtctcatatccagggcacattggtgggaggagtgagctcccaaggccttgggaagctctacccctctgactttgcagggcttagctccagtggctgctctcatatgctggcactgagtgcctgcagtttttccttgctgagggtgaargctgccagtggctaccattctgggttctggagtatggtggccctcttctcacagttccacaaggcaatgtcctagaggggactcagtggagactgcaacaccacatttccccttttcgctgccctaatagaggttctagggccatgagggttatgcccctgcagcaggccactgcctggacacccaggcttttctgtacatcctctgaaatctaggcagaggctcccaagcttcaattcttgcattccacacacccacaggcttaatgctgcatggaagctgcccatcgattcatttact

SEQ ID NO: 65125 - DNA, 601 bp, Human
tttggcttctggagaggcctcaggaagcccacaataatggcagaaggtgaaggagaagcaggtacatcacatgtggaaagcaggagcaaagtgggaggaggtgccacacactttaaaataaccagatcttgtgataactcattcactatcacaataaatcattcatgaaaaatccacctccagaatccaatcatctcccaccaggtatcacctccaccctggggattacaactgaacatgcatggggacacagatccaaaccatgtcattctgcctctggcccctcccaaatttcatgtcmttttcatgttgcaaaatacaattatcccttcccaacagtctcccaaagtcttaactcattccagcattaactccaaagtccaaagtctcatctgagacaaggcaattcccttctacctatgagcctgtaaaatcaaaacccagttatttacctccaaagtataattcagatacaagcattgagtaaatatttccattccaaacgggataaatcagccaaacaaaagaggctacagcccccatgcaagtctgaaacccaaaagggcagtcatcaaattttagtgctccaaaataatctcct

SEQ ID NO: 65126 - DNA, 601 bp, Human
ttcttctgacctaattaatctcttagctattaggtggcctaaagtccaaaatggcatattcaggttatttggtataaatatcatacaggaagcatagaaaaatatgaaatggtctttgctttctttggactgtatttgtaaaaatatgttattggtttgtgttccaaaattatgggaaagtcctgtaattctgatatgacttagtgtacattatcagtaatagttataattgtcagtaaaatcattgtatgtcacagaactaaccaaaatttctttatcaattgtggctttaatatatgtygttctaaaactttttgtcatccatagaaaattgttgacctgttttaatcctctttaaaaagtaagtttagagtcagctataggattttgacaggtgctcttgaatgcacgtttctaataactttgaagattgtgacattagaagagaggataaaactttcagtactgatggagagctgaaatgttcatgaatatcaagctgaacaagagttaactgcatgggctgaataatagatagctgaagtaatcttttaaaactttttgcttaaaatgttgctgatcctttgttttgctatcagag

SEQ ID NO: 65127 - DNA, 601 bp, Human
tctattaatgagtaaaggtttttcccctttaaatatttttgagttattattttggcctaatgaatgacttatgatgacctggaattatattttgtgatatccagtgttttaaacctttaatatttgacaagctttccaaaataaaattacaaagtatgtcttcttctgacctaattaatctcttagctattaggtggcctaaagtccaaaatggcatattcaggttatttggtataaatatcatacaggaagcatagaaaaatatgaaatggtctttgctttctttggactgtatttgtawaaatatgttattggtttgtgttccaaaattatgggaaagtcctgtaattctgatatgacttagtgtacattatcagtaatagttataattgtcagtaaaatcattgtatgtcacagaactaaccaaaatttctttatcaattgtggctttaatatatgtcgttctaaaactttttgtcatccatagaaaattgttgacctgttttaatcctctttaaaaagtaagtttagagtcagctataggattttgacaggtgctcttgaatgcacgtttctaataactttgaagattgtgacatta

SEQ ID NO: 65128 - DNA, 601 bp, Human
gaaaggaaagaaaagagacagatggtttggagatctaagtcttccctctattaatgagtaaaggtttttcccctttaaatatttttgagttattattttggcctaatgaatgacttatgatgacctggaattatattttgtgatatccagtgttttaaacctttaatatttgacaagctttccaaaataaaattacaaagtatgtcttcttctgacctaattaatctcttagctattaggtggcctaaagtccaaaatggcatattcaggttatttggtataaatatcatacaggaagcawagaaaaatatgaaatggtctttgctttctttggactgtatttgtaaaaatatgttattggtttgtgttccaaaattatgggaaagtcctgtaattctgatatgacttagtgtacattatcagtaatagttataattgtcagtaaaatcattgtatgtcacagaactaaccaaaatttctttatcaattgtggctttaatatatgtcgttctaaaactttttgtcatccatagaaaattgttgacctgttttaatcctctttaaaaagtaagtttagagtcagctataggattttgacagg

SEQ ID NO: 65129 - DNA, 601 bp, Human
ctggggacatgtggaattagccatattcccaactatgcaaagaggttgtttctaaaaaagaaattttatataggaaaggaaagaaaagagacagatggtttggagatctaagtcttccctctattaatgagtaaaggtttttcccctttaaatatttttgagttattattttggcctaatgaatgacttatgatgacctggaattatattttgtgatatccagtgttttaaacctttaatatttgacaagctttccaaaataaaattacaaagtatgtcttcttctgacctaattaatctyttagctattaggtggcctaaagtccaaaatggcatattcaggttatttggtataaatatcatacaggaagcatagaaaaatatgaaatggtctttgctttctttggactgtatttgtaaaaatatgttattggtttgtgttccaaaattatgggaaagtcctgtaattctgatatgacttagtgtacattatcagtaatagttataattgtcagtaaaatcattgtatgtcacagaactaaccaaaatttctttatcaattgtggctttaatatatgtcgttctaaaactttttgtcatc

SEQ ID NO: 65130 - DNA, 601 bp, Human
gacaacatagtaagaaccatctctacaaaaaaaaaaaaaaaaaaattagccaggcatggtggtgtgcacctgtactcccagctatgcagtaggctatgacaggaggattacttgagactgcactaggatacgatcatgccactgcactccagcctgggcgacaaagcaatactacatcttaaaaaaaaaaaaaaaagacagtattttgacaataccattaatagatttatatatgtaaaaaaacaaattctcaatgtggtaccataaaaaaatagatctgtgtccattcaaccaaaatatgataacagcctttcattatttctattaagaactcaaattgaaattaaaattaaaattatgcatcatggggtcaggttaattatctgatctctgtttagtgtgacactaagaatattttattttgtaacaaaatgaaaatcaaataatgaaatctaagtttttaaatatgatgtctctagaatgaagaaccaaagcagtttatttgtttttaatgctcactgcagtaagggttttatgccaaaaaattaccatatgttttctgcttttattatcattgttaagatttttagacattgggggt

SEQ ID NO: 65131 - DNA, 601 bp, Human
ctggacaacatagtaagaaccatctctacaaaaaaaaaaaaaaaaaaattagccaggcatggtggtgtgcacctgtactcccagctatgcagtaggctatgacaggaggattacttgagactgcactaggatacgatcatgccactgcactccagcctgggcgacaaagcaatactacatcttaaaaaaaaaaaaaaaagacagtattttgacaataccattaatagatttatatatgtaaaaaaacaaattctcaatgtggtaccataaaaaaatagatctgtgtccattcaaccaaaatatgataacagcctttcattatttctattaagaactcaaattgaaattaaaattaaaattatgcatcatggggtcaggttaattatctgatctctgtttagtgtgacactaagaatattttattttgtaacaaaatgaaaatcaaataatgaaatctaagtttttaaatatgatgtctctagaatgaagaaccaaagcagtttatttgtttttaatgctcactgcagtaagggttttatgccaaaaaattaccatatgttttctgcttttattatcattgttaagatttttagacattggg

SEQ ID NO: 65132 - DNA, 601 bp, Human
tggactggacaacatagtaagaaccatctctacaaaaaaaaaaaaaaaaaaattagccaggcatggtggtgtgcacctgtactcccagctatgcagtaggctatgacaggaggattacttgagactgcactaggatacgatcatgccactgcactccagcctgggcgacaaagcaatactacatcttaaaaaaaaaaaaaaaagacagtattttgacaataccattaatagatttatatatgtaaaaaaacaaattctcaatgtggtaccataaaaaaatagatctgtgtccattcaaccaaaatatgataacagcctttcattatttctattaagaactcaaattgaaattaaaattaaaattatgcatcatggggtcaggttaattatctgatctctgtttagtgtgacactaagaatattttattttgtaacaaaatgaaaatcaaataatgaaatctaagtttttaaatatgatgtctctagaatgaagaaccaaagcagtttatttgtttttaatgctcactgcagtaagggttttatgccaaaaaattaccatatgttttctgcttttattatcattgttaagatttttagacat

SEQ ID NO: 65133 - DNA, 601 bp, Human
tatcaaagtaataatcctcattattttcaaaacaacaaagcttaaaagactagctgggcttgatggttcatgcctatgctttgggtggctgaggtaggaggattgcttcaaactggactggacaacatagtaagaaccatctctacaaaaaaaaaaaaaaaaaaattagccaggcatggtggtgtgcacctgtactcccagctatgcagtaggctatgacaggaggattacttgagactgcactaggatacgatcatgccactgcactccagcctgggcgacaaagcaatactacatcttaaaaaaaaaaaaaaaagacagtattttgacaataccattaatagatttatatatgtaaaaaaacaaattctcaatgtggtaccataaaaaaatagatctgtgtccattcaaccaaaatatgataacagcctttcattatttctattaagaactcaaattgaaattaaaattaaaattatgcatcatggggtcaggttaattatctgatctctgtttagtgtgacactaagaatattttattttgtaacaaaatgaaaatcaaataatgaaatctaagtttttaaatatgatgtctctagaa

SEQ ID NO: 65134 - DNA, 601 bp, Human
tagctgtgtccttgaaaactaaaacaaatttaaattacaactagaagtaaagtaataattggcatagatgcttataaatagatatagctgcccacagattatacagaactaaagataatttcttgttaaatttttagaaaaaattctaatatgatatcaaagtaataatcctcattattttcaaaacaacaaagcttaaaagactagctgggcttgatggttcatgcctatgctttgggtggctgaggtaggaggattgcttcaaactggactggacaacatagtaagaaccatctctacaaaaaaaaaaaaaaaaaaattagccaggcatggtggtgtgcacctgtactcccagctatgcagtaggctatgacaggaggattacttgagactgcactaggatacgatcatgccactgcactccagcctgggcgacaaagcaatactacatcttaaaaaaaaaaaaaaaagacagtattttgacaataccattaatagatttatatatgtaaaaaaacaaattctcaatgtggtaccataaaaaaatagatctgtgtccattcaaccaaaatatgataacagcctttcattatttctatta

SEQ ID NO: 65135 - DNA, 601 bp, Human
catggttttctacctcaacaattcaaataaatctatagtcaaatattcgaattaatgtgttccaaaatggtgttggaaataagaatgatatataacaatttataatatttctttatatcagcaataaatataaaatgcaatttaataaaagatactatttacaatagcaccaaaaccttgagatacctaggaataaattttatatttatcccttttattataagttatgagtattttatttatagaaatttactaaaagacataaaagaagatctaaataaatagaatgatatactatgawcatggatgaaaaaaatcagcataacaatataaattatccctaagctgttgtataaatttaattcaattccaataaaaaatctcaataaacatttttatataaactgatcctaaaattcatttggaggagtaagacctaacaatagctgaagaaggctggtaagaaggaatccactgcaagatatcaaaagataatcaagtgctatagcttttggcaagaagttaatcaaattgacctctgaaacaagatgttaaacacactaccatcaaattggagcttgagatacagtagaggtggctt

SEQ ID NO: 65136 - DNA, 601 bp, Human
gtttttaacgtgatatggcaaacatcttatttaaaggaaaaaatgtaaagccatttccattaaagcaatgacaagttgaggatgcttgctctcactgcttttttttccaagattgttaaaggaatgtctagacctcacaatcagacaaagaaaagaagtaaaatccataagaattagaatgacataaatatattatttgcaaattacatggttttctacctcaacaattcaaataaatctatagtcaaatattcgaattaatgtgttccaaaatggtgttggaaataagaatgatatatamcaatttataatatttctttatatcagcaataaatataaaatgcaatttaataaaagatactatttacaatagcaccaaaaccttgagatacctaggaataaattttatatttatcccttttattataagttatgagtattttatttatagaaatttactaaaagacataaaagaagatctaaataaatagaatgatatactatgatcatggatgaaaaaaatcagcataacaatataaattatccctaagctgttgtataaatttaattcaattccaataaaaaatctcaataaacattt

SEQ ID NO: 65137 - DNA, 601 bp, Human
tttccagataaagaaatattgagaggttttatcactatcagacttgctctacaagaaataccaaaagaagtccttctggctgatatgataggatattagagagcaatgtaatccggatgaagaaataaagagtacctgtaaaggtaattaaataggtaaatatttaaaaagattataaatgtatttttactgtaattctttttctctctcacatttgttttaaaagatgactttataaagcaataattatatatctgtgttgatgggcatccaatgtaaaaaatctccatagacaataacrgcacaaaagaaagcagagtgaacaaaaactatataggtgcaaaattttgcatactcttaaaattaagttggtattaatttgaattagatttttatgaattaagatgttaatgataacatcctgggcaacaaacatagtagaataaatgacaagggtattaaattatacactagaagataactttttaacccaaagaagacagtgaaagaatagagaaatttagaagacataaatcatattttaaaaaaccaacagcaaagtgacattgtaactaccttatcagtcactgtgctaaatgta

SEQ ID NO: 65138 - DNA, 601 bp, Human
acatataaatcagggtaaaaacagataataaggctaagtaacaaatgtcacaacaatcagaaggaaagaaataaactctcatttgcagatagcataattatctactcagaaaatttccatgactgtacataaaagctattagaaataacaagtgaattagttaattttgtttgatagaagttaaatgagtaataatttaatttctatatactagtgattaaccaatggaaattaaaacttttaaatactattttattagcactgaaaatgtgaaatattagttataaatctattaaagcawggcaatgtatataggtaaaaactataagacattgaggaaacgaataaaaggacatcagcaatggcagagtgaaaacaatggaagagtctgtcttccataaaagcaatgggaacactggcaaagaatatcacatcaacttattgagaactctggaaataaagcaaagacttgcaacaatgtggacagtgtttattttttaaatgactgaatattggtaagaacaacatgttctatggcattttagctttcctattcccgtactcctctctgccactctctggaagccctgaaaatgaacag

SEQ ID NO: 65139 - DNA, 601 bp, Human
aatattacatataaaaatatttcttcattagtgtattctcagctgatgtagtctaagaaaaatacacttataggctctctctttctacccattagtctcagtcttccacataccccatgagctgaggcccacaagaagatgtgctctaggcagcctcctgctctgactttcccgtagggagagtttctctactctatctatcctaaaacaggcagctggcacaagtgcaaagaattattcctccaagtggtgttatgaagacaaaactaaatctactaaaactttgcagaaatctttagamgatttccaacacaaattgttctaaaatttataattagttacaagaaataagaaaacatggtaaaatattctttcagttaattggccatccaggcaacatgatttatgatcaattgacctggatccaggatctaaagttaaacaaagagggaatggtagaaagatggacatgtcattcttagaagaaagatgagaagaatacatgcaaatacagcaaagccattgtgtgcctatgcttttatttggggaataggaaagacgaataggaaagtcactcctcatagcataaattttatttatg

SEQ ID NO: 65140 - DNA, 601 bp, Human; identical to SEQ ID NO: 35586

SEQ ID NO: 65141 - DNA, 601 bp, Human; identical to SEQ ID NO: 35587

SEQ ID NO: 65142 - DNA, 601 bp, Human
tagtggctttgtggaggagaggacaaggttaatgaaagaaatcactgattataaggaagtaagtgtccatcttaagggatcaaaagaagacagtagaaaaatataataaatgttgctttaactttaaaatctagaacaaataaaattggcaaaaatttaaacacacaattatggctcagtgaagaataaatcaatcaagttaatccaattaatttcatttctgtgacaatatgataagccatacaatcaagcatattaaaatcagttcttctaaaagatttttcctcataatatactaatsaaatcaaatgcaaagactctaggcattagaaatccaaaagaaaaccataaaagatttcttcttttaaagcaagtattgactaatggtgaggactagatgtatataaagtagtgatctagaaaataaattcaaaagaatatctaaattagaacatgaaagttttggtctgagcacatagaaagaaagaaagaaagtaggccataactaaatcaaagactcttagttgaaactgaggagtgggactacgttttgaatgtgctagagaaagtctgcattatagataatattcttaccattgaa

SEQ ID NO: 65143 - DNA, 601 bp, Human
taaaatgtattctcaacccaaattatagttaattaattcactagttcataatccaacattcaccacctgagaccaagtctgaaaatcccaacttgtcttctgaaaccaatcatgagccttcattcatttaatggctctatttttaaggggaagcatgaaatcatccaagaatcagaaaatatccaacacttaactgtgagcaattaaagacagaaagataaaacaagacaggacgtcacaagcaaatgagagagactaataccgactgactagtcaacagaaagcaagagaagctcagaaragaacatatcatatgaaggtattagccaaactgtagcttgcaaatactagacatattcagttcaaggtgccctgctaaattcatcccaaagcattttttaattggggtgttagtggctttgtggaggagaggacaaggttaatgaaagaaatcactgattataaggaagtaagtgtccatcttaagggatcaaaagaagacagtagaaaaatataataaatgttgctttaactttaaaatctagaacaaataaaattggcaaaaatttaaacacacaattatggctcagtgaagaataaa

SEQ ID NO: 65144 - DNA, 601 bp, Human
tcattattgttccaaatatttcttctgttcctttctcttcttcttcttcttccccattatatgtatttacatttttggtagctgtctcacagttcttagatattctgctctatttgttcagtcatttttctttttacctttctattttggtagtctctattgacacatcttcaaactcagattcttttatcagctgtccccaaatattaatgatccaattaaaggcattctttatttctatgaaagtgtttctgatctctagcttttctttttgcttctttgtcagaatttttatctttcwgcttatattgccatctatttttgcatgttgtctactttttccattagagcctttagtgtattcatcagagccgctttaagtttctggtctgataatttccatatcctttccatgtctgagtctcattctcatttttgctctctctcttcaaactgtgaggttgtttgtttgtttctttgtttgtttgtttttggtgttttagtgtgctttgtaactttttgttgaaatccagacatgatgtactgagtaaagggaactctggcaaacaggcctttcatggtgtggtggtaagatgagagg

SEQ ID NO: 65145 - DNA, 601 bp, Human
agtttcttctttctatttgtatgattttaaaatttatataagtgtatacagtgtatgtattattctaaaacaagctttctgtagtatgattgtttgagaagtctggtcatgttgatgtgatagctatattccttcatatccactactgtaaagtgttccacgtagacatttgcaaattgttttccatagtgcagcagcaccttcccataagtggtgtatgagtccccacttaccagttcctgaaatttccagattttgccatctttgacaacttgatgagtataaaatattatcacattctttttttttagtttactgataaccagtaaagttgcacatgtctttacatgtatattgaccatttcagttgccacttctggcttcttctgtgaattacttgttcacttcttttgtctgtttttcaaatagtttgcttaatttaaatgttacctttgtcagttatatatgtgttgtcttgctaatgacaactgctagtatgtagcttttctttctttttataaaaagacatttttaataagagatgtattaaattcttctatgctgatggtagaacttgccaatttctctttctggttctata

SEQ ID NO: 65146 - DNA, 601 bp, Human
gtcttcacatgctgctctgtctgtccgagggggagctgcaagttagtcctgcctcctatccttttatcagtttcttctttctatttgtatgattttaaaatttatataagtgtatacagtgtatgtattattctaaaacaagctttctgtagtatgattgtttgagaagtctggtcatgttgatgtgatagctatattccttcatatccactactgtaaagtgttccacgtagacatttgcaaattgttttccatagtgcagcagcaccttcccataagtggtgtatgagtccccacttamcagttcctgaaatttccagattttgccatctttgacaacttgatgagtataaaatattatcacattctttttttttagtttactgataaccagtaaagttgcacatgtctttacatgtatattgaccatttcagttgccacttctggcttcttctgtgaattacttgttcacttcttttgtctgtttttcaaatagtttgcttaatttaaatgttacctttgtcagttatatatgtgttgtcttgctaatgacaactgctagtatgtagcttttctttctttttataaaaagacattttt

SEQ ID NO: 65147 - DNA, 601 bp, Human
ctgcagtagttcttggagaaaagttcatgatgtgtgtcttcacatgctgctctgtctgtccgagggggagctgcaagttagtcctgcctcctatccttttatcagtttcttctttctatttgtatgattttaaaatttatataagtgtatacagtgtatgtattattctaaaacaagctttctgtagtatgattgtttgagaagtctggtcatgttgatgtgatagctatattccttcatatccactactgtaaagtgttccacgtagacatttgcaaattgttttccatagtgcagcagyaccttcccataagtggtgtatgagtccccacttaccagttcctgaaatttccagattttgccatctttgacaacttgatgagtataaaatattatcacattctttttttttagtttactgataaccagtaaagttgcacatgtctttacatgtatattgaccatttcagttgccacttctggcttcttctgtgaattacttgttcacttcttttgtctgtttttcaaatagtttgcttaatttaaatgttacctttgtcagttatatatgtgttgtcttgctaatgacaactgctagtat

SEQ ID NO: 65148 - DNA, 601 bp, Human
gctgcagtagttcttggagaaaagttcatgatgtgtgtcttcacatgctgctctgtctgtccgagggggagctgcaagttagtcctgcctcctatccttttatcagtttcttctttctatttgtatgattttaaaatttatataagtgtatacagtgtatgtattattctaaaacaagctttctgtagtatgattgtttgagaagtctggtcatgttgatgtgatagctatattccttcatatccactactgtaaagtgttccacgtagacatttgcaaattgttttccatagtgcagcarcaccttcccataagtggtgtatgagtccccacttaccagttcctgaaatttccagattttgccatctttgacaacttgatgagtataaaatattatcacattctttttttttagtttactgataaccagtaaagttgcacatgtctttacatgtatattgaccatttcagttgccacttctggcttcttctgtgaattacttgttcacttcttttgtctgtttttcaaatagtttgcttaatttaaatgttacctttgtcagttatatatgtgttgtcttgctaatgacaactgctagta

SEQ ID NO: 65149 - DNA, 601 bp, Human
cctccctgcctgatgcaacttctgtgctgtgtctgcactcccagttcaccctcacccccagattctgctaggaaagttggcattcagtcgaaattgttacagagttcatctggaagtttccttctccttgtggtctttccccacttccactggcagtcctacccaaggaccctaggagacaaagtcagaaatggttttcctgggggctgagagagtccacagggctcttccccctgcttcctttacccttatattttgttcagctctctaagtttgtctcagctccaggtaaggccaaatycatcacctgtgacctggaccttcaggttccccaggaaggctatgtgttcaggggtggaagatccccctttcacactttgggcacttacagtttttcggctgtctcctggagcctgcagcagcaatctatttccttcaaaggatctgtggattctcgtggctttcctggtatgttgctgcagtagttcttggagaaaagttcatgatgtgtgtcttcacatgctgctctgtctgtccgagggggagctgcaagttagtcctgcctcctatccttttatcagtttcttctttctatttgtat

SEQ ID NO: 65150 - DNA, 601 bp, Human
tacttgcttggtgagttcttatcctttctgccattctgtatcttttaagtggtgcatttaggccatttacattcaatgttagtgttaggatgtgagatgcctttctattcatcatgctatttgttgcctgaatgcttttttttaaattgtgttttttttttataggtcctgtgagatttatgctttaaggaggttgtattctggtgtatttcaaggatttgtttcaaaatttagagctgcttttagcagttcttgtagtgctagcttggtggtgataagttctctaaacatttgtttgtckgaaaaagactgtatttttccttcatttaggaagcttaatttcactggatacaaaattcctggccaataactgttttgtttaaggaggataaggataggacaccaattccttctagcttgcagggtttctgctgagaaatctgctgttaatctgacaggttttccttcataggttacctgatgcttttgcctcacagctcttaagattccttccttcatcttgactttagataacttgatgactatgtgccttggcaatgacctttttgtgatgaatttcccaggtgttctttcagcttct

SEQ ID NO: 65151 - DNA, 601 bp, Human
gctttgaagtttgttttgtctgatataagaatagctactgctgtttgcttttggtgtccattttcgtggaatatctttttccacctctttaccttaagtttatgtgagtccttatgtgttagatgagtctcttgaggacagcagatacttgcttggtgagttcttatcctttctgccattctgtatcttttaagtggtgcatttaggccatttacattcaatgttagtgttaggatgtgagatgcctttctattcatcatgctatttgttgcctgaatgcttttttttaaattgtgttttwtttttataggtcctgtgagatttatgctttaaggaggttgtattctggtgtatttcaaggatttgtttcaaaatttagagctgcttttagcagttcttgtagtgctagcttggtggtgataagttctctaaacatttgtttgtcggaaaaagactgtatttttccttcatttaggaagcttaatttcactggatacaaaattcctggccaataactgttttgtttaaggaggataaggataggacaccaattccttctagcttgcagggtttctgctgagaaatctgctgttaatctgac

SEQ ID NO: 65152 - DNA, 601 bp, Human
ctgggagctctggagttaggtgcatatatatttagaattgtgatgtttccctgttggactagtccttttatcattatataatgtccctctttgttaactgctgttgctttgaagtttgttttgtctgatataagaatagctactgctgtttgcttttggtgtccattttcgtggaatatctttttccacctctttaccttaagtttatgtgagtccttatgtgttagatgagtctcttgaggacagcagatacttgcttggtgagttcttatcctttctgccattctgtatcttttaagtrgtgcatttaggccatttacattcaatgttagtgttaggatgtgagatgcctttctattcatcatgctatttgttgcctgaatgcttttttttaaattgtgttttttttttataggtcctgtgagatttatgctttaaggaggttgtattctggtgtatttcaaggatttgtttcaaaatttagagctgcttttagcagttcttgtagtgctagcttggtggtgataagttctctaaacatttgtttgtcggaaaaagactgtatttttccttcatttaggaagcttaatttcactggata

SEQ ID NO: 65153 - DNA, 601 bp, Human
taattcacccttttggtcattttacaatggtcaagttaaactctatggtcaattaaaatatcactgtaatattctttttggagtgataaagattatttttccccacaatcatttgcaaacctttaggctaaggtagttgtcccgcttctcatctctcagagtactctattaatacctcaatcttgctcctgtcactctactgaaatgattggcttctgtatatgtatctttcaggaaatacaagttattgactttatattctctgtatcatccatgcattaggagcatgatagacaattgytaagctgttagctgacaattcacaattaataatgatattaatgtccaaagaaagttgttcttgagggaatttagagaggagacagaatgagaacaattcacaaacaaggtgacatttatggaaagtcttcagaattgactgttaggtgatgatttgcaataaaaaccacttacaaatataaaatgaaactcatttcataaaagaagaatatgtggcaaccattaaaatattgtcagctatgggtctttagccaaaaaaatttaaagtggggaaattgacctctttacatttccctcacca

SEQ ID NO: 65154 - DNA, 601 bp, Human
agtgagttttttctacttagctggggagagagaaaaagacaaaaaggagaaaaaataataagaatgtaaacattaggtcacactgtttatatcaggtagtgctactttttaataattggtaaaaaataattcacccttttggtcattttacaatggtcaagttaaactctatggtcaattaaaatatcactgtaatattctttttggagtgataaagattatttttccccacaatcatttgcaaacctttaggctaaggtagttgtcccgcttctcatctctcagagtactctattaatayctcaatcttgctcctgtcactctactgaaatgattggcttctgtatatgtatctttcaggaaatacaagttattgactttatattctctgtatcatccatgcattaggagcatgatagacaattgttaagctgttagctgacaattcacaattaataatgatattaatgtccaaagaaagttgttcttgagggaatttagagaggagacagaatgagaacaattcacaaacaaggtgacatttatggaaagtcttcagaattgactgttaggtgatgatttgcaataaaaaccacttaca

SEQ ID NO: 65155 - DNA, 601 bp, Human
tttcaccctgttagccagcatggtctcgatctcctgacctcgtgttctgcccacctcggccgcccaaagtgctgggattacaggcgtgagccaccgcacccggccacatcttttctatgccttggtgaattgtcacgctcctttctaagtttgaatcagcttccaacattttaacttttatgcttttagtgttgtgaagtacctgtgagaattcctctaatgtgaagtgtttgggtgtcacttcctccaggacatcttcaccctatttgtggcaagcacttccctcacttatgttaagttyaccttcactaagtagctctggctacgtattcagaatctctcaaacctcagtagtgactatttcttctatgactccacttaggttcaatctgaattttacttcaagtattttctttctttgcagtgctttcctctttgctgtccaattcctcttcttttttgaatatctgtgtttgtaaagtgtcactcgggtttatcactcacaaggaggcaacacaaccacacgcttctcttctataaataaactgaatgataaatgtgtagtgcgcaatcaccaacagatactgaaaaaaataaacgt

SEQ ID NO: 65156 - DNA, 601 bp, Human
gcatgtaatgcccccttattgacacatgatggttactctgaaggtctttgaatccatattttgtcttggtttatatttgtcttttatttgggaaagcaatttttaatgaattctcaaaattataggagaaagatattttgtcttgtgtgtattatgttcacaatataactttttaacaaatattctataactggattgtggtttatgctcctagccttatttattcataacagaatatataactgtttaaaattaatacaatcattgaattgattcttcaaagtaaatttctcctttaccsattttcacaattttcacttattagtattatcagaacaggaaaaacttcagcttcaataagaagcctgttttcctgcttgaggtaggatacatgaactgaggttagttagaatctgtgtgcatgtaggctagacatcgatatttgtgatgtaagtaaacagaaagttttaaaattataaaaaatccattgtacttttaagagggaaagttagactaagaaattgagaagcgaggctatcataatttccatttggccctaagtgtaagtgacttttgctatatgatcttctatggaattttt

SEQ ID NO: 65157 - DNA, 601 bp, Human
tggacaataaaggccaggctgaggtggtctcagctggagataagtaacttgtggggaactggagtaaaggtcattcttgctatgcaaagaggctggtggcattttgcccctcccctggagatctgcagagctttgaacttgaaagagatgatttagggtatctagtggaagaaatgtctaagtagtaagtgttaaagaggaagcagagcataaaagtttgaaaaatttgcaggctgacaatgcagtagaaaagcaaaacacattttccggagagaaattcaagttggctgcagaaatttgyataactaacaagaagccaaatgttaatcaccaagacaatgggggaaagtgtctccaggacatgtctcatcacccctcccatcacaggcctggaggcctaggaggaaaaaatggtcccatgggcccagggcccccccactgtgtgcagtctagggacttggtgccgtgtcccaactgctccagctatggctaaaagggaccaacatacagctcagactattgcatcagagaatggcagctccaagccttggcagcttccacatggtgttgggcctgcaggtgtgcagaagacaagaattga

SEQ ID NO: 65158 - DNA, 601 bp, Human
tgaatggctttgaccaaaatgctgatagtgatatggacaataaaggccaggctgaggtggtctcagctggagataagtaacttgtggggaactggagtaaaggtcattcttgctatgcaaagaggctggtggcattttgcccctcccctggagatctgcagagctttgaacttgaaagagatgatttagggtatctagtggaagaaatgtctaagtagtaagtgttaaagaggaagcagagcataaaagtttgaaaaatttgcaggctgacaatgcagtagaaaagcaaaacacattttcyggagagaaattcaagttggctgcagaaatttgcataactaacaagaagccaaatgttaatcaccaagacaatgggggaaagtgtctccaggacatgtctcatcacccctcccatcacaggcctggaggcctaggaggaaaaaatggtcccatgggcccagggcccccccactgtgtgcagtctagggacttggtgccgtgtcccaactgctccagctatggctaaaagggaccaacatacagctcagactattgcatcagagaatggcagctccaagccttggcagcttccacatggtgt

SEQ ID NO: 65159 - DNA, 601 bp, Human
aaagtttgaggactaccctagctgatgaccaccatcttgactacagtggctgaacccccatggcttcctcagctcaacccaataacaagcaaagtaaacgggagagaaggtagcagggatgaaaaaagtcccaagcaagaaagcactcagacaatatttcttgaatgcattctacatgagtcaggccatatgctagggacttatgttagggactttcaccggtctccctaccttatcaccatcacctgtggaggtggctatagcagggactctggggctaccagaaaatatgtggaggagyggggtcagtggagggaaaggatggagacaagcggctcactcccaccttgggtcaggatcagactgagatctctagatgtatgcactttaggtgtggattcacagacccttctccagatatgtcaaagtacagaagaggcatcatctaggcctgggactctatttgattgatctgaacttaagtcacactagatgaggaaatggaaaaggacagttaacctccaactcaggatgcatgtcaagtaattcatgcattaagttcaagcaaacaagaaggaagtgcagtggtatcctgaaaaac

SEQ ID NO: 65160 - DNA, 601 bp, Human
gaaggaggctgattatattctgttcctcaataagccagtgtactcgtctgttttcacgctggtgataaagacatacctgagactgggcaatttacaaaagaagggggtttgttggacttacagttccatatggctggggaggcctcacaatcatggcagaaggcaaggaggagcaagtcacctcttacatggatggcagcaggcagagaaagcttgtgcaggtaaactcccatttttaaaaccatcagatctcatgagactcattcattatcacaagaacagcacaggaaagacctgcccycatgattcaatcatctcccaccaggttgctcccacaacacgtgggaattatgggagctattagatgagatttgggtagggacacagccaaaccatatcagtcagtatcatcaaaaagcactaagggtcactatgatgtaatgaataatttgtttaaacaaacttactattctcatatctatctatatctacctacttacctacctacatatctaaacaaaagttgttttcatcctttaatcataactccaggaaactatatacagcctatggtgtctgttcttgctaaaagtcttaaaat

SEQ ID NO: 65161 - DNA, 601 bp, Human
acaacagcaaagccattaaaaatgattataatgaaactaggtgaccagctgtgcccagaagcctcccaaaaaaagcaggtaggaacacaccaccagcagtcacaaaacctgcatggcattagcccctgtgtaggagaaagcagatgatagtaaaggggtgtcggacttttgaaagacctgaaaactggagaacctaaagttcagtgagccaatttgaaaatgggcgactgaaaatagaagaggttctgctgatccaatagccagtgactgcaagagttctgcagtgggaactgaagagccragggcaatctagcttccacggactctcaaaactcactgaccagggcacacttccacggcaaggccccacactgaggagaaatcattgagagtggatgggtaagggtggttaaaataggatatacttaaagataaaaattctgaagttagggtgggtttctcattggcaatgaaaaaaaaacctcacatagtttatttaaacataataataataaataatacatttcaaggttaaattcaattgaacacttcgtgagtgtttctgttattcactgtaatatacaccttgatatgcacagtg

SEQ ID NO: 65162 - DNA, 601 bp, Human
aaactttaacttcctatatcaggaagctattgagtaatatagttccagcaaaaagaaagtaaacagacaacagcaacaagaatggaaggcatgggattcaggaaatgaggatgtagaggtatatgaaaagctctaggctgatagcagggcaggaggtccttgagcataaatatgtatgtgtgtgtgcataaaatatatatgtatgtgtaccatatatatgtatatattcatgtagcaaagacgtcagcatgaggaagattaatgacatatagaaaactaaatagacaagcaaaggaattaytgaatctaggaagaatgaaagactatggatatttttgaaaatagaaccaacatgatttgctgatagattattatgtattgatgtgaagataaagataattaaattcaaataatattttatatatatatataaaacatgttaagtgtttaattggaaatatgattgtgaaattcatttgagtattgtctgtgtataattggtatttgaagtaaaatatcaccaagggcgtgagcgtagatacaggaaagtcctctaaagagagttccagagcactccaacaataagtgttcaaaggtaaga

SEQ ID NO: 65163 - DNA, 601 bp, Human
tataaaattgagaccaaaaacaatacaaaagctcaacaaaacaaaaagttgatattttgaaagataatattgacaaaccgttagctagactgagaaaaaaagaaaaaagactcaaataaaatcagaaatgaaaaaggagacactacaactgaaaccacaaaaatacagttgatcattggagactattatgaataactatatgccaacaaattgaaaaacctagaagaaatggataaatttgtggatacatacaactggccaaaattgaaccaaggaggaatagaacactgaacagaacacycacaagtaatgagattgattcagtaattaagagtctcccaacaaagaaaagtccaggatcaatggcttcactgctgaaatctaccaaactttaatagaagaactaataccattttttcttaaactattccaaaaaattgaaggagaggaaattcttctaaactaattttataaggccagcattaccctgatagcaaaaccaaatatgcaacagcaaaaactacaggccaatattcctgatgaccatagttgcaaagatcatcaataaaatactggcagaccgaatccaacagcacatcaa

SEQ ID NO: 65164 - DNA, 601 bp, Human
tagagttcattctttcttgctgggcttggaactctgagatcaccttgtgagcaagctcatgctatcctgctggaatattagaggttggatggcagagaactgaggtgccccagctaataattgctcctactgtcccagtgaacagccagcttgccaaccaccacatatgagagtgaggtcttcctatctaactgctgcttgaccagctagctaatcacagacaaatgagagagcccagaagaggttggacaagccagtgcacaccagcactgagccaaaccatagaatcctaaataaataygcaatttttattgtttttagccactaacttaaacagcaaacgttaatagataaaatatcattgaccagaacttaaaccacatttctacacctagctgccaaggagactgagaaatgtagtttattctctatgatcatgtgatcaactacttctgagctttcttttactaacatggaaggaaatacagataaagcagtacaattactatctctgataacaaacaaatatctattcacagttcaagccatggagattctcctgctctttatggcttaaaatgcaatcttggtcttataaatt

SEQ ID NO: 65165 - DNA, 601 bp, Human
ataatattgccttgattcttgccaaaacctaagtcttatcgagatatttttgtcaataaaaacaattctttctatatgaactctgccacaaattaataaaataacaagtttactcccatttcattaatctctctgtaacacatatagattataatttctgtatattaactatatcttaaaatgtagtttaaaaataaaataaagcattattatttttaaaaatgttaactttagtcagtttcccaagattcaactgaaaatacccagtttacttctatagattccacagttgtagattctmcctttttaatgtgagaaaatacaaatctactcatactctaaaaccaattgctgtccaccaagaagtagaaagagagaaaggcattcccctttcctttaaaaatacactaagacactctttggtacgatccttccacaataactctagattgacctattggttttcttcggccaaatactagcacatataatgcttgcaaatatgattcaaacagacaatttaaaatgcctgcaaatttagagttcattctttcttgctgggcttggaactctgagatcaccttgtgagcaagctcatgct

SEQ ID NO: 65166 - DNA, 601 bp, Human
aaaaaaaaatatatatatatgtatatataattccttgtacattgtgggcacacaataaggggttcatttaattgacgatactgagaaataatcaggagttttaacaaggtcatctcattgggctgctttttaaaacaggcacttatgatcttaaatgagaaaaaatgcaaaagagaaaaacagaaaaatgactagttttagataataatataaaaagaaacaggttgataatttctttcacttcaccattcctccttttaaaccacttactgtttccattgcaataaaatatcaatgtgayttcacttgtacaatataaacatggctacccagttcacctttctggaaactaaacactgatataaaagtgctaaataaatagtctatttggtaacctcgataatatcttaaactcttagcaagaaagaaacataattgagtagagccacagatccaaaaatcatcactatttaaattcatatcatatatttatttgcaaattattctgtcagtttccccatcaaaatttaagctcactgaaagtaccgtttgctactacacataaaatgttctctgattaaattaagaactcaacagtacc

SEQ ID NO: 65167 - DNA, 601 bp, Human
ttttcttcatgcaaccccctcctggtctcctttctcttttcctggctctttttttggaggactttatctggtatatatttgtctttttggttttttttttttgagacggagtttggctcttgttgcccaggcaggagtgcaatggcgccatctctgctcactgcaatctgtgcctcccaggttcaagcgattctcctgcctcagtctcccaagtagctgggattacaggcatgtgccaccatgcccagctaattttgtatcttcagtagagatggagtttcaccatgttgctcaggctggkctcaaactcttgacctcaggtgatccacccgcctcagcctctcagtgctggggttacaggcatgagccaccatgtgcggccattaggagaataacttcttagtcacgatttgcctaagtacagacgcaacaaaactcctttccaaaggtttattgcaaattgtcttcttttctttagaggaagatgtagaatgggcatcaacactaatactgaaaaacaatgatcacatttaaagtattatcgtattttatttacttgtgcaaatgtcttatttcccttgttaaagtttcaatatcttga

SEQ ID NO: 65168 - DNA, 601 bp, Human
cagaatcatgagttgaggtatgcttgaaagtggatgaaataaacagtatttatctaactcaccctcaaatatttgttgtgtgaatgtgtaagataaatattgagttagttatttagaaaaagttccactcttagcttgcagtgagctgagatcgtgccactgcactccagcctgggcgacagagcaagactccgtcttaaaaaaaaaaaaaaaaaaaagaaagaaaaagaaaaagttccactctttcagagtatacattctggagtcagatggacctggacttataaatggctcttctacktaattagatttcattcccccaattagattaaaatgagaataatcccagcacctccatcttagaaatattgtgcatattaaatgaaagtttgcaggcaaaaccttatcacagagcctggcacacagcggactctcagtaaacattatctattatcatctttgtaattgtcaattagcaagttttctatgacagagaaatttttcttatcagtgtcttttacttttttttgttttccagatgtacctaagattgtggtctgtatttcctgtgacaagattccttcctgatgatttatcaagg

SEQ ID NO: 65169 - DNA, 601 bp, Human
gaagatatttttctcctggtaaatgtggtcagaactatgaaaaagacagaggtggccaggagtgaaacaaaccagcccaagagttccaactggggaatctgtagaatattatttcaaaaaaattacatctaggagctagtatgtgcagtaactggctcctattttactatcaaaatcctgacagtgctttttatttactatttactgtaccatgcgctttgtatactcatttagatgatttataataacatctgtagaaaagagtcacaatggtctcagaccatcaaggtaacatttctayggtgatagaagtagagcgtcacagattaaaatatatgcatgtatgtcaagaaaacaaaaattattttaataaaattttaaatgatttttgtagtttttaaaaatcatatcaaattttaaaagaaagtcaaaatgaactagtttaagttctttttcagtaattaccctgtcacctgtccaccctctaatggaggtgttaatgaggagtggaacagccaaaaggcaggcagcaggggggcaatgagtttaaaagagcccagataatcacaaaccctgaaataattagcaattagatttataa

SEQ ID NO: 65170 - DNA, 601 bp, Human
cagaactataagataataaaaattcatgttgttttaagccactgagtttgagataatttattccaccaataataggaagctactgtatctggtctagtggaaaagacaaaactgaaacctggatatcctgatgtccagttgcatgttattcctattacatcacgttgaataaatgctactaatatataaaaactgatacttcttatcagatcatatatcatctatactaagagagaatatatagtttggcagccataggagattgcaaaaatcacaactcttcacctttccctctgtgcakgtcctttgcagctaactgtataattagttctactcatcaaaaggagagtctgtttattccccaccacttccaaacatggttaagcctcgtgccttgctttggccagtagaataaggtaaaagtaacatcctgacggttcgggcctcaagtgtctttgcatgcttctgctttctttcttggaaatctgccactgccttgtgagaaagccctgccttggctgccagatgatgacaggcttgtggcccatttaccctgtcaccccagatgacagccagctgtctgacaaagagtcactgagga

SEQ ID NO: 65171 - DNA, 601 bp, Human; identical to SEQ ID NO: 35588

SEQ ID NO: 65172 - DNA, 601 bp, Human; identical to SEQ ID NO: 35589

SEQ ID NO: 65173 - DNA, 601 bp, Human; identical to SEQ ID NO: 35590

SEQ ID NO: 65174 - DNA, 601 bp, Human; identical to SEQ ID NO: 35591

SEQ ID NO: 65175 - DNA, 601 bp, Human; identical to SEQ ID NO: 35592

SEQ ID NO: 65176 - DNA, 601 bp, Human
ataattgggttttataagtcttactaatacatgtaatcaggtttgtatgaatccagttagtcctgaatgaagcaagcacaaattatacaaaccatttctactcagattatacttaataacaattcttttatttaaattttattaacttaagagcttcttcttaataaaacaatagataaacatttacctatttcatgaaagccaaatataacaccaggccacacagtaatttctagatgttcccatggatcaggagtgagtagagccaagcctacaaaaaatgtctggactgagggaagargtatcctaacgtcctcataagaagcttcctgattgtttctcacaattgtcaggacactgctaggacacaggttggtagttaagccctggagtcacgctacaactaattacatttctatgtatttctagttctatatatttgtatatgtttctagttgtatattctatatatttctagttgtagagtggagtcactctaccactaattatatttcttattatgacacagctgtaactcgtagctcctaggtacctctttaagttacgttttggttgttgttgtttaaaactgttgaggtaa

SEQ ID NO: 65177 - DNA, 601 bp, Human
gtcacaggcattgaaactaaagaagcagcagtgcaatactctggatgaaatgtacccattctaatcatatatttaattgaaaaaatgtttaaaacaagagagagccaattataattctcaagctttttaatgaaacagcaagataaatcttcacaagtatctttctgatttttgagaccgagatttaagggggcaacatatcttttcatgattcaaatgcttccaaaaggctaattactacttctaatttgtggtgctctttttcaaaatttttgaatggtcactcgtttccattgatgtstgataatgagctcatatgagctattagacataagagttaaatttcccacaaatccattggagttcattggaataatatatactctccaaattgcaatgttaatagtagaaaaaacagagcaggatgaacagtaaagttgcaagtcaacttttattactctcctatagcaaaattgttgaccattctaaagaactggctttattataggtctgcagtgtatttctatgatttaatgtctatactttctattcagatgttttgttttggaaaaacatttagaaatacacattcatctactga

SEQ ID NO: 65178 - DNA, 601 bp, Human
ttcatgactaccatactggacaccaaagatgtagacagagcatcacaaattatacatatttggtgtgttgaggataggatttccattttaactaaatgttgagaagaagtatgaatatgcctcctatgcttcttaaaagctgaagaatttcattgctgtttgaaagcagcctttctccaggtcccatttgtttgaaagttgatacatctctactttactccaaccactcaactcaatggagataatgttgaagctcagcaccaccacagaaatcaaattccttcccccatcagtagcatartccaaaaattacgtcttaaacaggaatatagattaagagtaataggaaacaaaactaaacaaaaggaattctggcaactctgtcgtttttgtgtaataattattgaaaattagagcacactttttttttaatttggcaaagtgattctaatcaatagggaaattcttgagagtccattaaagttaatgtttaccatttaaactttaagtagtagagcacttcttgattcccagaggaattattccatctagcaatgggactgtcctttagaagtcaattcctgagaatgaatagaactag

SEQ ID NO: 65179 - DNA, 601 bp, Human
aattcaccgtaaagcagcttagaacaattagtatttgttactttttagaccttcggccagcttttcaaaaagaaacaattcattttggttctattttaacttttagtaaaaaagaaaaggcactgagcaaaaagttcatcaagttagaaggataattaacaattctggttattttctgccactgcagcccatgtgatattttatttttatatatgtatgaatctgtgaattatatgcataatttctcttagcatttttttctgctaaaaatcagttaaatggtaggttctcaaagatttcwttctacaagttatgatctcacttcaaaataatccaaaacaaaataaaaggctaagccattcagaaatttcttcacccagagtctctcttcagagtttagagttacatatttgtattaagattttagcaggccattcttggctataatctcaactaggaaaggaaagctgccaaagattttttagtcctgggctcagggaagcaatggagaaccaattacataatgtttaaattgaaatttgctagattccctagggttttgggacacagaaacctgaactttttagtttcataaactact

SEQ ID NO: 65180 - DNA, 601 bp, Human
aaaagactttcattatttttgtttttgattgctcctgtggagcacggctacaccataggcaatgtgccaggggtaacctttatttatttttttttttagagatggagtctcacattgttgcccaggctggagtgcagtggctatgcacaggcataatgatagctcactacagcctggaactcctgggctcaagcaatcttcctgtctcagcctcccaagtagctgggactacagacaggtgccactacacccagtagacttaatttttaagagaagttttatgttcatagaaaaattgagaagaaggtacagagttctaccatatctccccacccatgcacagtctcttccaatatcaacatccggcacccaaatggttcatttgctacagtagataaatctgcattgacacatcattttcattcaaagtacatagtttccattggggctcacacgtggtgtttaccttctctgggtttggacaaatgtatgatggcatgcatccatcattatgctattacacagaaaattttccctacccaaaacatcctctgtgccctgcctattcatctctccttccccccaaccccaggtaactact

SEQ ID NO: 65181 - DNA, 601 bp, Human
cccgaggccctgatttctacccaagaaaccctattttatcatagagacagaaagtaggatgatggttgccatgggctgcagggaggaagaaatggggagttttgtttaaaaggtacagcgtttttacaagatttttacttggttttacaagattaaaagagttataaacatggggccgggtgcggtggttcatacctgtaatcccagcactttggatggctgagatgggaggatcaattgaggccaggagttcaagaccagactggtcaacatagtgagaccccgtctccattgtgtttaractttcgtctttttcaaaaaaaaaaaaaaaggatggatggtggtgatggtgggacaacactaggaatgtatttaatcacattgggttatatgctgcttacaaatggttaagatggcaaaatttgccgggcgtggtggctcacgcctgtaatcccggcactttgggaggccgagcgggtggatcacagggtcaggagatcgagaccagcctggcaaacatggtgaaaccccatctctactaaaaatacaaaaattagccgggcgtggtggcaggagcctgtaatcccagctacttgggagg

SEQ ID NO: 65182 - DNA, 601 bp, Human
atttttacttggttttacaagattaaaagagttataaacatggggccgggtgcggtggttcatacctgtaatcccagcactttggatggctgagatgggaggatcaattgaggccaggagttcaagaccagactggtcaacatagtgagaccccgtctccattgtgtttaaactttcgtctttttcaaaaaaaaaaaaaaaggatggatggtggtgatggtgggacaacactaggaatgtatttaatcacattgggttatatgctgcttacaaatggttaagatggcaaaatttgccgggygtggtggctcacgcctgtaatcccggcactttgggaggccgagcgggtggatcacagggtcaggagatcgagaccagcctggcaaacatggtgaaaccccatctctactaaaaatacaaaaattagccgggcgtggtggcaggagcctgtaatcccagctacttgggaggctgaggcaagagaatcgcttgaatctgggaggcagaggttgcagtgagctgagatcgcgccactgcactccagcctgggcgacagagcaagactcatctaaaaagaaaaaaagatggtaaaatttatttt

SEQ ID NO: 65183 - DNA, 601 bp, Human
gtggtggctcacgcctgtaatcccggcactttgggaggccgagcgggtggatcacagggtcaggagatcgagaccagcctggcaaacatggtgaaaccccatctctactaaaaatacaaaaattagccgggcgtggtggcaggagcctgtaatcccagctacttgggaggctgaggcaagagaatcgcttgaatctgggaggcagaggttgcagtgagctgagatcgcgccactgcactccagcctgggcgacagagcaagactcatctaaaaagaaaaaaagatggtaaaatttattttwtatgcatttcaccacaacaaaaaattttggaaaacaagccctatcatcactgccatcactttgatccactagaaagtgagatcaaggccaggaaaacacaggcaagtgctagaaatcactgcaacctgggatcaggggaggagtgaggagtagccgctgactgtgttggatctgaggatctgtggagggccattttcagggggtgttcatagggtaattgtgttggattcactcagttgttcactggacaaacatttattgagcaccaacaatattccaggagttgtgctaagtgctggg

SEQ ID NO: 65184 - DNA, 601 bp, Human
tccctgcccctgatttctctccctccccattgtcctcacgccaatgtgccctgctccaactgtacctcccaggaagcatctcttcatctccctgagctcccccaggctggagcaggggtcccttctctgtgctcaaaagcacagcgccctacatttggcagctgtgttcatgcctgttcctccaactagggcgtgagctctttggaaggcaaacaaagaccaagacctacctcgtgtctgtgtctgtctgggctccaggccttgccctggggctgccctccctggctctgggcccagcccgaagcttagctccatttctttttgtttttctttttctggagaatggggtcttgctatgttgccctggctgatctcaaactcctgtgctcaaaggatcctcccacctctgcctccttaagtgctgggattccaggcgtgagccaccgcacccagccctagctccatttctgcgccacaaccttctggctgcaaaactcagcctctcccacctcaaatcccagcccaccagacatttctagatctccatagtgacagagagggggacccatgggacacttctgttctggctggctctcctggc

SEQ ID NO: 65185 - DNA, 601 bp, Human
tgcctgttcctccaactagggcgtgagctctttggaaggcaaacaaagaccaagacctacctcgtgtctgtgtctgtctgggctccaggccttgccctggggctgccctccctggctctgggcccagccccaagcttagctccatttctttttgtttttctttttctggagaatggggtcttgctatgttgccctggctgatctcaaactcctgtgctcaaaggatcctcccacctctgcctccttaagtgctgggattccaggcgtgagccaccgcacccagccctagctccatttctgygccacaaccttctggctgcaaaactcagcctctcccacctcaaatcccagcccaccagacatttctagatctccatagtgacagagagggggacccatgggacacttctgttctggctggctctcctggcctgcactctcgtggtggaggcagggagaagtggctcacagcaacctttgcagggcagttttagagacgagtggggaaacaggactgatagaaataaagtgaggaaacggagacagggagcatagatcattctttccgaaagctggggcgaaagggaagccatctggcagg

SEQ ID NO: 65186 - DNA, 601 bp, Human
gaagggccttccaggaggagggactgagaagagcagtagggtctgaaacacaagggtgtttctagaagagaaacaatccattcaggaattcaggaatgttaggagtcaagaagggtgtgaagacgaatggggctggatggcttggccacggccaagttggtgaaaatgatgtctaaggagctggatttttgtcctgaggtcactggagaaccaggagagtttcagcagaggagttagagaggagtctgttgtaaaaaatcaccctggctgctgggtggaggagggacaagaaagggtgacrctggaggcagaggagccttgtgaggcccctggaggctaggaccagggcagtggcagtgggtgtggggagaagcggactgggttaggggatgaggaggagatggactgagcaggacttggtgatttactgggtggctggtggagcatgaagaagagggcacttctgagctttctggcgtgggcataggctctcgtggtgccggccctaggtctcatcactgtgcatggggctcattgatgtgagctgagcagaggtggacagagagaggtgacacagccctcatgtagtgctgaggcccct

SEQ ID NO: 65187 - DNA, 601 bp, Human
gccggcgcttcaaggtcaatgtgaaaggtcagtgatgtcctaggtccacagggaatggacggtgagcagagtaggctctagatgatgctgctcaggctggagatactagcaggaaggacaaggacatctaaggtcatagcctagcaccagacaaaaagcggggttgtggtcaaccagaggtccgggctgggcagtgtcaaggctggagtacagcttagacccatctggaaaggacatcccgtgccccagaaactggggacactctccagccccgcccttcctcctgcccagccatgctgtsccccaccaaccgtcacacacagacaagtatacctttaactctgctctgggatgctgcctcccatctctgagtcaccccacagacactcagtgctagcccaggggagcatatggggctatggagctcagagggtgaccagcttggcttcctagaagtggtgcatgcctagaaatcttccaggtaaataaggagggacctcccagtgcccaagattactcagaccagagcacccccacctgctctaaggcctccttcgccttctccagcttctccagcaccctaagtcttaaccattcacac

SEQ ID NO: 65188 - DNA, 601 bp, Human
tacagtgagcaggagagggagggcaaatggtgcgagggggctgaagggagcatggcagcttctagaagaggtgggggctgaataatgtgtgctttacaccccacgcccagtggaccccagtgagaacgtgacgttaatgaacctgaggccaaagacaggatacagtgttcgtgtgcagctgagccggccaggggaaggaggagagggggcctgggggcctcccaccctcatgaccacagactgtcctggtgagaggccaagagtcatcccttcctgtccccccaagggttactttcctgtygaccccagggacccctgcctttcccactggaggttgttcttccttgttcactggggatcattgtcctgtccagccccaagtacctactggacagttctgacccctgacctctggccccagagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgca

SEQ ID NO: 65189 - DNA, 601 bp, Human
tcccagggctgggaaaatcatgtcgcccctctgacacccctcatcccttccttcatgtggcccaagtgatttcctgacagtcctggcactgggatctttcacctctccctctgtgtaaccccatggtggcctctgggttccctgacccaggtgtccccacaatctgcccctctcactgtgtccagggctgcaggctgagggcccagtccaagagagccgggcagctgaagagggcctggatcagcagctgatcctggcggtggtgggctccgtgtctgccacctgcctcaccatcctggcygcccttttaaccctggtgtgcatccgcagaagctgcctgcatcggagacgcaccttcacctaccagtcaggctcggtcagtgacccgccccgcccctgggtgcatgcttgcagcccgtgtttatgtttctacctgtgtacacacaataccttgtacaccttgtgtgtgtgtgtgtgtgtgtgtttatgttgcaggtataagattacactcaacaatgttcaagggtacaaaatataattttctttatttctctaaaactgaattcagctcatgagcccatttatattagtggtgaaatat

SEQ ID NO: 65190 - DNA, 601 bp, Human
acttgggaggctgaggcaggagaatggcgtgaacccaggaggcagagcttgcagtgagccgagatctcgccactgcactccagcctgggcgacagagcgagactctgtctcaaaaaataaataaataaataaataaataaataaataaaaatacaaaacattagctgagcatggtggcacacaccagctacaagggagactgaggtgggaggaccacctgatcctgggaggttgaggctgcagtaagccactgcactccagcctgggtgacagagtgagaccctgtctcaaaaaaaaaaamaaaaacaaaacaaaacaaaagagctctaattgtgctgagcccagggatgggggcagtatgaaggagcttcattggcgcagagacaacagctggccaaggccagatacttacagagtagacacatacagcggggctgggaggcactgcacatcttgggcaggtagaagctaaactgctagggaccagggcctagaaggtaactaagtgcatccttcttatttcagctggtcctttggagtccttctttgggagatagtgagccttggtgagttcctgatccccgtcccccagagtgcccca

SEQ ID NO: 65191 - DNA, 601 bp, Human
gaggctgaggcaggagaatggcgtgaacccaggaggcagagcttgcagtgagccgagatctcgccactgcactccagcctgggcgacagagcgagactctgtctcaaaaaataaataaataaataaataaataaataaataaaaatacaaaacattagctgagcatggtggcacacaccagctacaagggagactgaggtgggaggaccacctgatcctgggaggttgaggctgcagtaagccactgcactccagcctgggtgacagagtgagaccctgtctcaaaaaaaaaaaaaaaaamaaaacaaaacaaaagagctctaattgtgctgagcccagggatgggggcagtatgaaggagcttcattggcgcagagacaacagctggccaaggccagatacttacagagtagacacatacagcggggctgggaggcactgcacatcttgggcaggtagaagctaaactgctagggaccagggcctagaaggtaactaagtgcatccttcttatttcagctggtcctttggagtccttctttgggagatagtgagccttggtgagttcctgatccccgtcccccagagtgccccaccttac

SEQ ID NO: 65192 - DNA, 601 bp, Human
tgaggcaggagaatggcgtgaacccaggaggcagagcttgcagtgagccgagatctcgccactgcactccagcctgggcgacagagcgagactctgtctcaaaaaataaataaataaataaataaataaataaataaaaatacaaaacattagctgagcatggtggcacacaccagctacaagggagactgaggtgggaggaccacctgatcctgggaggttgaggctgcagtaagccactgcactccagcctgggtgacagagtgagaccctgtctcaaaaaaaaaaaaaaaaacaaaamaaaacaaaagagctctaattgtgctgagcccagggatgggggcagtatgaaggagcttcattggcgcagagacaacagctggccaaggccagatacttacagagtagacacatacagcggggctgggaggcactgcacatcttgggcaggtagaagctaaactgctagggaccagggcctagaaggtaactaagtgcatccttcttatttcagctggtcctttggagtccttctttgggagatagtgagccttggtgagttcctgatccccgtcccccagagtgccccaccttaccccac

SEQ ID NO: 65193 - DNA, 601 bp, Human
gcagcctcgaaactgtgacgatgaagtgtgagtcaccccatccttgagctccatgatcctatctctgtgatgagtgacctcagctttgatccctgtgaccccatcaccccagctggcctgactcctcatctcagcaatgccccctcgcaggtacgagctgatgcgtcagtgctggcgggaccgtccctatgagcgacccccctttgcccagattgcgctacagctaggccgcatgctggaagccaggaaggtgaggagactggggctgaggtggcgggctgggctcacagagtgctccagrgtgccctctcagaggtgccatgacccctgtcccaaccacactgcctgcccaacctccctcagtgggggctgtcaccacggctaggctgggccccaggatgcagcctgcctttccagccctcactggtttagacaccaggcccttccaaaactcttccaaggccactgcttagccccaacagcaaatccctaccttaagccccaagtcccagactgcttgcctgtcctctgctgaggccatcagcctgtcctcatctgggacacctctccccacctgccagagccagagcagagtgcatga

SEQ ID NO: 65194 - DNA, 601 bp, Human
tgaataagtgaattatcaaataaatataatgaaaaatatatcaaaattagtaaatatgaagagttcttcaagtaaattaatgattaaataaccatcttaagaatgaaggaatgatcaaataaccatataaatggatgagtcgtctaaaatggcttttgaacagataagttactgaatgaatgaacgcataagccaagaattcattgaaagagtgcatgtaaaaaccctcctctaacaatggcattgagagcctctcacctgaggccccaactgtggcctgatgccttcactgccctgggcyggtaaaggccactcttggccatggggccatcttaggtctccagaacaaatcagtgtcagttcaaatgcccccaccacatggaagtccaggagcttgaggccagatgcacccccattcctggcccccactaaagcttgctctgcccccaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttaca

SEQ ID NO: 65195 - DNA, 601 bp, Human
tgactgttctttggataataccatcttgctccttcactaccctttatgccaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttaycagaacagactgaaagtactctacagccaaaaggccactcctggctccagccggaagacctgccgttacattccttccctgccagaccgtatcctggatgcgcctgaaatccgaaatgactattgtaagtgcatccttatcctcgcctcatgcatggagaaagagggcctgggaccacacaaacaaggaagctcatgctcttctctccacctctgacagacctgaaccttgtggattggagttctgggaatgtactggccgtggcactggacaacagtgtgtacctgtggagtgcaagct

SEQ ID NO: 65196 - DNA, 601 bp, Human
tggagaaagagggcctgggaccacacaaacaaggaagctcatgctcttctctccacctctgacagacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcaggtgagacgtgtccagtgctgtcattctcaccagtcccartgggcttgcacagctggaggatattaatgccaagtcccaatctctgatcctagtgggcttctctctctagctatgggatgtgcagcagcagaaacggcttcgaaatatgaccagtcactctgcccgagtgggctccctaagctggaacagctatatcctgtccaggtcagtggtttttgttggtctatggtagtctgatatttgcccaccctacccttgactgtacacccctgaactgaaccagctctggcttgcttgcatttggtgctgccacagaacctgattcccttctttcctcct

SEQ ID NO: 65197 - DNA, 601 bp, Human
cttagggaaagtccctgacattcagaagatctaacctactcaccatttcggtattaatcctaactctatctctactgctaaatttcactggctaaaaaaataaacttttaaatttaaaaataaatgaaatgtcacttttccaaggatgactgtctcaatttctagttgcatcttttggctttcatctaaggccaaccccaatactcccccaaatctacagaataatcttgcaaaattggcacggatgcaggtttaatgcctggccaacctggacgaacatacccttgcataataatgggarccaatacaaagaaggcaaagattacaccccgtcccccatccacagtagcagttgtaaattttgtcaagtaataaattacttgacaagtaataaaataccagtacttatcgcctccatatctagaaatcaacattttacatttcccagtaaagagtgactggttcgctgctgccatttactaagaaggccagaatgacacacaggttcgcaaaacaccccttgttctaggcgcttccacggggtgacgctcaagtctctgaataaacgtcctctaaacaaaagtcctgggatctaaaaatg

SEQ ID NO: 65198 - DNA, 601 bp, Human
aaaacaaaaacaaaggccgggcacaatggcttatgcctgtaatcccagcactttgggaagccgagaggggcagatcacttgagctcaggagtttgagaccagcctggccaatatagtgaaataccatctctactaaaaatataaaacttagctgggcgtggtgacgcacgcctgtagtcccagctactctgaaggcggaggcaaaagaatcacttgaacctgggaggcagaggttgcagtgagccgagattgtgccactgcactccagcccgggtaacagagcgagactccgtctcaaaamaaaaacaaaaacaaaaacaaaaacaaaaagcctaaaaatactgactgggtcttccccaccaggatgtgtataagacagccttccaccttatgacctagctcagactgaagatgaccaggaaattaataagtattggagaattatctgcccataagcccagatgtgggctggatgcagtgcagaaacaaaggaagtacgtttttaaaaacgaatttgagaatgctgtcaaagggtggattggattgcatgcaattttaatcatgtatttatactcaaaaagtaaccctggccagacacagt

SEQ ID NO: 65199 - DNA, 601 bp, Human
tagccctaagaagccacccctttaagtcttcttagcaaaccaatcccactagctttgccatacaagtcgaatcaagttctggctgggcgcggtggctcatgcctgtaatcccagcatgttgggaggcagaggcgcgtgaatcacgaggtcaggagttcaagaccagcctggccaagatggtgaaaccccgtctctactaaaaatacaaaaattagccgggtgtggtggcaggcacctgtaatcccagctacttgggaggctgagcaagagaatcgcttgaacttgggaggcagaggttgcrgtaagccaagatcacaccattgcactccagcctgggcaatgagagcaaaactccatctcaaaaaaaaaaaaaaagagaaagtgctttgactagcctgggcaacatggcgaaaccccatctctacaacaggtacacaaattagccaggcatggtggtgaacgcctgtagtcccagctactcaggaggaggctgaggtgggagggttacaccactgcactcagcctgggtgagagagcgactgctgaaccttgggcaactcttgctgattcttgatgctcccttcaaaacctgtctcaaggc

SEQ ID NO: 65200 - DNA, 601 bp, Human
attaactagcccataacattacaatgggtggcaattttcacatctaactagctaaatgaaccaaggaaataggccctcaactttagccctaagaagccacccctttaagtcttcttagcaaaccaatcccactagctttgccatacaagtcgaatcaagttctggctgggcgcggtggctcatgcctgtaatcccagcatgttgggaggcagaggcgcgtgaatcacgaggtcaggagttcaagaccagcctggccaagatggtgaaaccccgtctctactaaaaatacaaaaattagccrggtgtggtggcaggcacctgtaatcccagctacttgggaggctgagcaagagaatcgcttgaacttgggaggcagaggttgcggtaagccaagatcacaccattgcactccagcctgggcaatgagagcaaaactccatctcaaaaaaaaaaaaaaagagaaagtgctttgactagcctgggcaacatggcgaaaccccatctctacaacaggtacacaaattagccaggcatggtggtgaacgcctgtagtcccagctactcaggaggaggctgaggtgggagggttacaccactgcac

SEQ ID NO: 65201 - DNA, 601 bp, Human
ctagtatccagtaaacaaatggtaagcaattaactagcccataacattacaatgggtggcaattttcacatctaactagctaaatgaaccaaggaaataggccctcaactttagccctaagaagccacccctttaagtcttcttagcaaaccaatcccactagctttgccatacaagtcgaatcaagttctggctgggcgcggtggctcatgcctgtaatcccagcatgttgggaggcagaggcgcgtgaatcacgaggtcaggagttcaagaccagcctggccaagatggtgaaaccccrtctctactaaaaatacaaaaattagccgggtgtggtggcaggcacctgtaatcccagctacttgggaggctgagcaagagaatcgcttgaacttgggaggcagaggttgcggtaagccaagatcacaccattgcactccagcctgggcaatgagagcaaaactccatctcaaaaaaaaaaaaaaagagaaagtgctttgactagcctgggcaacatggcgaaaccccatctctacaacaggtacacaaattagccaggcatggtggtgaacgcctgtagtcccagctactcaggaggagg

SEQ ID NO: 65202 - DNA, 601 bp, Human
gtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggctttgttttcattggcttcttttttcctcgttttactctgttttatgctgggcacagctttattaatagtacatcacttygctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttt

SEQ ID NO: 65203 - DNA, 601 bp, Human
ggggagattaataaaagttggacaaacagtggcaatccttcaatttttactggcatagtccctgacaaaaatttaatttttaccaactttgaagtaatattgaaaaaaacaaaacaaaacaagaagacacactatttacctataattgcaaaccaaaaagaaaagtggcaaatggcagcttagatattctctggctaaatgtaggtagcagataatagagtgttaaagtagaaatgtgtcttccctatagactggacctttctggatataaagtaagagatgtatcaagtttctttttttygattttgagacagagtctcgctctgtcgccaggctggagtgcagtggcgtgatctcagctcactgcaacctctgcctcccaggttcaagcgattcttctgcctcagcctcccaagtagctgggattacaggcgtggaccgccacgcctggctaatttttttagcatttttagtagagatggggtttcaccacgttggccaggctggtctcgatctcctgacctcgtgatccacctgcctcggcatcccaaagtgctgggataacaggcgtgagccaccacaccaggccgagatgtatcaa

SEQ ID NO: 65204 - DNA, 601 bp, Human
tgccactgcactccagcctgggcgacagagtaagactccgtctcaaaaaaataaatacataaaaataaaaataaataaaaatacaaaaattagccaggcgtgatagtgcacgcctgtaatcccagctacttgggagactgaggcaggagaatcacttgaacctgggaggcggaggttgcagtaagctgagattgtgccactgcactcgagcctggtaaaaaaaaaaaaaaaaaagaaaaagaaaaaagaaaaaacaattattacatagtaaaatttaaatatatattattttatttgtcarttatagctcaataaagctggggaaaaatctgttaacacttaaaaaaaaatacaccaggacaccaaaagcacaggcaacaaaagtaaaaatacagagggtagatctcatgttaagtgttcttaccacaataaaacaaaaatataaagtatatctcttatttaaaaaaagtaaaaaatagataaattggactacgtcaaaattagaaacttctatgcatcaaaagacacaatcaacagagtgaaaaggcaacccatggaatgggagaaatatttgcaaattatattatctgataaggggtaa

SEQ ID NO: 65205 - DNA, 601 bp, Human
agtagaaatcctgggtcaaagattatgctcatgtttagagctactgatacagtagtgacagcctattactgagaaccaagatccaagctagaattcctcaagtagttttcaattttgcagtaactaatttcattttttcgtattttcaagtcaaaatttttttaggaatatgaacttattactagaaaataccaattgaccttcaaaggcttaccactgtctaaacattccttatcagtcatcgaactttttgtatttatattacatttgtgtgaaactaaataggtcaaagaatttttcycactttaatggattctcataatgctgtgaggcaggtattaccatctgcaatttacagtaacagtctcagagaaactagtaacttccctgaagtcacacagctagcaactgatggaggtaggagacttaggtactgtgatgaaaagactgttgccctgattctttttgcccacttacctattaattctctattttttgcttctatttcctctagcagtgtctctggagtagatgtcattttctcattatctgtggcataactttccaaaaactttctatattctggatctaaataatcatt

SEQ ID NO: 65206 - DNA, 601 bp, Human
caaaaaaaacaaacaaacaaacaaaaaaaccccacatattccttaggataaattcctgagtagaaatcctgggtcaaagattatgctcatgtttagagctactgatacagtagtgacagcctattactgagaaccaagatccaagctagaattcctcaagtagttttcaattttgcagtaactaatttcattttttcgtattttcaagtcaaaatttttttaggaatatgaacttattactagaaaataccaattgaccttcaaaggcttaccactgtctaaacattccttatcagtcatygaactttttgtatttatattacatttgtgtgaaactaaataggtcaaagaatttttcccactttaatggattctcataatgctgtgaggcaggtattaccatctgcaatttacagtaacagtctcagagaaactagtaacttccctgaagtcacacagctagcaactgatggaggtaggagacttaggtactgtgatgaaaagactgttgccctgattctttttgcccacttacctattaattctctattttttgcttctatttcctctagcagtgtctctggagtagatgtcattttct

SEQ ID NO: 65207 - DNA, 601 bp, Human
tttcagaggccaaggcaggcggatcacttgaggtcaggagttcgagatcagcctggccaacatggtgaaaccccggctctactaaaaatacaaaattggccgggcgtggtggcggacacctgtacttccagctactcgggagactgcggcagaatcgcctgaacccaggaggcggaagttgcagtgagccgagattgcgacactgcactccagcctgggcgacagagcaagactccatctctcacacacacacacacacacacacatacacacacacacacacacacacacagagagagagcgagcgagcaagcaagcaaaaaaaacaaacaaacaaacaaaaaaaccccacatattccttaggataaattcctgagtagaaatcctgggtcaaagattatgctcatgtttagagctactgatacagtagtgacagcctattactgagaaccaagatccaagctagaattcctcaagtagttttcaattttgcagtaactaatttcattttttcgtattttcaagtcaaaatttttttaggaatatgaacttattactagaaaataccaattgaccttcaaaggcttaccactgtctaaac

SEQ ID NO: 65208 - DNA, 601 bp, Human
ctgctgctcacagattcccagatatatgcaggaagatactacgggagtcatgtgagagggaaaggcacatattgcagggtatttatccctagtcctcccacaaggcagccagttatgagaagcatataagaagatgagaaagaactatataggcatggttgtcctctggctgtaggtcaatgaagcttctgggcacacagcagagcatcaggaagtcacctgggcttccttttaaagtagaaatttataataaaatagctcagcttttaagaagactcaagtcaacctgaaggggttttcmacaagtaacactaccaccaccaccaccaaaaggacttattagctaagacctgtgtgtgtgacatgatactagatgctctgtatcatgtacttggtccttacatttttctgattcacagcttgtaacagaaacctgtgtacctgaagacagtggaaaacaaacagatgaggtaacttcatgtatcaattatgaagaaaaagctgaaaaaaaaccataaatcatgccagccagccctaagccctcatttactatgaatttagaggacaatagtctaaaaatccaacattttcaatgacaaaa

SEQ ID NO: 65209 - DNA, 601 bp, Human
cagccactgcaaatggtgagtccaaaatggacactgagaaggcaccagtgtaaaatgaggataccatgtgcaggtttcattggaagtgctcttatttctccaatgaacatccttattagaaaccaaggtgttcattactctaataagaacattaatgaatgtctctagcatggctggctctaccttctgccttgctgattgttaggaatagcaagtcaagtcacttgtggcatagcagacagagagattgctggaaagaattaagatgagaaactccatcctcccccaagcccctcatcaycagtaatgagccccgtagagacttagggaacccttgctacataaactgctgagttttcaggaaataaaataaggagaccctgccaccctctctgtgagattttctttgactttatctgaagtgctaggtactagtacttccccaggaaatatgttgaaacaagggctgcccaagccatgcccttagaagggaagtggcaaggttgggatctttctgcaggttttcttcttcccaaatgcaatgcatgaatccgaatctgctgctcacagattcccagatatatgcaggaagatactacgg

SEQ ID NO: 65210 - DNA, 601 bp, Human
gggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagagracagttgaagccacagaactgagaggccccgctatctgtccctccaagcagcccgaagtacatgcagccgccacttctgcctaccacctccggacagcccgagcacccctgaggccagtaacccccctacggggccagggcccggcacgaggcgtcggctgacctgtatggtttgtctgttgtagacttttaccacgtggaagttaaaactgtagatccctttgcgcggggcgatgaaagtgctgcgttctgaatcaaagttgttcccaatgttcactagtacctataacgagacgggaa

SEQ ID NO: 65211 - DNA, 601 bp, Human
ccctgcgtcgtttttgttttttgttttttgagacggagtctagctctgtcgcccaggctggagtgtagtggtgcaatctctgttcactgcagcctccacctcgcaggttcaagcaattctcctgcctcagcctccctagtagctgggattccaggtgcgcaccaccacgcccagctaatttttgtagttttagtggagatagagtttcaccgtgttgccctggctggccttgaactcctgacctcaaatgatcagccagcctcggcctcccaaagtgctggaattacaggcgtgagctgcygcgcccggccagtccctgcgtcacttgaggcgatgctgtcctcagatccctggctcagagttggcactcagcccatgtgaatggaggtcacggctgttttggtctttgcattgtggatgatgtcaggccagaggcctctcccctgccctgggaaaggtggggaaactgaaggcagggctgcctggcctaagacagagttacccccacagccagctgcgcagactgagatgttgcaggacccctcttggctcaccctcggctgcatagaaggcctcgaaccccgtgaacggcttctcgttg

SEQ ID NO: 65212 - DNA, 601 bp, Human
acctctgttaaaccagtgggagtttcagtgtccggcccgaggtcacccagctaatgaggggagtcaatcaaacccagggggcggggctacagcgctgaacccttgcagcagcttcctaaggagcagagaaattgagccacttgccagaggtcacacagttggtctctgcagggactgggatctgaaatcaaacatcctggcagcgctcccgctggcagggccccactttgtcagctgtaaatggggccctcggcccctgcgtcgtttttgttttttgttttttgagacggagtctagctcygtcgcccaggctggagtgtagtggtgcaatctctgttcactgcagcctccacctcgcaggttcaagcaattctcctgcctcagcctccctagtagctgggattccaggtgcgcaccaccacgcccagctaatttttgtagttttagtggagatagagtttcaccgtgttgccctggctggccttgaactcctgacctcaaatgatcagccagcctcggcctcccaaagtgctggaattacaggcgtgagctgccgcgcccggccagtccctgcgtcacttgaggcgatgctgtcctcaga

SEQ ID NO: 65213 - DNA, 601 bp, Human
gaccctcccaccccagagacacgcggcagcaggtggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctctggaagagagatcagagaggcaaggagagacaccgagagggagaaaccgagtcgggggaggcagggtcagcgccagcaggtggggctgcccacgccccagagcactggccygtcccacagtgcagggaaccagggaaccaggtcccaaggaacgagggctagatacccccgactctcccgtggctacatgaggggttcccagagcccaggtggaaccaggtacacagtgggatgttagaattagtctcagtcgctagggcagggtggcactgatgagcctggctgctgagaggggaagcagggctgagaaggggagctggaggcagcagggcctagaagcacccagtgtccagggcccaggccctccgcacccctgggcagagcagcaatggccctgaggagccccgggta

SEQ ID NO: 65214 - DNA, 601 bp, Human
caccccgccgcctcccgaccctcccaccccagagacacgcggcagcaggtggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctctggaagagagatcagagaggcaaggagagacaccgagagggagaaaccgagtcgggggaggcagggtcagcgccagcaggtggggctgcccacgycccagagcactggcccgtcccacagtgcagggaaccagggaaccaggtcccaaggaacgagggctagatacccccgactctcccgtggctacatgaggggttcccagagcccaggtggaaccaggtacacagtgggatgttagaattagtctcagtcgctagggcagggtggcactgatgagcctggctgctgagaggggaagcagggctgagaaggggagctggaggcagcagggcctagaagcacccagtgtccagggcccaggccctccgcacccctgggcagagcagcaatggccc

SEQ ID NO: 65215 - DNA, 601 bp, Human
ttacccctcaatgaatatctcccagggtgtctcctctgtgggtcaggctcctccaggccagaccctgaatgggggtggttcaagattactctgggctcagcctctggggacctggactcgagcgaggccttacccctctccgggcctcagtgccccatcttcaaaacagggggtgaggccaaggagcctgtggccccatggaggaggctcccacagacctggggttcatgaggctgtgaggagggtaggcagagaggagcgcaccccgccgcctcccgaccctcccaccccagagacacgyggcagcaggtggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctctggaagagagatcagagaggcaaggagagacaccgagagggagaaaccgagtcgggggaggcagggtcagcgccagcaggtggggctgcccacgccccagagcactggcccgtcccacagtgcagggaaccagg

SEQ ID NO: 65216 - DNA, 601 bp, Human
cccagctgcagtggggggcatttgagttgtgaggcctctaggaagtgaggagccccaacattgcctgccttcttccacgtggctgtgccctatggggcagtgggaatcacccctggatttgcgggggaccagattacccctcaatgaatatctcccagggtgtctcctctgtgggtcaggctcctccaggccagaccctgaatgggggtggttcaagattactctgggctcagcctctggggacctggactcgagcgaggccttacccctctccgggcctcagtgccccatcttcaaaacrgggggtgaggccaaggagcctgtggccccatggaggaggctcccacagacctggggttcatgaggctgtgaggagggtaggcagagaggagcgcaccccgccgcctcccgaccctcccaccccagagacacgcggcagcaggtggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctct

SEQ ID NO: 65217 - DNA, 601 bp, Human
cccctttccccaggtctgacccctgccctgggggctgctcctggaagttcaaggcaacagtgatcatgactgagtctggtgctctccttcctcgctggaacagctgatgctgctgccacgggcggggtgttgggctgggctctatccttcaaggaaggcttggtccccatcccataccaccaccccacccccagctgcagtggggggcatttgagttgtgaggcctctaggaagtgaggagccccaacattgcctgccttcttccacgtggctgtgccctatggggcagtgggaatcaccyctggatttgcgggggaccagattacccctcaatgaatatctcccagggtgtctcctctgtgggtcaggctcctccaggccagaccctgaatgggggtggttcaagattactctgggctcagcctctggggacctggactcgagcgaggccttacccctctccgggcctcagtgccccatcttcaaaacagggggtgaggccaaggagcctgtggccccatggaggaggctcccacagacctggggttcatgaggctgtgaggagggtaggcagagaggagcgcaccccgccgcctcccga

SEQ ID NO: 65218 - DNA, 601 bp, Human
taagggccccttcggagctcccctaaattcccttacagccaccccagtgattcccaagtttattcatcaggggtctcctacccgaacccagccaagaccagccagccccctgggttcctggaggaaccatccggaagaagggtctctcatcaccccctttccccaggtctgacccctgccctgggggctgctcctggaagttcaaggcaacagtgatcatgactgagtctggtgctctccttcctcgctggaacagctgatgctgctgccacgggcggggtgttgggctgggctctatccytcaaggaaggcttggtccccatcccataccaccaccccacccccagctgcagtggggggcatttgagttgtgaggcctctaggaagtgaggagccccaacattgcctgccttcttccacgtggctgtgccctatggggcagtgggaatcacccctggatttgcgggggaccagattacccctcaatgaatatctcccagggtgtctcctctgtgggtcaggctcctccaggccagaccctgaatgggggtggttcaagattactctgggctcagcctctggggacctggactcgagcgag

SEQ ID NO: 65219 - DNA, 601 bp, Human
aggcaggggagtgacttggcgtgccctctatcagccctcgcaccaacagcagggtggatgccttggggagcaggaaactgggacagggatgtggctgggacatctgcatccctgggttgggctgggccctgcaggtggccagcccctgaggcctacccagaaaccaaacgacccacccgatggctgaggggccgcttagagagggggtttctcttgctttgaggctttagctgaaacaggcagcactcgggatggagcgcacaggccctcactcacacccccagggagcgtggtggtgtcytgagccagagtcgcaaccccagggtaggggctagagcactgagttccaccaggctctgccagggcggggggcgggggtggatggacacacaggaaggaggaagaagggacactctccttggtccctgggaattcgggaaaagagaggagcatctcctcgagcctaagggccccttcggagctcccctaaattcccttacagccaccccagtgattcccaagtttattcatcaggggtctcctacccgaacccagccaagaccagccagccccctgggttcctggaggaaccatccggaag

SEQ ID NO: 65220 - DNA, 601 bp, Human
caggcgcccgccacctaataatttttgtatttttagtggagacggggctactacctcatctaatttttgtatttttagtggagacggggtttcaccacgttggccaggctggtcttgaactcctggcctcaagtgatctgcctgcctctgcctcccaaagtgctgggaatacaggtgtgagccaccgcgcctggccaagttgcccattttaatcaccagctttccaaactagctttaaaacaaagggctcgcttatgtaaatttaaagttaagtataaagaaagaaagaaaaaagggcggrattcagaatcacattttccatagccatcctttttgtcctctgaaaacttatttcttggctttttatcatttaaagatagacaaaagaaatcatgctgacacacgattttctcactttcctttcacatatctgcagatagaaatatgtttacatttcaaagcaatcgtcattgatcgtggtgtactttgttttaactcacttgcagaagctcatagccagtctcgcaaaagatggagaagctgtctttcaggatgtatttggcttgcacaggtgaaacgtggccattaggtggcgccatcg

SEQ ID NO: 65221 - DNA, 601 bp, Human
tacaggcgcccgccacctaataatttttgtatttttagtggagacggggctactacctcatctaatttttgtatttttagtggagacggggtttcaccacgttggccaggctggtcttgaactcctggcctcaagtgatctgcctgcctctgcctcccaaagtgctgggaatacaggtgtgagccaccgcgcctggccaagttgcccattttaatcaccagctttccaaactagctttaaaacaaagggctcgcttatgtaaatttaaagttaagtataaagaaagaaagaaaaaagggcrggattcagaatcacattttccatagccatcctttttgtcctctgaaaacttatttcttggctttttatcatttaaagatagacaaaagaaatcatgctgacacacgattttctcactttcctttcacatatctgcagatagaaatatgtttacatttcaaagcaatcgtcattgatcgtggtgtactttgttttaactcacttgcagaagctcatagccagtctcgcaaaagatggagaagctgtctttcaggatgtatttggcttgcacaggtgaaacgtggccattaggtggcgccat

SEQ ID NO: 65222 - DNA, 601 bp, Human
ttacaggcgcccgccacctaataatttttgtatttttagtggagacggggctactacctcatctaatttttgtatttttagtggagacggggtttcaccacgttggccaggctggtcttgaactcctggcctcaagtgatctgcctgcctctgcctcccaaagtgctgggaatacaggtgtgagccaccgcgcctggccaagttgcccattttaatcaccagctttccaaactagctttaaaacaaagggctcgcttatgtaaatttaaagttaagtataaagaaagaaagaaaaaagggmgggattcagaatcacattttccatagccatcctttttgtcctctgaaaacttatttcttggctttttatcatttaaagatagacaaaagaaatcatgctgacacacgattttctcactttcctttcacatatctgcagatagaaatatgtttacatttcaaagcaatcgtcattgatcgtggtgtactttgttttaactcacttgcagaagctcatagccagtctcgcaaaagatggagaagctgtctttcaggatgtatttggcttgcacaggtgaaacgtggccattaggtggcgcca

SEQ ID NO: 65223 - DNA, 601 bp, Human
ccactatttataactttgcagaatatactctttcccggggctgtctacttttttgtgggcccaggagttgtttcatggaaaggtcatttgaccagggggagaactttaatttgatgcaagactgggcacatggaacaggatagcaaactcatctttctgtcattccagccacttcacaaagagctgctgtcgtgtgtgaccaacagaaaagttgcccgttttattttattttatatatttttttgagacagagtcttgctctgtcacccaggctggagtgcagtggtgtgatttcggctcrccgcaacctgcgcctcccaggctcaagtgattctcctgcctcagccacccgagtagctgggattacaggcgcccgccacctaataatttttgtatttttagtggagacggggctactacctcatctaatttttgtatttttagtggagacggggtttcaccacgttggccaggctggtcttgaactcctggcctcaagtgatctgcctgcctctgcctcccaaagtgctgggaatacaggtgtgagccaccgcgcctggccaagttgcccattttaatcaccagctttccaaactagctt

SEQ ID NO: 65224 - DNA, 601 bp, Human
ttatataaagtgacagaggaccaggcgcagtggttcacacctgtaatcccagcacattgggaggccgaggtgggaggattgcttgagctcagaagttcaagaccagcctgggcaacatagtgagacccccacctctacaaaaaagacaaaagttagccgggcgtgttggcgcttgcctgtagtcccagctacttgggaggctggggtgagaggattgcttgagcctgagaggtcaaggctgtggtgagctgtgatcgtgccactgcactccagcctgggtgacaaagtgagaccctgtccaaaaaaaaaaaaaaaaaagccagaggactgtggtgacaagtttgagaaagcaggtgtgatcagacttgcaagtgtgtctgtgtatctgtctagctggtggccattagctggaggagggctactaagagttcttttgtgagcttcgtctgtgtgctgtccatcagctttcaccgccagcgtcattcacagggaaacatttttcgacttgctaagataatgtttttctaaaatcaaacattaaaataaaagaagatggctttggcagaaaccctgtgccgcaaaggatttcaggtcttcttgt

SEQ ID NO: 65225 - DNA, 601 bp, Human
ggatgcctggcacatggacgcactgccccaccgcctcggtgcacgtctatgccacctaggttacgtatttcatcactcaacaggtattggcattttatgaatcagatggaacctttgcagcaatttataattttttttttgcttttcaccctaatacaaaaacatatcagatctcagccaggtgcggtggctcatgcctgtaatcccgacactcctggagaccaaggcgggtggatcacttgaggtgaggagttcaagaccagcctggccagcatggtgaaaccctgtctctactaaaaawatacaaaaaattagcctggcatggtggcgtgcacctgtaatcccagctcctcaggaggttgaggcaggagaattgcttgaacctgtgaggcgggggttgcagtgagccgatattgcaacactgcactccagcctaggtgatagagtgagaccctgtctcaaatcatcatcatcatcatcatcatcatcatcatatctcaacatttctgcatctgatgttccaccatttctttatataaagtgacagaggaccaggcgcagtggttcacacctgtaatcccagcacattgggaggccgagg

SEQ ID NO: 65226 - DNA, 601 bp, Human
agcaagaccctgtctcagaaaaaaaaaaaaaaagggaaagaaaaaagaaagtaaacagaaaaccagagaagcaatagaagcagcaacagtagcagcagagggagttccgggcggttatggggcctgtagtcaccacacgaccgtactgctgcacgcgggcattggccggtcccaagatccatctttctgacaaactgcagtaaaggatttcaggggcaagtgaccctaaagaagaattcagaatatattaatttccttgtttatatcataaaatcactccccaaagctgtgctctcacagyagttcctattctagtgttttacgaggtgctcctgaagggggtggcagcacacatgactagtatctgcgtgtgctggggttggggggatgcctggcacatggacgcactgccccaccgcctcggtgcacgtctatgccacctaggttacgtatttcatcactcaacaggtattggcattttatgaatcagatggaacctttgcagcaatttataattttttttttgcttttcaccctaatacaaaaacatatcagatctcagccaggtgcggtggctcatgcctgtaatcccgacactcct

SEQ ID NO: 65227 - DNA, 601 bp, Human
gagaatctcttgaacccgggaggcagaggttgcagtgagccgagattgtcaccgcactccagcctgggtgacagagtgagactccgacacacacacacacacacacacacacacacacacactctctctctctctctctcacacactttgggaggcccaggtgggcagatcacctgaggtcaggagttcgagatcagcctggccaacatggtgaaaccccatctctactaaaaatacaaaaattagccgggtgtagtgacatgtgctggtagtgcctcccagctcctgggggtagctgacrtgggagaatcgcttgaacccaggagacagaggttgcagtgatctgagattgtaccactgtactccagcctgggcaacagaatgagacccttctcagaaaaaaaaaaaaaaaaaaaccttgtcaaagaacatatttttctaaagcacataccttccctagtaggttggttctgttttaacctctaagaatgcactgagagatgagtaaaaagaagcaaatttgaaattcaagggctgataaatggatcattaaaaaaaaaaaaccaaggatccgggcacagtggctcacgcctgtaatctt

SEQ ID NO: 65228 - DNA, 601 bp, Human
acaccaaaacggtaacgattaggccgggcctggtggctcacacctgtaattgcagcactttgggaggccaaggtgggtggatcacttgagattaggagttggagacaagcctgggcaacatggtgaaaccctgcctctactaaaactaaaaaaattactgggtgtggtggcgggcgcctgtaatcccggctactggggaagctgaagcaggagaattgcttgaacccaggaggcagaggtttcagtgagtcgagattgtgccactgcactccagcctgggcgacagaatgagaccccgtcaaaaaaaaaaaaaaaagtggctggtcacggtggctcacgcctgtaatcccaacactttgggaggccaaggcaggtggatcacttgaagtcaggagttcaagaccagcctggccaacatggtgaaacctcgtctctactaaaaatagaaaaattagctgggcttggtgggaagtgcttgtaatcccagctatttgggaggctgaggcaggataattacttgaacccgggagaaggaggttgcagtgagccgagatggcgccactccactccagcctgggtgacagaacaagactccgtctca

SEQ ID NO: 65229 - DNA, 601 bp, Human; identical to SEQ ID NO: 27810

SEQ ID NO: 65230 - DNA, 601 bp, Human; identical to SEQ ID NO: 27811

SEQ ID NO: 65231 - DNA, 601 bp, Human; identical to SEQ ID NO: 27812

SEQ ID NO: 65232 - DNA, 601 bp, Human; identical to SEQ ID NO: 27813

SEQ ID NO: 65233 - DNA, 601 bp, Human; identical to SEQ ID NO: 27814

SEQ ID NO: 65234 - DNA, 601 bp, Human; identical to SEQ ID NO: 27815

SEQ ID NO: 65235 - DNA, 601 bp, Human; identical to SEQ ID NO: 27816

SEQ ID NO: 65236 - DNA, 601 bp, Human; identical to SEQ ID NO: 27817

SEQ ID NO: 65237 - DNA, 601 bp, Human; identical to SEQ ID NO: 27818

SEQ ID NO: 65238 - DNA, 601 bp, Human; identical to SEQ ID NO: 27819

SEQ ID NO: 65239 - DNA, 601 bp, Human; identical to SEQ ID NO: 27820

SEQ ID NO: 65240 - DNA, 601 bp, Human; identical to SEQ ID NO: 27821

SEQ ID NO: 65241 - DNA, 601 bp, Human; identical to SEQ ID NO: 27822

SEQ ID NO: 65242 - DNA, 601 bp, Human; identical to SEQ ID NO: 27823

SEQ ID NO: 65243 - DNA, 601 bp, Human; identical to SEQ ID NO: 27824

SEQ ID NO: 65244 - DNA, 601 bp, Human; identical to SEQ ID NO: 27825

SEQ ID NO: 65245 - DNA, 601 bp, Human
gtgccctgatctctgatcctgaacagtgaactagccattgcctcttgactttcctcactggtagcctttatccttgtggtgaggttgaggctacacccagcgcccccttccctatacttaggtcggggtgggagttcttttgatctgatgtcttccctagtgaggtggacaaggtcctgtcaggcctggagatcctgtccaaggtgtttgaccagcagagctcgcccatggtgacccgccttttgcagcagcaggtagattgtagggagacctctgggaggtgcgttcgtgttctggagcygggtgggaggctctgcttaggtgactcatgtacaagcctggttcttcctccccccagaacctgccacagacaggggagcaggaactagagagcctggtgctgaagctgtcagtgctaaaggacttcctgtcaggcatccagaagaaggtggcatgatctctgacccttgacccccgattcactggccactgtcattggcctagcactgatctcaaccctcagtctacaacttaacattggccccaaggtcaattgtgtccctccctgccccagccttcagtgtgtcccctgaccccgccc

SEQ ID NO: 65246 - DNA, 601 bp, Human
ccctgccccagccttcagtgtgtcccctgaccccgccctgcccttgttccctccaggccctgaaggccctacaggacatgagctccacagcacccccagctccgcagccatccacacgtaaggccaagaccatccccgtgcaggcctttgaggtacatggcagtggggcctcacagggccaagggtggttggaggtgaccagggtgctgcctactccaaggtcttgtcagcagcctccccacctggcctacaggtgaagctagatgtgaccctgggtgacctgaccaagattgggaagtcrcagaagttcacgctgagcgtggatgtggagggtgggcggctggtgctgctgcggagacagcgggactcccaggaggactggaccaccttcacgcacgaccgcagtgagccagggccagacctgggaggggtgggcagggcggagcccctggcctaggggcacaggcccatgtgaccggtcctccatgccctagtccgccagctcattaagtcccagcgtgtccagaacaagctgggtgttgtgtttgagaaggagaaggaccggactcagcgcaaggacttcatctttgtcagtgcccgg

SEQ ID NO: 65247 - DNA, 601 bp, Human
ctcacagggccaagggtggttggaggtgaccagggtgctgcctactccaaggtcttgtcagcagcctccccacctggcctacaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcagtgagccagggccagacctgggaggggtgggcagggcggagcccctggcctaggggcacaggcccrtgtgaccggtcctccatgccctagtccgccagctcattaagtcccagcgtgtccagaacaagctgggtgttgtgtttgagaaggagaaggaccggactcagcgcaaggacttcatctttgtcagtgcccgggtgagcagcaggctgggccaggccactggggactgcgggggtcccccacatgggtgcttcccattggagggtaagaaagggaacacatgatgtaggcatgccatccctcctggcaggggtaggtctgacagggtagagggtgttgagaacgggtggcctgagggtggat

SEQ ID NO: 65248 - DNA, 601 bp, Human
ggtgagcagcaggctgggccaggccactggggactgcgggggtcccccacatgggtgcttcccattggagggtaagaaagggaacacatgatgtaggcatgccatccctcctggcaggggtaggtctgacagggtagagggtgttgagaacgggtggcctgagggtggataacatttgccagcactgttatatgcttgagcagtgggtatgcagtggagaaccagacagaccctctcctcatggacatgagccaactggcagggtatccctgtggacggggggcttcctggatgcctaccygcccctgagtggctgctgttcccccagaagcgggaggccttctgccagctgttgcagctcatgaagaacaagcactccaagcaggacgagcccgacatgatctcagtcttcataggcacctggaacatgggtcaggcccgggctggggctggggcgggagagagggatggccccagagcaggtgcctaacccctccagacccacctcacccccttcacctccaggaagtgtaccacctccaaaaaacgtgacatcctggttcacatcgaagggtctggggaagaccctggacgaggtcac

SEQ ID NO: 65249 - DNA, 601 bp, Human
ccaacggggaggcccccagccccaccccgagcagctccccgggaggagcccttgacccccaggtgagaggaggaacctgtcaccgcccccccttcccccacccacctctatccatcactatcccctgcagggtctcagggttggcctggagatcatcagctgcttaggtgccctgccactctgtggttggagctgccatggccttatgcctgtggccagccaggccacccttagctgtggctctgagtcaaagggagcagtcagcctttcctctcaattctgcctttaaaaatggaatgcraaattgtttctaagacagctccctccatgtaaacagacctagcttgagccttctatttggaggaggcacatggctcggcctgggatttcccagggtaccttctttggaactctgtcctgcaagaggccccagttgaaatgggtttgtggtcaaatgagtttgggaaatgctttttctagattcttttcttagacattcccagtgcatgttagtattagcaaaagctctgagcatgtggacaggaaggaaacctcttttcagctctgtttaatatagtttcccaaacttaatgggccagga

SEQ ID NO: 65250 - DNA, 601 bp, Human
tcttttcagctctgtttaatatagtttcccaaacttaatgggccaggaaacttattttccatgtagtaactattaacgttctggggaattagtgctctgtgtcacactttgggaaagtgaggcttgctttctaattatatccgattgttgcttaaacttacataaactcctaggtacagtttggtgctttttcactcatcttcagctgttgtcagtcaccccggttttatccctaggcttgaataagacccacctgaatctctgagaaagattctgcagcggattgactgtgggtgcctcragaggctttccaaacctggcctctcattggaggcttcttgccctgtcttctggcacctctattctgacccatttagcttgggtttcacagctacagataaagtcatgaaagatctaagtatcttagcaagtgaggcaagggattgtagggttatccattcaaagggttatcctccctctgacctttagagatgaagaaactaagggcaggtgatgtgctcaaggtcatgagaaagtctaggaccaggggactttctgactcccgtctagttctccttccactgcttccactgccttagac

SEQ ID NO: 65251 - DNA, 601 bp, Human
gaggcttcttgccctgtcttctggcacctctattctgacccatttagcttgggtttcacagctacagataaagtcatgaaagatctaagtatcttagcaagtgaggcaagggattgtagggttatccattcaaagggttatcctccctctgacctttagagatgaagaaactaagggcaggtgatgtgctcaaggtcatgagaaagtctaggaccaggggactttctgactcccgtctagttctccttccactgcttccactgccttagacctgggttcctggatcctggcttagtcgttytgcttccacacccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacc

SEQ ID NO: 65252 - DNA, 601 bp, Human
cctcggactatggccggcccctcagcttccctccaccccgcatccgggagagcatccaggaagacctggcagaggaggtgtgtggagcagggtggctgtctgtgtgtgcctgagtgtgcttgcccacagactggtaccctttcactccaccattcagcactcatggtgtccctgctaccctgaactgatcactgggaagttgggagacacatgtatcagcccagcccttcccttccttttccccagagcatgcagcagaatgtgactgcaggtgtttctatggggggcactcagctccccstgacatgccctgtttccttaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgc

SEQ ID NO: 65253 - DNA, 601 bp, Human
gtgagctgagattgcaccactgcactccagcctaggtgacaaagtaagactccgtctcaaaaaaaaaaaaaaaaatccagtatgatagctcatgtaaagcatttagcaaaatactactaataggtgccaaaattctgagagctgtaacacaaatacacatagaattaaggcacagaagaccctacactactatacccgatgttacacagtcgatgaaattcaaatgccgatttctcacttgtgtctgtgcactatgagcaacctatttaccattttcactgtatctctaatattcaaaatwccagaaaaaggctttccacagtaccttcacactgatgatgaaaattagaaactacaaaatgcatagccttattaataaaatacctcaaccaattttatcccaacacaccaccacaagaacagaaataaagcaaaaactacaaagtcattttaaggcttgttttacaaaacgttaggtggaatatcaattggtaaacccttatttagcatctgagtgtttggcattgtgtcgaggggaaagacagctatgtgagaaagccacaagttctaagtaaatgaatatgagagttatacaagggac

SEQ ID NO: 65254 - DNA, 601 bp, Human
atagcttcactaccaaataggatttaaaatttaccctttgacatcttcaggatacaagtgtaatagtaaataatcacattatctcaatggcacactaagcccaataaagtagattagacatggggtgttgcaatatttgagaatacaagtagggatctctatgccatgcaacagagcatggtggttaggagttctgaggttaaaccaccagcttcaggttgtatctttgcacttactagctgtacaaccccaagcacactacttccctttgctaactcccaatctgtaaaatggagataaytgtacctgtttcatagggttataagaatccagtatgataggctgggcgcggtggctcacgcctgtaatcctagcattttgggaggctgaggcaggtggatctcaaggtcaggagttcaagaccagcctgaccaacatggtgaaactccgtctctaactaaaaataccaaaattagccaggcgtggtggtgtgcacctgtaatcccagctactcaggagtctgaggtaggacaatcacttgaacccaggaggcggaggttgcagtgagctgagattgcaccactgcactccagcctaggtg

SEQ ID NO: 65255 - DNA, 601 bp, Human
tgctttaattatgtggatttattacatttttttcccctccaggattatttaaagctggagggttatcctttggtacaatagcttcactaccaaataggatttaaaatttaccctttgacatcttcaggatacaagtgtaatagtaaataatcacattatctcaatggcacactaagcccaataaagtagattagacatggggtgttgcaatatttgagaatacaagtagggatctctatgccatgcaacagagcatggtggttaggagttctgaggttaaaccaccagcttcaggttgtayctttgcacttactagctgtacaaccccaagcacactacttccctttgctaactcccaatctgtaaaatggagataattgtacctgtttcatagggttataagaatccagtatgataggctgggcgcggtggctcacgcctgtaatcctagcattttgggaggctgaggcaggtggatctcaaggtcaggagttcaagaccagcctgaccaacatggtgaaactccgtctctaactaaaaataccaaaattagccaggcgtggtggtgtgcacctgtaatcccagctactcaggagtctga

SEQ ID NO: 65256 - DNA, 601 bp, Human
tagaagttctgataaaattaagtaaaacaccatattacaaaattttcctaatcgtttctcactggaaatggcaaagaacaatgaaagatcaatacataagagctgtaagaggcattaagattcccagccaaacactaaatccaggaagagtttatggtttatttctaattcatcatgcatgtcttgagaagattttaaacatgagtaaaaaagttatgaatttctatgagccccactatagaatctaaaaaccaaaatcaaaaaaagcatcacttcctttaacattccattaaaactaaaytatgaaaaaaatgatgatatctcattaactaaatttttaaaagcaatgtgaaaaaatctaccaatttctgttggagattatttttagaatgtatatgcatcagttcctttgagctatgtatttcctctaatacaagtattgtgggtgttgcggcaggtgagactttgcatgtcagattctaaaaatcagatgtaggacagacagcaatgctgcaccctaacaaaaattcctttggtatctcacaaaaagatgtgatagtacagctaaggaagatatatcagagcacaatctccaccacac

SEQ ID NO: 65257 - DNA, 601 bp, Human
gcctcccaaagtgctgggattacaggtatgtgccagcatacctgacctatgcataatatttttttaaaactctgaggaacctttataacctaaggtctgccctaatcacatttcagaatacaacaaaatacagtaaaccttcacataattaccaagcatgcgcttctatttctgttggctaattaaacgaagagaaaggagctaacattttactgatgcactaaccacctacacatggcaagcacatttaatctcaaaaaatttccacgaggtagaattcttttttttttttttttagacrgagtctcgctctgtcgccgaggctggagtgcagtggtgcgatcttggctcactgcaagctccacgtcccgggttcacgccattctcctgcctcagcctccctagtagctgggacgacaggcgcccgccaacaggcccagctaattttttgtatttcttagtagagatggggtttcacagcattagccaggatggtctcgatctcctgacctcgtgatccacccgcctcagcctaccaaactgctgggattacaggggtgagccaccgcgcccggcctccacaaggtagaattcttacact

SEQ ID NO: 65258 - DNA, 601 bp, Human
ttccatgaaaccggtccctggtgccgaaaaagttggggaccactgctctgtatcatttgtttaaaaaattaaaaaccagggtatgccactaaaatgcgaaaaaatgaatttatgtagaattctacctagtctcatccttaaggcatttgctttctgagaaaggaaaaaagaaaaatactggttattttggttgaattggggactagacactgctacgacactgtcagaaattaagtatgtttgggaattatttcaaaatataactagggggaacggggtgaatacagataaagcaagactrgccaggagctggtaactgttgaaactggatgactatatagggattcattatacttttccatctatttttgcctatgtctgaacttttccataattacaagtgtgtgtatgtaggtatatgtgtgtgtgtatacacatatatatccttacacatatatcttacatatatacatacacacacatattaatatttacttagacaaatatgcccaaaaaccagactggaagctactatgtcaaaattagcagtggttctcttttctttctttcttttttttttttttttttaacaacaaacatt

SEQ ID NO: 65259 - DNA, 601 bp, Human
gcccagaaataccaatccaccttatatactacctcttccacaaagccttcacagaacccagtaataggaattttctttcctctgaacccatatagtaattattgcctatgttaggcaaataatcatgaactgcctgttggcctcattctagctttgaaacactgagttctgcactggtagaaattttcacaagttacatcttctcaaatagcatattgaatacttatttatgaatgaacttacttgacgtcagatttccttcaaataatgaaggttgggtcaggagtagtaaattgggatrgggatgaaataagattgactatgtgttgacaaattgtttaagctgggtagttcccactacttttgtatgtatgaatgaaaatttctctattttgtttaaacattaagtatgctagctgaagatttccccccaaaataggaaagctttaaaaaaaaaatatcaagactctgggcaagtcaatttgagcattaaagaatttgctggttgggcaaagtggctcacacctgtaattccagtactttgggaagccgaggcggacagatcacttaagccatgagttcaagacaagcctgggcaaaa

SEQ ID NO: 65260 - DNA, 601 bp, Human
acaacaacaacaaaaagctgcaatagccatatggtccttattatcagatatcagatactcaagttattggtaaacgacattctgataaactagttaacataccacaaaaaaatgaaaacacaaaatccacaaaataaaaatgacaattctgtggccaggcacggtggctcatgcctgtaatcccagcactttgggaggccaaggcaggcagatcacctgagttcgggagtttgcgaccagcctgaccaacatggagaaaacccatctctactaaaaatacaaaattagccaggcgttgtgrcgcatgcctctaaccccagctactcgggaggctgaggcaggagaatcgcttgaacccaggagacagacgttgcggcaagccgagatggcgccactacactccagcctgggcaacgagcaaaactctgtctcaataaaataaaataaaatgacaattctcaatcagctgtctctcacatagatctcttttgtgcaataaaaaacagctctagagtagacaccttatttcaacaaattcattttccagaagatgaaatactcaggcagtaactcttaccaaaaagataagcatactgttctt

SEQ ID NO: 65261 - DNA, 601 bp, Human
caaacaccattataggctagcactgaacaaggtaactttctgagagcaaaaaacgttatcagttcaatactaaaggatgtagttttcatttgcagacacaatgggataaatattattgtttatttaaaagttatatggcaaagaatttttaaaactaagctagaaaatattttcatgattaatgtgttttaccacataagaaataaagtattactaatgacctaaattaatatgaaaaattagtaacattactctgccattatgtcacttataaaatgctgcaatagccaggcgcggtggytcatgcctgtaatcccagcactttgggaggccgaggcgggcagatcacgaggtcagaagatcgagaccatcctggctaacacggtgaaaccccgtctctactaaaaatacaaaaaaattagccgggcgtggtggcgggcgcctgtagtcccagctactcaggaggctgaggcaggagaataacatgaacccaggaggcggagcttgcagtgagctgagatcgcaccactgcactccagcctgggcgacagatcgagagtctgtctcaaaaaacaacaacaaaaaacaacaacaacaacaa

SEQ ID NO: 65262 - DNA, 601 bp, Human
aacttcaaacaccattataggctagcactgaacaaggtaactttctgagagcaaaaaacgttatcagttcaatactaaaggatgtagttttcatttgcagacacaatgggataaatattattgtttatttaaaagttatatggcaaagaatttttaaaactaagctagaaaatattttcatgattaatgtgttttaccacataagaaataaagtattactaatgacctaaattaatatgaaaaattagtaacattactctgccattatgtcacttataaaatgctgcaatagccaggcgcrgtggctcatgcctgtaatcccagcactttgggaggccgaggcgggcagatcacgaggtcagaagatcgagaccatcctggctaacacggtgaaaccccgtctctactaaaaatacaaaaaaattagccgggcgtggtggcgggcgcctgtagtcccagctactcaggaggctgaggcaggagaataacatgaacccaggaggcggagcttgcagtgagctgagatcgcaccactgcactccagcctgggcgacagatcgagagtctgtctcaaaaaacaacaacaaaaaacaacaacaac

SEQ ID NO: 65263 - DNA, 601 bp, Human
aaaatttttttcctgtgtggcattaatctgtaagaaagtttttataggaataatgccccaaagtgttacctaataaattttctgaactaaataaatgtgctagaacaaagtcagtgtgatatgtcacaagaaaattgtgagaattgtagaatacttctcaaagaagccaatgtgtcacatttagaacttaaccttgcaccaagtgaccacaataaaagaaaaataactcataggaagataaaaggaaaaaggctgaaaaaccaagcaataaatattctcttggaacaagaaaacttctatytgggtcaaatacacagcaatacaccccggacttgtcacaaactctttggtattctgtcccaccacacttcaagataactgaagatgctatcaacattctttttccacaaccacatgacttaagtattcgtgaaacacaattcaaggtatagagttcagcaggcagatgaaaataacaaccagtaacaacaagaacaatacaagaaaaaaccagaggaaagagtacaggattctacacaagcaaagctcaactccaactctaacctagacttccagaatactcggtatcacaaaataaaat

SEQ ID NO: 65264 - DNA, 601 bp, Human; identical to SEQ ID NO: 37981

SEQ ID NO: 65265 - DNA, 601 bp, Human; identical to SEQ ID NO: 37982

SEQ ID NO: 65266 - DNA, 601 bp, Human
gcaagactctgtctcaaaacaaaacaaaacaaacacaataatgtactgaagccagattcacaaccacaaagcaaaacattacctcagatttctattaattactttaaagctcttagctttctttacactgtaccatcataaaaaagacataatatagttattacttaactagccacaaatatattttctgctttatagaactatctaatatgttgctggtgttactttccaagagaacttattttttaaaatgcaaaactccactttctgaccatttaaataaaatcagatgcaaaaaaaraccatgcctccaaaaattaaggcagaaagcttcagaaaacaatgaaaatgaaaggtatttccaaaataatgtacggtataatttatttatttaataaacatttattaccactatacacttctagaatgaggtggatggtaaatcaaataaacataaagcaatattaagtacctaccgtgtgcaaaagcaaaaaaagacatggtccctgccctcatggagctcacagtctagctgaagcagacaaacaagtcacaaatacaatggcaaagcaccagggaagcattatggaggaaaggattg

SEQ ID NO: 65267 - DNA, 601 bp, Human
acttctagtgacaaaccaagctgcatgaagtcccctaaaacatatcttgcacttagaatcactgtactcttctttatccaatcctagagtgtctccaattcaattttagtatcatcttgcctctcctcccagttccctgctaaaaatgttgacagtcacatctgtgaaaccctgcaacaccacctctttgaaaaatcaaacataaatccctaaacaatatttagcttttgaagcaaaggtttggtttttatttgcatattgagaggcaaagcttatttgcatattgagaggcaaagctccrtgctgttcaataggatagtgactaggtacatctggctatttaattttaaagtaaaactaaaaattgaggccgagcgcggtggctcacgtctgtaatcccagcactttgggaggccgaggcgggcggatcacgaggtcaggagatcgagaccatcctggctaatgctgtgaaaccccatctctactaagaaatacaaaaaattagctgggcgtggtggcgggggcctgtagtcccagctacttgggaggctgaggcaggagaatggcatgaacccgggaggcagagcttgcagtgagccaa

SEQ ID NO: 65268 - DNA, 601 bp, Human
attcagtatgtttatacatctaaaacactaaaataaacttctagtgacaaaccaagctgcatgaagtcccctaaaacatatcttgcacttagaatcactgtactcttctttatccaatcctagagtgtctccaattcaattttagtatcatcttgcctctcctcccagttccctgctaaaaatgttgacagtcacatctgtgaaaccctgcaacaccacctctttgaaaaatcaaacataaatccctaaacaatatttagcttttgaagcaaaggtttggtttttatttgcatattgagasgcaaagcttatttgcatattgagaggcaaagctccgtgctgttcaataggatagtgactaggtacatctggctatttaattttaaagtaaaactaaaaattgaggccgagcgcggtggctcacgtctgtaatcccagcactttgggaggccgaggcgggcggatcacgaggtcaggagatcgagaccatcctggctaatgctgtgaaaccccatctctactaagaaatacaaaaaattagctgggcgtggtggcgggggcctgtagtcccagctacttgggaggctgaggcaggagaatg

SEQ ID NO: 65269 - DNA, 601 bp, Human
aattcagtatgtttatacatctaaaacactaaaataaacttctagtgacaaaccaagctgcatgaagtcccctaaaacatatcttgcacttagaatcactgtactcttctttatccaatcctagagtgtctccaattcaattttagtatcatcttgcctctcctcccagttccctgctaaaaatgttgacagtcacatctgtgaaaccctgcaacaccacctctttgaaaaatcaaacataaatccctaaacaatatttagcttttgaagcaaaggtttggtttttatttgcatattgagrggcaaagcttatttgcatattgagaggcaaagctccgtgctgttcaataggatagtgactaggtacatctggctatttaattttaaagtaaaactaaaaattgaggccgagcgcggtggctcacgtctgtaatcccagcactttgggaggccgaggcgggcggatcacgaggtcaggagatcgagaccatcctggctaatgctgtgaaaccccatctctactaagaaatacaaaaaattagctgggcgtggtggcgggggcctgtagtcccagctacttgggaggctgaggcaggagaat

SEQ ID NO: 65270 - DNA, 601 bp, Human
tgtctttccacaaaatcaaatgccaacaatggaaagtgccttacaattcttcgtaagtttttaattaatataattcacataccacaaaactcatcattttaaaatatataattcagtggtttctagtatattcactaatttgtgcaacttcataggtttttacaaaaagtaaagaaaaaattatctggtacccatgatgtctatgcagaaaatccacttagtctaatattctatatgggtaacaagattttttaaaggagattaatggcatattaaaatattaataggatggatggagtayactttgagctcattaaaaaggactacacctgttcacagaagaatgattacaattcatcaatgaaaacacgttttgaagagttctgcttgaaaaataacttactggagctttagttaatgtaacggacatcaccaaagatgccagagtttcagccagatatcctagaacagtcctactcaaactcagacagttattctatggcgttaatcatctcctttacttctcagttggcattagctatgtacacatccttgggagaactatggaaatagtgacacaaatggttttctgtagggctta

SEQ ID NO: 65271 - DNA, 601 bp, Human
cacccagcctttgttcttaataaagaatgatatactctgctggtattagaacaaaggtggcatcatgtgtctacttcagtagacacacagaagtatttgcaaccgtctgcatgagtaaacatattcaaacctgtgagattctcattgttaccaaggatgactggaggcaactactctaaactgtttcaaactatgaatcctgaatccatgaagactggaaggaagcatggaacacgtcaaactattgatgctacactggtaagatggacgttcttccattcacttatgtttctgtgcaataaaaaaaattaaaagaaaagcctggctaaaatatttaagatatacaactaacttccattgtctaatgagacagttcattccctactggcacagaatgagacattattcaaaatgtgctgcattattcttcactcaatcttattttggtttttagtattttttctccttttaactggcctagaagctctgacgacagaatgtctttaatttattattctaaaacagtatcacatgaagctgagcaatctgtaaagctggactaactagttttcccaggaactgtcaaagaaacagtcaattc

SEQ ID NO: 65272 - DNA, 601 bp, Human
ctcttgaccttgtgatctgcctgcctcggcctcccaaagtgctgggattacagacatgagccactgcacccagcctttgttcttaataaagaatgatatactctgctggtattagaacaaaggtggcatcatgtgtctacttcagtagacacacagaagtatttgcaaccgtctgcatgagtaaacatattcaaacctgtgagattctcattgttaccaaggatgactggaggcaactactctaaactgtttcaaactatgaatcctgaatccatgaagactggaaggaagcatggaacasgtcaaactattgatgctacactggtaagatggacgttcttccattcacttatgtttctgtgcaataaaaaaaattaaaagaaaagcctggctaaaatatttaagatatacaactaacttccattgtctaatgagacagttcattccctactggcacagaatgagacattattcaaaatgtgctgcattattcttcactcaatcttattttggtttttagtattttttctccttttaactggcctagaagctctgacgacagaatgtctttaatttattattctaaaacagtatcacatga

SEQ ID NO: 65273 - DNA, 601 bp, Human
tcaagaccaccctgggcaacatagtgaaatcccatctctatgaaaaacacaaaattagccaggcatggtggtgtgcacctgtggtcccggctactcaggaggctgaggtgggagcatcacttgagcccaggaggttgaagctgcaatgagtcgtgattgcactcctgcactccagcctgggtagctaagcaagtccctgtctccaaaaaaaaaaaagacaaaaagcagagagattagatgaaatgaataatagttacttagtctcagaacggagcaagagaacattcaggaggtaggatcrataggacttgctggctaaatagacgcttggggtgaaagataggaagaatcaaggatgatgctcaagtttccagcttaggcagccaagcggacagtggtcctttcactgagataaagcacatctaataaaaggcagatttgattggatgacaaaggagttcatagagataaagcaatagattacaggtgctgatgagacttccaagtgaacaatgttagtaggagaattgacacaaacgactgaagctcaggatgaagatataaatttggaaatcattaacatatggatgataactgaagc

SEQ ID NO: 65274 - DNA, 601 bp, Human
catcatcttttactagctcaacatgcaacaattactttaagagtataaattttctaccactcaaattcatattttattatttttaaaaaatattgagctaccctttattatgtccatatttctgtcaaagatatcattctcccactttattctaagattcttcatataggcagagctgataagtcaataaattttgtcaattatttattttattcttttttttaagacggattcttgctctgtcgcccaggctggagtgcagcggtgcgatctcggctcactacaacctccacctcccagsttcaggcaattctctgcctcagcctcccaagtagctgggattacaggcacctgccaccacacccagctaattttttttgtatttttagtagagacagggtttcgcatcttggccaggctggtcttgaactcctgaccacgtgatccacccgcctcggcctcccaaagtgctgggattacaggtgtgggccactgtgcccggccatcagttattgtatgaccagcataaaacacaccttatcgcttatgccctaacttctgtaagagtttcttcagtgatctcctaaccctgtcagtcctc

SEQ ID NO: 65275 - DNA, 601 bp, Human
atcaattaaagatatataagatcactagactgaaaactataaaagcttactggaggaatacctaagattcgtggactgtaacacttaatattataaaaatattaattctccccacagatttacatcctagcagcataaagaaaatatttttgatgagcatgtggcagaaattttaaaatcagaaaaggttaactataattatattagaaaacctaacatagagttattaagattaaaaacaacaaagaattatgacagaaaggagtggcagggcattacttaccctacccagaaaaatttycattcataataacgtaaaccctgactatttaacctatttacctaaaattgtgatacatctaggttgggagcatgacggcagagagagagaactatgtagtcacctatccttggggaaagtaaagaaataatggctaaaattaacaaagacagcctaacaagtatattaattagaaatatgaagataattataaagagatatgataagaattaagaataaatgtttctggcagagactagaagacttaactggagtagtaaactactgttttgagaagtagtttttaaaaacactattcga

SEQ ID NO: 65276 - DNA, 601 bp, Human
atttttaaaaactagccaggcgtggtggtgtgcacctgtagtcccagctactctagaggctgaggtgtgaggctcacttgagcccaggagggcaaggctgcagtgagctgtgatcacaccattacactccagcctgagcgatacagcgagaccttgtctcaaaaacaaagaaaaaaaatgaatctgtaagttaaaacttttccataaaaaaaataggctgagatgacctcccaattaattattccaaaaagaaaattttgttttttaaaaatgccaattttatagaaactcttccagagamtataagaaggatcacctccaagctcattttataaagccagaaaaccttgatactaaagcttgagaagcaaattacaagaaaagaaaagtacaagtcaatttcaatcatgaatataaaggcaaaacatcctaaacctaataacagcaactctaaacagtgataacaatgataatacattacaaccacattgggcttactccaggaattctagatctgtttaacattcaaaaacatcaaacagtgaaattaatcacataaaccaatcaatatgatacactttattaacagaataaataaaca

SEQ ID NO: 65277 - DNA, 601 bp, Human
tatataaacacagtgacagaattaggactaaacatatctgtaaaacaataaatgtaagggtaatctcaccaattatgaaaaagaccttcagatcatattttaaaacaaatttaaaaactcaactgtatgtttatgcaagagacagatttaaaaataaagagactcagaaagctggaaataaaaagaaagtgcaaagaaatagcaaacaaatacaggcataaaaaaaaacaaagatcccaatagtactataagattacttcaaggcaacagtgtcaaataagacaaggcataatccattatraagaaataacttctataaaagaaatgttttcttataaaaagaaatttgatagaattggatttgaatttcaatgaggaaaagctcatatacagactgagttcaaaacttgttaggaaaggtctccccaatacctcattccacttttcatttggatactaccaatatcagagaaaagaatatcacaatagatactgtaaacattaaaaatattactagaaatatataaacaatcttttgccactaactttgaaaattataaaatgcacaaattcctagaaaatcacatgaaaaaaactagaa

SEQ ID NO: 65278 - DNA, 601 bp, Human
gggacgggggtttcactgtgttagccaggatgatctcaatctcctgactcgttatccgcccgcctcagcctcccaagatgctgggattacaggcgtgagccactgccaaattaattcctattctttctgtaggacactaacaggcactattttttttttcctctctttttttttttttttttttttgagacagagtatcactctgttgcccaagcaggagtcagggatgcagtgggtatgatcatagctcgctgcaacctgcaactccggggctcaaggaatcctcctgcctcagccaccsgagtaactggaactacaggcccacaccactgcgccagctagtttcttaaaaaatttcctgtagagatggagtctcactttcttggcaggctgctctcaaactcatggcctcaagcagtcctcccatctcagcctcccaaagtgcttggattacaggcataagccaccatgcccagccgttcttcctttttaataccaatacatcgagaaatagaagtacatatgcactatttagaatatgacattaatcaaccactagaattaaaatcaggttataaatcctcaaaattaccagaagtat

SEQ ID NO: 65279 - DNA, 601 bp, Human
attaaagcaaaatccagaaagtgtgtactttctagtcactctcaaaaggctaaatatacaagacactgggttagggctacgtggatgaatggtgtttcctgccaagaagaaattcactgtccagtttctaaactgctttatttccaatcagccccatatagtatctgaattgtctagttatggtcagcaaaaacaacttaaataccatggcctgcaaacatcaaagatcaagtatgagctaccctcttattttgtcagggtggcctaagaagaaagagctagataatgacaagaaaattaytgcataaaccaaggagaaggttacttcgtgtggctgtgcaaactacaatgtgatctctcgttaaggcaaaagataatttgggctaaacaggatagatgaataaaccaaagggcaaattttagggctgatgaagacagaggtgcagtaagcgtttgctgtagttgtttgactaaattttgccatgaatactctctaacttacacacagtgggtatacaatacttgtcaagtgcctgaaaaggtacaattatcctaagatgaccatggaataagagtatcattcgtggtgcctagatttttc

SEQ ID NO: 65280 - DNA, 601 bp, Human
ttcttcttttaagtgacagatgcacttgaacactgacaacttaaaacatgtccttattcacactgcttccccctcaagccatctttatcttcccctcccactagtagagagaacttgtgtcttatttcctcacattctattcattcttttccttctaacccaggctctgcccctcttatttatatgaacactgaccttgcccaaggtcacagtcacctaattaccaaatccaattcctagctcaagcctcccctgtcctacttcactgatacattcgcctgccgtcaggggactgaagacmttttgtgatggttctctgtatgtttctgtattctttacaactattcagcaacaaattaaaatgtctaacattaattgtcaaagatttagactacaagcatttcttttcttttttctaatgaaaaaaatttaaatgcgtaagatatgtgatatactttttaaagtatatgaggacaacagtgttaatgccttataaaacagaagaagcaaaagttaccttaaaaatctcaccatttttagagttttatctgcaatctacatctgtcaagagcatgatgctagacacaaaattcgcactcag

SEQ ID NO: 65281 - DNA, 601 bp, Human
ctgtacagagagattttagattttagaaggggctctcttatttaccacaggatcggggttcccacacatgtgtgaatctgtcactgactactgagaaaggcacggctccatttagaatgactttaagtgttcaaatgtaggtacagcagcaaaatagaacagacaggtttatttggaacatgttaatttccataaattagcaggtagctatcagtaggtctggcttattcttacatgaaaactggagaaaattcaccaaactgagccacacaaaaacctaaaacttattttagctctcatrtattgtcttaaaaagcatcttcccttttgaaattataatctctattagaacaaagtgaactgaccagaggaacatgctgaacttcaataatgaaactaagggaagttcatctaaaattcctacatatccaaactcctgttttttattgtttattttagacaccatagctgaatattaacccccaagccaagaagcctacagagcaacttcagactgactagaaaagccaggcgtgaagcctgaaggtctagagcctctatgaacatcgtcctttccacctcagatctcctcctattttag

SEQ ID NO: 65282 - DNA, 601 bp, Human
tatatcacaacctataaactagaaagtgtctgtacagagagattttagattttagaaggggctctcttatttaccacaggatcggggttcccacacatgtgtgaatctgtcactgactactgagaaaggcacggctccatttagaatgactttaagtgttcaaatgtaggtacagcagcaaaatagaacagacaggtttatttggaacatgttaatttccataaattagcaggtagctatcagtaggtctggcttattcttacatgaaaactggagaaaattcaccaaactgagccacacraaaacctaaaacttattttagctctcatgtattgtcttaaaaagcatcttcccttttgaaattataatctctattagaacaaagtgaactgaccagaggaacatgctgaacttcaataatgaaactaagggaagttcatctaaaattcctacatatccaaactcctgttttttattgtttattttagacaccatagctgaatattaacccccaagccaagaagcctacagagcaacttcagactgactagaaaagccaggcgtgaagcctgaaggtctagagcctctatgaacatcgtcc

SEQ ID NO: 65283 - DNA, 601 bp, Human
atgaaacatgaaattttatatcacaacctataaactagaaagtgtctgtacagagagattttagattttagaaggggctctcttatttaccacaggatcggggttcccacacatgtgtgaatctgtcactgactactgagaaaggcacggctccatttagaatgactttaagtgttcaaatgtaggtacagcagcaaaatagaacagacaggtttatttggaacatgttaatttccataaattagcaggtagctatcagtaggtctggcttattcttacatgaaaactggagaaaattcamcaaactgagccacacaaaaacctaaaacttattttagctctcatgtattgtcttaaaaagcatcttcccttttgaaattataatctctattagaacaaagtgaactgaccagaggaacatgctgaacttcaataatgaaactaagggaagttcatctaaaattcctacatatccaaactcctgttttttattgtttattttagacaccatagctgaatattaacccccaagccaagaagcctacagagcaacttcagactgactagaaaagccaggcgtgaagcctgaaggtctagagcc

SEQ ID NO: 65284 - DNA, 601 bp, Human
agcttgtttcaagaatagaaggtgggagagaatcagggaacacagactatatttctatgctgcaatgaatcaaaaaaggcaaaaacaaccttaaccagtagcaactgtctggagcagaatttctcagtcttggcattcttgacatttgggggtagatgattatcagcttgcttggtttatacacccacaagatgtcagtagaaacaccctagttgtgacaaccgaaaaatatctctggatataccaaatgtacccaggtaggtgggaagtgaggcagtaagaggaaatggaggaagcaaawtcatgtctagttgagaaccactggtccagagaaagagaaaaaggatagggaaataggaggtttataaaggcaggtgcccagatctcacagcagaaacagaaagaagggcccctgccagcatgcaccatcactgcaagctcctctctcagttctcagtagtgtctctcccagctcctcattcatgggccttagaagaaccaatctaaatggcttggaggtgggtgcctctttttttttactgccagacaactaggagtggtggagaatccagtcattctggaaagtaagataaagcacaac

SEQ ID NO: 65285 - DNA, 601 bp, Human
tgaaaagtactgatgtgtctctgttgtgttaaaaaaaaaaattcactagacaaaatgaaactgactttccctgtatactcacgacctcaacttgacagtcaaccctgaggacgggaatatctaacttattagcagagtgaatgggattgggttttagaatctgaacaaccaatgttcaaacttgctttttcactagctttataaattggacaattgacctctctaaatatcggtttcatactatatcgaatgggacaatataagcaatctcaaagggttatgggaacaaaatgaggaagcrttataaacacttgaacatgcccagtacacagcaactatcattttactatttcgtttcacctgtggcttgtagcacattgctgatcatacaatagcacttaataagtagttggtcattttattaaaattaggaagtataaacaaagcaaaaataatcaattctgaaaggtaagtattagcaaatgaagagtctgagcacatgaatatgaatcttcccttcccttccctttcagttggggatttcttgctactacgaatattttaaaattattcctcttcctcccctcctccaggccagact

SEQ ID NO: 65286 - DNA, 601 bp, Human
agaacatgaaattgttatttggtggatagaaattaaagagaccccactccaagaaaacacttccagataagcgacactaacgatggtatgggagcaagtatttcaaaaaatggaaaaagaaagggagtgatttgcatatataactgaaggcttttgaattttttcttaagaatactgtttcagattaattatactaatagctacttctcatgaccacactgaaaagcatctacatcatatatcctagcacgattttcattaatcattatatccaatttgaaaagtactgatgtgtctctgytgtgttaaaaaaaaaaattcactagacaaaatgaaactgactttccctgtatactcacgacctcaacttgacagtcaaccctgaggacgggaatatctaacttattagcagagtgaatgggattgggttttagaatctgaacaaccaatgttcaaacttgctttttcactagctttataaattggacaattgacctctctaaatatcggtttcatactatatcgaatgggacaatataagcaatctcaaagggttatgggaacaaaatgaggaagcgttataaacacttgaacatgccca

SEQ ID NO: 65287 - DNA, 601 bp, Human
accgatccctattctgatgctctgggaaccgaggctgataatgttgattattatttaccttcatcactccgagtttattaatattactctaagagatttgtactctttagtgaagaacaaaagagatggcttactaggaaaaaggaatttgaggatcaacaatattcaacaaatactctttgaatgcccatgatatgcaatgtgtttttcttgcactggggatgcttggtaggataatcggcaatcgctgccctccaggaggtgtttggtggaaaacatgcaaaactctacaaggccgacygcaataatgaagatccaaaactaacttcaatttgggaagacctggaaaggcttctaggaagaggtagcccttgaaaattgtgtaagaattctataagcatgtagaagagaaaagactattccaacccaagaaattgtatgggcaaggaggtaacagagtgcaggtcagtgtttctaaagatcttataaagaacaataaccaaggtggcttattttaaaaatatattccaaggcctcatccccagagattctattcaatagatctgggattagaaagctagttttatttttttttttacaa

SEQ ID NO: 65288 - DNA, 601 bp, Human
gaaatttaaatcatttcaatagtttcctataatttcctcattttttccttataaaaagctaaatgatattccaaacatgaattatttccacacatcataatcctctcagatggcattgctcaaaaaaggttgttttacataacctattcacttgttacaatactatagatggttatatgctgtatactatgtatagtttcttataaggtatcttccaaagaaaataatttgaattttttaaagattcacctggcatgaaattttaatgctacgacttattaaggaaaagaaaacaaattaygtgatgtgttatccccctttatccaatatcattagagaaagagctactccaatatgggatttttccagtacaatgaagtttagccctttagcacactttaagggagaaaagaccattttcaatgaaaagttttctaaaatgttttagatgcctcctttatttttaaactggatgtcacattcatgagtgactctttccctgctgcacagggcctgggtcaccatggtcacttagtagccccaggtcatcattacgggcatcagtgagtacactgagtggctcctcgtgccctaggggcta

SEQ ID NO: 65289 - DNA, 601 bp, Human; identical to SEQ ID NO: 29116

SEQ ID NO: 65290 - DNA, 601 bp, Human; identical to SEQ ID NO: 29117

SEQ ID NO: 65291 - DNA, 601 bp, Human; identical to SEQ ID NO: 29118

SEQ ID NO: 65292 - DNA, 601 bp, Human; identical to SEQ ID NO: 29119

SEQ ID NO: 65293 - DNA, 601 bp, Human; identical to SEQ ID NO: 29120

SEQ ID NO: 65294 - DNA, 601 bp, Human; identical to SEQ ID NO: 29121

SEQ ID NO: 65295 - DNA, 601 bp, Human; identical to SEQ ID NO: 29122

SEQ ID NO: 65296 - DNA, 601 bp, Human; identical to SEQ ID NO: 29123

SEQ ID NO: 65297 - DNA, 601 bp, Human; identical to SEQ ID NO: 29124

SEQ ID NO: 65298 - DNA, 601 bp, Human; identical to SEQ ID NO: 29125

SEQ ID NO: 65299 - DNA, 601 bp, Human; identical to SEQ ID NO: 29126

SEQ ID NO: 65300 - DNA, 601 bp, Human; identical to SEQ ID NO: 65253

SEQ ID NO: 65301 - DNA, 601 bp, Human; identical to SEQ ID NO: 65254

SEQ ID NO: 65302 - DNA, 601 bp, Human; identical to SEQ ID NO: 65255

SEQ ID NO: 65303 - DNA, 601 bp, Human; identical to SEQ ID NO: 65256

SEQ ID NO: 65304 - DNA, 601 bp, Human; identical to SEQ ID NO: 65257

SEQ ID NO: 65305 - DNA, 601 bp, Human; identical to SEQ ID NO: 65258

SEQ ID NO: 65306 - DNA, 601 bp, Human; identical to SEQ ID NO: 65259

SEQ ID NO: 65307 - DNA, 601 bp, Human; identical to SEQ ID NO: 65260

SEQ ID NO: 65308 - DNA, 601 bp, Human; identical to SEQ ID NO: 65261

SEQ ID NO: 65309 - DNA, 601 bp, Human; identical to SEQ ID NO: 65262

SEQ ID NO: 65310 - DNA, 601 bp, Human; identical to SEQ ID NO: 65263

SEQ ID NO: 65311 - DNA, 601 bp, Human; identical to SEQ ID NO: 37981

SEQ ID NO: 65312 - DNA, 601 bp, Human; identical to SEQ ID NO: 37982

SEQ ID NO: 65313 - DNA, 601 bp, Human; identical to SEQ ID NO: 65266

SEQ ID NO: 65314 - DNA, 601 bp, Human; identical to SEQ ID NO: 65267

SEQ ID NO: 65315 - DNA, 601 bp, Human; identical to SEQ ID NO: 65268

SEQ ID NO: 65316 - DNA, 601 bp, Human; identical to SEQ ID NO: 65269

SEQ ID NO: 65317 - DNA, 601 bp, Human; identical to SEQ ID NO: 65270

SEQ ID NO: 65318 - DNA, 601 bp, Human; identical to SEQ ID NO: 65271

SEQ ID NO: 65319 - DNA, 601 bp, Human; identical to SEQ ID NO: 65272

SEQ ID NO: 65320 - DNA, 601 bp, Human; identical to SEQ ID NO: 65273

SEQ ID NO: 65321 - DNA, 601 bp, Human; identical to SEQ ID NO: 65274

SEQ ID NO: 65322 - DNA, 601 bp, Human; identical to SEQ ID NO: 65275

SEQ ID NO: 65323 - DNA, 601 bp, Human; identical to SEQ ID NO: 65276

SEQ ID NO: 65324 - DNA, 601 bp, Human; identical to SEQ ID NO: 65277

SEQ ID NO: 65325 - DNA, 601 bp, Human; identical to SEQ ID NO: 65278

SEQ ID NO: 65326 - DNA, 601 bp, Human; identical to SEQ ID NO: 65279

SEQ ID NO: 65327 - DNA, 601 bp, Human; identical to SEQ ID NO: 65280

SEQ ID NO: 65328 - DNA, 601 bp, Human; identical to SEQ ID NO: 65281

SEQ ID NO: 65329 - DNA, 601 bp, Human; identical to SEQ ID NO: 65282

SEQ ID NO: 65330 - DNA, 601 bp, Human; identical to SEQ ID NO: 65283

SEQ ID NO: 65331 - DNA, 601 bp, Human; identical to SEQ ID NO: 65284

SEQ ID NO: 65332 - DNA, 601 bp, Human; identical to SEQ ID NO: 65285

SEQ ID NO: 65333 - DNA, 601 bp, Human; identical to SEQ ID NO: 65286

SEQ ID NO: 65334 - DNA, 601 bp, Human; identical to SEQ ID NO: 65287

SEQ ID NO: 65335 - DNA, 601 bp, Human; identical to SEQ ID NO: 65288

SEQ ID NO: 65336 - DNA, 601 bp, Human; identical to SEQ ID NO: 29116

SEQ ID NO: 65337 - DNA, 601 bp, Human; identical to SEQ ID NO: 29117

SEQ ID NO: 65338 - DNA, 601 bp, Human; identical to SEQ ID NO: 29118

SEQ ID NO: 65339 - DNA, 601 bp, Human; identical to SEQ ID NO: 29119

SEQ ID NO: 65340 - DNA, 601 bp, Human; identical to SEQ ID NO: 29120

SEQ ID NO: 65341 - DNA, 601 bp, Human; identical to SEQ ID NO: 29121

SEQ ID NO: 65342 - DNA, 601 bp, Human; identical to SEQ ID NO: 29122

SEQ ID NO: 65343 - DNA, 601 bp, Human; identical to SEQ ID NO: 29123

SEQ ID NO: 65344 - DNA, 601 bp, Human; identical to SEQ ID NO: 29124

SEQ ID NO: 65345 - DNA, 601 bp, Human; identical to SEQ ID NO: 29125

SEQ ID NO: 65346 - DNA, 601 bp, Human; identical to SEQ ID NO: 29126

SEQ ID NO: 65347 - DNA, 601 bp, Human
taggggtccttcccagcattctctgatgcctgtattagaagcccacacccacccaatgcctgccgggttagggttctcctgagagcaagggtgtttcgggaataggtaatggcgggggtgggagcagcaggaatttgtattgagcctctcctgcaaaggaatttaaatgtatggcattgattttgaggtgataaaatatttaaagttcttatttaagtttttttttttctgactattacaaaagtttatttcacaaaaagtctaatatgaaaatgtacgtgacctaatttttacatcataktaaaacaggctctatggagagaggacatgggtttctctgctgaacagccattatttatactcgttccaaggcttctaacatgatgatactatttcctcgtattaccaccattccaatattgttctattgaccactagtcgccatctccacacattcgtctatcacaaggttcataaaaggatcaaatccccgcaatattccttgcacatgtctgccaccatttaatttcaatgataacttcttgtccataaattttttcaactcgggagggtgagctttgctcatggtgtatactccgcg

SEQ ID NO: 65348 - DNA, 601 bp, Human; identical to SEQ ID NO: 37380

SEQ ID NO: 65349 - DNA, 601 bp, Human; identical to SEQ ID NO: 37381

SEQ ID NO: 65350 - DNA, 601 bp, Human; identical to SEQ ID NO: 37382

SEQ ID NO: 65351 - DNA, 601 bp, Human
tgcagctgttatttatcccaccatgaaagatttcaaccactcataccatgcctgtggtgttatagcaaccatagccttcctaatgtaagtgtcatcgtaattggcattacttacatagcttgccacaaaataaaaatgtttcaaatatagttgcatagatttaaaattctaaatattatcagattaacacactggacatgatttaaaagtcacacagtagagatggacttatacagaaaagcagcagtcctctttattctttttgtgtacctctccactccctcccagcttctctcagctrttcttttattttatacccccagggtttatagctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaagggatgtcaataggagggatagaaattaaaaaaattttttttttatagagagggtg

SEQ ID NO: 65352 - DNA, 601 bp, Human
ctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaagggatgtcaataggagggatagaaattaaaaaaattttttttttatagagagggtgtctcattatgttgctcaggttggtctcctgggctcaagtgatcctcccacctcgacctcccaaagtgccaggattacaggtgtgagccaccacacgtggccagaaattttcagcagagtcagagaaggtctcactaagaaggtgactttgagtaaagacttgaagaaagtgaaggagctgaccaggggatggggatatataagagaggttcattccaggcaggtgaaacagcaagtacaaaggctttacggcaaggagaccagtataactgcagtagcaagatcaagggaaagagaaattgatgaggtcaaagaagtggtggagagggacag

SEQ ID NO: 65353 - DNA, 601 bp, Human
ttattttgttccattttgaagcagtagcaagtctgactatggaggggaattatagctgtatatgagcttgaatgtactattcaaacgtgtttcctgctaaacttacattctgttgcattaacataattatagcagagctgacttcatgtctttataaatgtttatcatctatttggcttcagtttacatctttttattatagtgtcagatagtgtcaggccataattttaaacaaaaactgttagttaattataattcaaatggataggagtcaaaaagcagctattctttcattaatgaytttattattttttctcttattacaaaagttctctgattttgtggctttaaaaatattaataaatgttctgtgtattactctgtattttttaattttaaaaatgtagggtaggccgggcacggtggctcacgcctgtaatcccagcactttgggaggccgaggtggaaggatctcgaggtcaggagatcgagaccatcctggccaacatgatgaagccccgtctctactaaaatacaaaaaattagctgggtgtggtgacacgcgcctgtggtcctagctactcaggaggctgaggcaggg

SEQ ID NO: 65354 - DNA, 601 bp, Human
atagcagagctgacttcatgtctttataaatgtttatcatctatttggcttcagtttacatctttttattatagtgtcagatagtgtcaggccataattttaaacaaaaactgttagttaattataattcaaatggataggagtcaaaaagcagctattctttcattaatgactttattattttttctcttattacaaaagttctctgattttgtggctttaaaaatattaataaatgttctgtgtattactctgtattttttaattttaaaaatgtagggtaggccgggcacggtggctyacgcctgtaatcccagcactttgggaggccgaggtggaaggatctcgaggtcaggagatcgagaccatcctggccaacatgatgaagccccgtctctactaaaatacaaaaaattagctgggtgtggtgacacgcgcctgtggtcctagctactcaggaggctgaggcaggggaatcgcttgaacccgggaggtggaggttgcagtgagctgagattgtgccactgcactccagcctggcgatagagcaagactccatctcaaaaaaaaaaaaaaagtaggatatgccaataagcaaaaa

SEQ ID NO: 65355 - DNA, 601 bp, Human
actcgggaggctgaggcaggagaatggcgtaaaacctgggaggcagaggttgcagtgagccgagatcgtgccactacactatagcctgggagacagagcgagactccgtctcaaaaaaaaaaaaaaaaaaggagtatctggttgaagagaccagtcatatgaactctttactcaagaactgaaggcttatgagccaggtgtagtggcactttgggaggtcaaggcaaggaggatctcttgaggccaggagtttgagaccagcctgagcaacatagcaagactttgtctctacaaaaatttwtaaaaattagctgggtgtggtggtgcacacctgtaatcccagctactcaggaggctgaagtgggaggatcacttgagcctgggatttcaaggctgcagtaagccatggttgtgccactgcattctagcttgagcaacagagtgagaccctgtatctttaaaaaaaaaaaaagactttcaggcctaaccttacatttgagaaactgtagattattgtttctggtaattggtgtcatggaccctgatttcttggttttattttattcatacaggattaatgcagtatcgaatggacaagtcc

SEQ ID NO: 65356 - DNA, 601 bp, Human; identical to SEQ ID NO: 37383

SEQ ID NO: 65357 - DNA, 601 bp, Human; identical to SEQ ID NO: 37384

SEQ ID NO: 65358 - DNA, 601 bp, Human; identical to SEQ ID NO: 30449

SEQ ID NO: 65359 - DNA, 601 bp, Human; identical to SEQ ID NO: 30450

SEQ ID NO: 65360 - DNA, 601 bp, Human; identical to SEQ ID NO: 30451

SEQ ID NO: 65361 - DNA, 601 bp, Human; identical to SEQ ID NO: 30452

SEQ ID NO: 65362 - DNA, 601 bp, Human; identical to SEQ ID NO: 30453

SEQ ID NO: 65363 - DNA, 601 bp, Human; identical to SEQ ID NO: 30454

SEQ ID NO: 65364 - DNA, 601 bp, Human; identical to SEQ ID NO: 30455

SEQ ID NO: 65365 - DNA, 601 bp, Human; identical to SEQ ID NO: 30456

SEQ ID NO: 65366 - DNA, 601 bp, Human; identical to SEQ ID NO: 30457

SEQ ID NO: 65367 - DNA, 601 bp, Human; identical to SEQ ID NO: 30458

SEQ ID NO: 65368 - DNA, 601 bp, Human; identical to SEQ ID NO: 30459

SEQ ID NO: 65369 - DNA, 601 bp, Human; identical to SEQ ID NO: 30460

SEQ ID NO: 65370 - DNA, 601 bp, Human; identical to SEQ ID NO: 30461

SEQ ID NO: 65371 - DNA, 601 bp, Human; identical to SEQ ID NO: 30462

SEQ ID NO: 65372 - DNA, 601 bp, Human; identical to SEQ ID NO: 30463

SEQ ID NO: 65373 - DNA, 601 bp, Human; identical to SEQ ID NO: 30464

SEQ ID NO: 65374 - DNA, 601 bp, Human; identical to SEQ ID NO: 30465

SEQ ID NO: 65375 - DNA, 601 bp, Human; identical to SEQ ID NO: 30466

SEQ ID NO: 65376 - DNA, 601 bp, Human; identical to SEQ ID NO: 30467

SEQ ID NO: 65377 - DNA, 601 bp, Human; identical to SEQ ID NO: 30468

SEQ ID NO: 65378 - DNA, 601 bp, Human; identical to SEQ ID NO: 30469

SEQ ID NO: 65379 - DNA, 601 bp, Human; identical to SEQ ID NO: 30470

SEQ ID NO: 65380 - DNA, 601 bp, Human; identical to SEQ ID NO: 30471

SEQ ID NO: 65381 - DNA, 601 bp, Human; identical to SEQ ID NO: 30472

SEQ ID NO: 65382 - DNA, 601 bp, Human; identical to SEQ ID NO: 30473

SEQ ID NO: 65383 - DNA, 601 bp, Human; identical to SEQ ID NO: 30474

SEQ ID NO: 65384 - DNA, 601 bp, Human; identical to SEQ ID NO: 30475

SEQ ID NO: 65385 - DNA, 601 bp, Human; identical to SEQ ID NO: 30476

SEQ ID NO: 65386 - DNA, 601 bp, Human; identical to SEQ ID NO: 30477

SEQ ID NO: 65387 - DNA, 601 bp, Human
caggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtca

SEQ ID NO: 65388 - DNA, 601 bp, Human
cctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggagractggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtccc

SEQ ID NO: 65389 - DNA, 601 bp, Human
agtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtcyctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagattt

SEQ ID NO: 65390 - DNA, 601 bp, Human
ccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggmgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcggg

SEQ ID NO: 65391 - DNA, 601 bp, Human
gtggtatcatggagggggatccctggagcaaggaagacctcaagggagaagcagagagatttagtttctgggttcttgccaaaggaagggaaattaggagggaataaatagaaataattgcctgtataaagggccctggggaggagggtgaagacagaggcaccctaggccttaaacttcatctagactccctgggctgtgctgacttctgacccttttagggacctttgtttttgctgacttgggaaaagttgcttcctccagggagacaactcttcttagaggggagagtccataatgrggaagccctctggggtgatttatttatgctgtcaggtatagagctccgtcaggctaactcaccctgtggggccctatcaccccctcttatcacccaggctttttccctaaccaacctctgtgcctttgggggaaaggctttttgatttcccagtctcattcaaggcaatggctgaaaaatgtgcataggtttttctaggggcaggtggggaaaaggtagggacgtggattgtgtgacccagcccatctaatgcctgacatggtgcagatgggcaagacttggaggcaggctgtgggctgt

SEQ ID NO: 65392 - DNA, 601 bp, Human
tttacccttcgtgcttgtgatattcctttaagtgttctcatctaggatagctgggcattaagcccacactccaaaccaaacaaaaatgggaaggggggtgggaagagagggggtcaggaggcagaattgtgggaagtgaaattaaatcaaactgaaatgtgtaatgacccagttggggatgtttttctcattcttctaaaatgacatgcagggataaagacaaaatagatgcatttggcatctttttttttatgagaaaagaaaatctgtttatatgcctagagtaaaaatgtctcaggamcatcattttctactgtaaaattatttcaattaagccaccagtttgcttcattaagattggttcacttaaaagcagtgatgttgccacaattattttggttcatttgtagcaaatcagaaaaaggattctccccagaaatgcaatattttggactctgtatatgagcataaacactgaagtcacttgaaaagagagaggatttggagtttttgtgttctgctggatgtgggaagcaacgggtagaacttttgttgtggagcagagtagacgcaataggaattgccagatattgctcagtat

SEQ ID NO: 65393 - DNA, 601 bp, Human
gaggatttggagtttttgtgttctgctggatgtgggaagcaacgggtagaacttttgttgtggagcagagtagacgcaataggaattgccagatattgctcagtatccctcttgcttgtagatatgaaaatgtaagtctcatttgcctccagaaccatcggcacaatccatttcatttcttccctgatccttttttcctgtctaaataacatccatttgtgatttttttcaacacggtacatgacctgtttctaattggctatctcttgggttgtttttgtacattcatgtttgttttatstgattgaaaaatattaatgatttcgtaggtgagctaatgtatttatctgctgagcgagttcaaagggcagagttcagctatggttcaggttaattgaacaggaagcagtgagctctccaggctgtgttgaacaagggatcagtcccttaaaatatcacactcagcaaacacaatttcactgtcttcatcctagagtctgatgtaaaaggctcagatcaacttggatcacttgtttaaaaaaccaaagcaaagcacagtaactgcagcaataccctggagtccccctcggggaagaagagt

SEQ ID NO: 65394 - DNA, 601 bp, Human
tgttgtggagcagagtagacgcaataggaattgccagatattgctcagtatccctcttgcttgtagatatgaaaatgtaagtctcatttgcctccagaaccatcggcacaatccatttcatttcttccctgatccttttttcctgtctaaataacatccatttgtgatttttttcaacacggtacatgacctgtttctaattggctatctcttgggttgtttttgtacattcatgtttgttttatctgattgaaaaatattaatgatttcgtaggtgagctaatgtatttatctgctgagygagttcaaagggcagagttcagctatggttcaggttaattgaacaggaagcagtgagctctccaggctgtgttgaacaagggatcagtcccttaaaatatcacactcagcaaacacaatttcactgtcttcatcctagagtctgatgtaaaaggctcagatcaacttggatcacttgtttaaaaaaccaaagcaaagcacagtaactgcagcaataccctggagtccccctcggggaagaagagttttctcattggctaattgctttattggtagcactgacctgcagagcagctgcagg

SEQ ID NO: 65395 - DNA, 601 bp, Human
tatccttgtccccattccccaccctgcagatcactacccatgcaagcattatcttcctagaagtagcttaaagggctttttcctggtcctttgaaactgtaacctctgcctcttctaattcattgccaaggagaaatcaacagttctgctgtcataggtgaggtgatttgcccatcctgcacattgaggtaatagtctcctgcttagttggactgtgcttgggggaagagaagcaaagaaagcaaaaaatagccgtgggagggaaaacgaatgattatgtgtggaagaaaaatggctccgwtgattgtgccagtgagggctgtgccaactgtaaggtgttctgcaaagataaaatattgtacaaaggagagaggatgggagagaattagcatctacagggaggacatcgagaaagagatatgccaaatcagcaaactcgagtttaggctttgtgaaatcccctggaaagagaaaaagtgaaccagccgttttgcaattgcaaagaagtgagccagtgagctagacttcgagccagactgtggagctggctgtagctctgtgggtggcagctatttccacacttgcttcacatggacccctg

SEQ ID NO: 65396 - DNA, 601 bp, Human
cagcaaactcgagtttaggctttgtgaaatcccctggaaagagaaaaagtgaaccagccgttttgcaattgcaaagaagtgagccagtgagctagacttcgagccagactgtggagctggctgtagctctgtgggtggcagctatttccacacttgcttcacatggacccctgcctggagcccctggtagcagagcgcctgtgggtgggttgctgcctccacgccccggcgcaggcttcagcaccacgaacagcgccatggaggaacgctgtttgagcgaattggagatggaccctctacygcggttaaatccaggcaagagcctgaccagtagctctagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatt

SEQ ID NO: 65397 - DNA, 601 bp, Human
aaagagaaaaagtgaaccagccgttttgcaattgcaaagaagtgagccagtgagctagacttcgagccagactgtggagctggctgtagctctgtgggtggcagctatttccacacttgcttcacatggacccctgcctggagcccctggtagcagagcgcctgtgggtgggttgctgcctccacgccccggcgcaggcttcagcaccacgaacagcgccatggaggaacgctgtttgagcgaattggagatggaccctctactgcggttaaatccaggcaagagcctgaccagtagctcyagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccc

SEQ ID NO: 65398 - DNA, 601 bp, Human
agcagagcgcctgtgggtgggttgctgcctccacgccccggcgcaggcttcagcaccacgaacagcgccatggaggaacgctgtttgagcgaattggagatggaccctctactgcggttaaatccaggcaagagcctgaccagtagctctagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccytctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcat

SEQ ID NO: 65399 - DNA, 601 bp, Human
ggtcttttctgtgtctccctttcttccccatggctctggaggggagatagcatatctttgagctccccatggactgctggtccatggctgaacccacaccaggtattcttttttgagtaagtcatttggtggcctcctgtctatctttacagaagcccctattctcaacgagagaataggttgggtatgtttacttacatctatcattcttttctagcttcttctctcaaaagggggtattcttttcttattttatttttttgatctggagccgtactttgtcacccaggctggagtgcartggtgcgatctcggctaactgcaacatccgtctccagggttcaattgattatcctgcctctgcctcctgagtagctgggattacaggcacctgtcactatgcctggctaatttgtgtatttttagtagagatggggtttcaccatgctggccaggctggtctcaaactcctgaccttaagtgatccacctgccttggcttcctaaagtattgggattacaggcgtgagccactgcacccaacctgaaaaaggggtattgttttctataaatgctttggtcattgttggaaatattggcta

SEQ ID NO: 65400 - DNA, 601 bp, Human
tcagaggccaccctgttctctggctacggcaccatagcctagacatgggtgtcaccaaaggctatacacttctttacctccttttctgccctcttcctaaaggaagcatctggaaccagaaggagtccatatcgctagccccactcctccctaaccagttctccatcccgagccttagattcaggcttgcataggcagattctggaaagtccattaaaagggcaggatgtggagtaaataggtgattggattggagggtaaagggcggaaaattcacagcagagacaggtggacttttctractggataagctacaccaactcatgaatccaagtattccacccctggaaagcaagaggtgaaagcaagttggttccattggtgaaagcaagtcacctgcctgagcccagagacagggtggaaaggctctacaaagttacatggcaggaagcatgggcacagaaaaggcaagcatgaggaatggggggggcggtgttggtgtttttctttgtttgtttgttttgttttgtttgcattctacctcatgccatgtattttagctcatttattcttggaagctgccactgctatggtgatacac

SEQ ID NO: 65401 - DNA, 601 bp, Human
aaggatgtccaatagtatagggctaattttggcaacacagaagataagtgtgggggtatttcacattcataagtaacaaacctatgcccacctggacaggaaccacgcctctttgtattgagactgtttgtgacatgcttgatcttctcgactagatcatagcaagcagggaccctgagctttgttctcctgcatcttccctttagccccaccacaatgcctaacacatagtttgcacttagtaaatatgcaaggataaatgatccccagaatcccactgctctagtgtcccaatgggagwtcccctcaagacccaccaggtgattgcttgtagctcaacctgtattttattttattttattttattttattttagagacagagtctcactctgtaacacaggctggagtgcagtagtacaatcttggctcactgcaacctccacctactgggttcaagctattctcctgcctcagcctcccaagtaggtgggattacaggtgcccaccactatgcccagctaattttcatatttttagtagagatggggttttgccatgttggccaggctggtctcgaactcctgacctcaggtgatcca

SEQ ID NO: 65402 - DNA, 601 bp, Human
aacaaacctatgcccacctggacaggaaccacgcctctttgtattgagactgtttgtgacatgcttgatcttctcgactagatcatagcaagcagggaccctgagctttgttctcctgcatcttccctttagccccaccacaatgcctaacacatagtttgcacttagtaaatatgcaaggataaatgatccccagaatcccactgctctagtgtcccaatgggagatcccctcaagacccaccaggtgattgcttgtagctcaacctgtattttattttattttattttattttatttttgagacagagtctcactctgtaacacaggctggagtgcagtagtacaatcttggctcactgcaacctccacctactgggttcaagctattctcctgcctcagcctcccaagtaggtgggattacaggtgcccaccactatgcccagctaattttcatatttttagtagagatggggttttgccatgttggccaggctggtctcgaactcctgacctcaggtgatccactcaccttggcctcccaaagtgctgggattacaggcgtgcgccaccacgcctggcctcaacctgtattgtaaaa

SEQ ID NO: 65403 - DNA, 601 bp, Human
atcccctcaagacccaccaggtgattgcttgtagctcaacctgtattttattttattttattttattttattttagagacagagtctcactctgtaacacaggctggagtgcagtagtacaatcttggctcactgcaacctccacctactgggttcaagctattctcctgcctcagcctcccaagtaggtgggattacaggtgcccaccactatgcccagctaattttcatatttttagtagagatggggttttgccatgttggccaggctggtctcgaactcctgacctcaggtgatccrctcaccttggcctcccaaagtgctgggattacaggcgtgcgccaccacgcctggcctcaacctgtattgtaaaatagggtttcactttaaacttttaaattttgttctactacaataattaccaaattccaggggagcaaaggtccaagcctgttgcctacagaattaaggcatccaattcagatctcaattattttgtgttaagaaaatctaaacaaagcaaacactgcttagggtttaccaatgaataaagaagcaagttggaagggatatcaaaaagatcaaaatgtttgcgcattt

SEQ ID NO: 65404 - DNA, 601 bp, Human
tcaaaatgtttgcgcatttataactttaacaatgtctaagtttttttaaacttaggttctacatctggagcatacttttttaaaaatcataagcagtgttaaaaaatacttgacagttttgtcttgattcttaatgtgggtgttaagggatgccgtccattagtgagtacaccccagatcatgtgtttattgcatcctccttcttccctgcctgtcccctaatgatctggtgcacagagggctacttgagctgagttatatggatctcagttgctgtcatttgcacatacttaattcagasaggtgatcacattgatttccaagacccaatttttaagacactgtactcacgtagatatcttagctgctctgactatgttgtctgaaaaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcatcctacgaatcaatacccagtgctcaca

SEQ ID NO: 65405 - DNA, 601 bp, Human
gctgtcatttgcacatacttaattcagacaggtgatcacattgatttccaagacccaatttttaagacactgtactcacgtagatatcttagctgctctgactatgttgtctgaaaaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcrtcctacgaatcaatacccagtgctcacagttcccctgaatgtgaagaaatggcacccttagtaggcagttgtagtctcctgtaattcataacaagctgtccctagttattgaacgtgtttaccctgtaatcccagaaagttcttgtgtttttatgcctatggttttgcaggctggtttattcagattctgagcattgtgaactaaattcataacttctttcatgcattagccggagtcataggactctgatttacagactcgcagtccagctcacagcggctagctttctttgggtcata

SEQ ID NO: 65406 - DNA, 601 bp, Human
aaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcatcctacgaatcaatacccagtgctcacagttcccctgaatgtgaagaaatggcacccttagtaggcagttgtagtctcctgtaattcataacaagctgtccctagttattgaacrtgtttaccctgtaatcccagaaagttcttgtgtttttatgcctatggttttgcaggctggtttattcagattctgagcattgtgaactaaattcataacttctttcatgcattagccggagtcataggactctgatttacagactcgcagtccagctcacagcggctagctttctttgggtcataccagagtttcatctgcatggccaaaggggtagaattccaacttgggtttgaaagcaaataggataaattgtcagaagatgtattcctgtgtacatctttggaaacaagacatagg

SEQ ID NO: 65407 - DNA, 601 bp, Human
tgtcaatgacagcatgagccaaacagatccagtttgtatctgagccaccatttactagctctgtgatgtcaggcaggggacgactcttgaagagcctcagttccctcctctgtaggaggaggacaaggtaggtcctgacgttatctagttggtgtacagattaaatgagacgccataagggtatatggcacctggtacattgcctcctatctcctcagttttacagctaacatcctattacacatgggccacatctgtacttcaacataaattttttgtcattttctcagatgagatttargatgagtgagattgccagactctacactcatcactgggcatgctgtttgcaaactggccaaccatgcagccggactatttactccccacccccaatgtccttttaagactcccttaacagttatggacattttgctaagctcgtgcttagaacccagaagttgactgtgcacacagtaggttctgactgaatccctacaggcttagattggaatacagtccattttgcaagtgtggtatgtattgagcagacattctgtatttgatggaagttcacatataaaaatggcaactgagccaa

SEQ ID NO: 65408 - DNA, 601 bp, Human
cttggctccctggagagctcctgttttggttcacaccatcatctttattcccaaattaggatccttaacaagaaaagagaaaagaaagaaaacctgtagacatccagatgttgctttttctgaagtaacaactttatttgataatattttgaagccatgggccaccgaattctcaacatgcaagtttatttaaacagtctctagtatcctttcctgaccccaaattactttcaagcattaattgtcctagtggtttcatggccatattatttcatattcattagtgttttcatgaaaaatkataacactaattagagtggcttccagttaattcacttggtgattcattactctctccttcttggtgatctgcatgtggtcatcctggagaaagcatccaagggtaattgcagctctattccctgagtgattgcctaatgccattagttctgatccacaggagcatctcgggaagctctgatggggtctggttacagctgcacccttgtcctgccctttggatgcagggagaaagggaagcctgcagtgaggactggtcctccggaggggtctagggaaacagaggggagggacgtcttag

SEQ ID NO: 65409 - DNA, 601 bp, Human
acggaaagtacaatggtgcttgccaggtgcctgagagagggaaatggaaacttgtttaatgagtatagagttttagttctgcaagatataaaagttctggagattgtacaagaatgtgaatatacttaacactatggagctataaccttaaaagtagttaagatggtaaattttgttgtgtatattttaccataatttcaaagaaagattgtttgttatttatattgtattgcttgctcaatttttaaaaaaaattaaaaatagaaaaacaaaaagccaggtgcggtggcatgtacctgcrgtcccagctactggggaagctgaggtgggaggattgcttgagcctgagttctggactgtagtgccccaggcccatcaatgtcctcactaagttcaccatcaatacggtgacttcctgggagtggggtatcaccaggttggtgagggaaaaaacaactactgccatgttgctttcagttcttttggagtatatactcataagtggtatttctgggtcatgtgataattcacactttaaatttccgaggaactgccatactatttccatagtggctacatcatcttacagtcccaccaacag

SEQ ID NO: 65410 - DNA, 601 bp, Human
ggtgggagttgaacaatgagaatacatggacacagggcggggaacatcacacactggggcctgttgtggggtagggggctgggggagggatagcattagaagaaatacctaatgtaaaagacgagttgatgggtgcagcaaaccaacatggcacatgtatacgtatgcaacaaacctgcacgttgtgcacatgtaccctagaatttaaagtataataataaaaaaaagttctgccactcaaagagaaccacattaatattttgcttttattaaaattatttttaattatttaagcaatgcrttaaaacattctacttataaaaatcaaaacattaatgatcagaataaagtcctctttgcctatctcctttaataccagtcttcttcattacttcccagcagtaaccactcttctggctacaaagagtgggtctgccaatccaggcacttccagtgcatttatttacctacatatgtactcatataaattgtataaataggtagaaagacagatagatagatcgataggtatcttaggtttgcgtattgttttcacataagtggcatcacactgcatgcatcattccaaagctccttcttt

SEQ ID NO: 65411 - DNA, 601 bp, Human
ggttcttgcaacccacatttattgcatagtgtcctatggcatgactattttcatttatttagccatttctgttttgatgggcaattaggctgtttaccatttttggttgtttgcattatttgctaagcagtgatgagtgaacatccttgtacacacctccctgtgtacccatgggaatgtttcctagggtggacaccgagaagcaaaatgagaggtcatggagatgcacatactgtaattttgataggcactaccacactgtcttcgaaattggctccccatcagcagtggaggagagagytcctatttccctgacacttgccagaagttaatatattagccattttacttttttttgcatagttgctggatttaaaaataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatgg

SEQ ID NO: 65412 - DNA, 601 bp, Human
ataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatggttaaagaaacaagacccatctatatgttgccttcaggaaacccacttcacccataaagacacacatcgactgaaagtraaagagtagaaaaaatatttcatgcaattggaaaccaaagaagagtgggagtaactatacttatatcagataaaatagactacaaatcaaagactgtgaacaaagatgaggagggtcactacgtaatgagaaaagggtcaatacagcaaggggatataacaattataaatatctatgtgcccaacactagagctcccaggtatataaagcaaacattaatagatctaaagggagggatagactataatatattgaaaacattttatcccatggtattattttgaaacttaataaggcttc

SEQ ID NO: 65413 - DNA, 601 bp, Human
atttttagtagagatggagtttctccatgttggtcaggctggtctcgaacttctgacctcagatgatccacccgcctcagcctcccaaagtgctgggattataggcgtgagccaccatgcccggcccaaataaatatttttgttgctcttcctttactttatgtgttttgcttcttgggtcatttttatttattttatttattttttagaggcaggatctcactctgttgcctaggctgagatgcagagccccaatcatagctcactgcaacctcgaactcttgggctcaagcgatcctcytacaaaagcttcccaagcagctaggactacaggtgcctgccacctcatccagctaattttattttatttttttcatacagatggagtcttgctatgttacccaggctagtctcaaactcctgagctcaagcaatccccccacctcagcctgtgtgctggggttataggcgtgagccaccatgcctggccttgggtcatttttaaacatttgaatctttattctttaatttttctgaagttgctttttataaattatgtgaaattggaatctatttttttaaaatctcaaatggatagcca

SEQ ID NO: 65414 - DNA, 601 bp, Human
tgcctaggctgagatgcagagccccaatcatagctcactgcaacctcgaactcttgggctcaagcgatcctcctacaaaagcttcccaagcagctaggactacaggtgcctgccacctcatccagctaattttattttatttttttcatacagatggagtcttgctatgttacccaggctagtctcaaactcctgagctcaagcaatccccccacctcagcctgtgtgctggggttataggcgtgagccaccatgcctggccttgggtcatttttaaacatttgaatctttattctttaayttttctgaagttgctttttataaattatgtgaaattggaatctatttttttaaaatctcaaatggatagccaactaatccaacagtttctgaacaattcatctcttctcactatttgaaatgcaatactttctttataatatattatattcccttatgtacttgggtcagtttctgcactccattctgttccatggatctattaaattctgtgtcaacgtcatactatttaaattatttttgctttatgatatatcttgagctctaataggatatatattttctctcctcatcttctgtt

SEQ ID NO: 65415 - DNA, 601 bp, Human
gtcttttgaaaaacagaagttcttaaatttttttaagagacagggtctcgctctgttacccaggctggagtatagtggtacgatcatagctcactgcagctttcacctcctgggctcaggcagtcctcctgcctcaaccttccaagtagctgggactactataggcatgcaccaccacgctggctaacttcttaaaattgttttttgtagagacagggtctcactttgttgcacaggagaagttcttaattttaacgggccccaatatataactatttctctttgggctagtactttttgrgtactaagaaatctttcctgtgattatgaagaattaccctatgttattttctttctttttttttttttttttttttttttgagacagagttttgctcttgttgcccaggctggagtgcaatggcccaatctcggctcactggaacctctgcctcccaggttcaagcgattctcctgcctcagccttccgagtagctgggacaacaggcatctgccaccacgcctggctaatttttgtatttttagtagacacggagttttaccatgttggccaggctggtctcgaactcctgacctcaag

SEQ ID NO: 65416 - DNA, 601 bp, Human
tgacatgaggtaggggtcaagaattacattgtgacacaatgcctatccagttattccaactccattacaggagagaacacatgttcctcatgttctgcatatccaaccttgtcattgaatccagtgtccatatgtgtatggatctatttctgggtttctgtccttttccactggtctggagttgtatgtccttgctgcagtattacaccatctattgtagcctcattaaagatcttggtagttgaaacagaaagttgtcctacgttgttcttcttcatctagaatagcttaactgttcttygatttttttgcattcccagttaaatttcagagtcagcttgtcaaactcaaactttctttcctttcctcttgaaaggaaggaaagaaggaaggaagagagggagagaaatctgctgggattctgattagagattgcattgtacctgtagatcaatatggaaagaattaaaactcttcacaatattgagttttccaatcaatttatttaggtattctttaatttctctaacaaagttttgtagttttccctgtcaatgtcttgtatacctattgctagatctattctatgtacactcttgat

SEQ ID NO: 65417 - DNA, 601 bp, Human
atttcatcagtttcctaaattcctttataaattttctttctaaattttcacttcttatttattttttcttattttattgtattggctccttttccgatataacattgaatcatagtggtgcttacacacctcatctgaaatttcaacactttgaaacatttctttctagtattttttttgttttttgtttttttgtttttgtttttgtttttttatataggcatgttgttttgttttgcttttcatgtttgacgtatctgaaattgtctttgactggacttccaaatctggtggtaaactrtgcaagacagagatacttttccaaaggaatgtcttttgttcaaactatattattcacataaagatgaaaagtaataacgaaacaatttgtttttaaacattgagatttggttgtgaatggagacaccgaccctttttccttcctgcagattcattagtgtagtcttaacaaagaggtgctcttcattcatgtaataaaactttttaggatgtttggaaggagctcagggatattcgtagccacatagggctgttggccaattcttttttaagacaatatcacattcttgagcttttaagt

SEQ ID NO: 65418 - DNA, 601 bp, Human
atttcctccaatgccactactgtatttctcattttcctgcaaattttaaaaatcttactcctctttttttgcggggggcgggggttgtttgtttgttttgagacagggtttcattctgtcacccaggctggagtgcagtggcatgattgtggctcaccacagtctcaaccctctgggctcaattgttctccctgcttcagtctcctgagtagctgggaccacaggtgcacaccacccacgcctggctaatttttgtagtttttgtagagacagggtttcgccatgttgcccaggctggtcrcaaattcctgggcttaagcaatccgcccgccttggcctcccaaagtgctgggattacaggcatgagccacctcatccagcccatcttttgtcttactactttttcattacatatggttacttacaaattgctattttcttcttaataattttctgttcctgtttcataaaagccacctctttttgcatcatattgttatatcaaatgattctctaaaatgttctttaagtttctggaagatattatctggtaaattttctctggttttcagatgaggatccctttttgtcttctactatt

SEQ ID NO: 65419 - DNA, 601 bp, Human
ttggccttggccttgtgtttaggtaaaaaatctccagatcccccaaaacagactgactgcagtcctggtttttggtgtgctaagttttgtgtttcattacaggacttcgagatgattttagcagaaagttgaagaagctgccccatgctctcctagccattttaagccagatgtttgtatctggaattaaatatttgttttagcaactcacgacttcctggatggcttacaggaatgcagcttggcagcagagctaaagatccctctttgccaggcttctgcataggcagaagagatgacygggaattgtgatttcaaaggctgagtgccccaaactatttattctaataggaaggtgggaaataaaagccccactggactagacaggagggaatatgggttctcagggctgtgtcactgcataggtgaccctagctgggagttctgatctcttatttctaaaaacaaggttagaccaagtgctctctaaaatcctgcctttctaggagtctgtggttttagcagctgacctagaccatctgctattagaagcctgttctttgaggctactcatgtttgttagagcctctgctggagagaa

SEQ ID NO: 65420 - DNA, 601 bp, Human
ataagaaagtcgtgagacatccaagagccctcatttcctgagtccccttcagtgactttgtattgaaagtaaaaatagagacaggaaataaaacttgtttttttcagagaatgtctttgaagcttgggaacacagaatggtcgctgtgcggtctgcctccagccgacagtaagtggacactggggagttgctctagcgcttgtcaagaccagcttcgacatccaagtgaaagcagaggcggcggtgtggagaaagagcagagatttgccattgatcatccacatttcctttggtttttttktttgtttgtttttttgttttttttcctaagacagagccttgctctgtcacccaggcgggagcgcaatggcgtgatcttggctcactgcaatctctgcctcccgggttgaagtgattctcctgcctcggcctcccgagtatctgggattacaggcacacgccaccacacttggctaatttttttttatttttagtagagacagggtttcaccatgttatccaggatagcctcgatctcctgacctcgtgatccacccgcctcagcctcccgaagtgctgggattacaggcatgagccacct

SEQ ID NO: 65421 - DNA, 601 bp, Human
agttgctctagcgcttgtcaagaccagcttcgacatccaagtgaaagcagaggcggcggtgtggagaaagagcagagatttgccattgatcatccacatttcctttggtttttttttttgtttgtttttttgttttttttcctaagacagagccttgctctgtcacccaggcgggagcgcaatggcgtgatcttggctcactgcaatctctgcctcccgggttgaagtgattctcctgcctcggcctcccgagtatctgggattacaggcacacgccaccacacttggctaatttttttttatttttagtagagacagggtttcaccatgttatccaggatagcctcgatctcctgacctcgtgatccacccgcctcagcctcccgaagtgctgggattacaggcatgagccacctcacctggcctatcatccacattttctagatgagaggaagaatgtactacaggaaatctccccaggatctgagatttgtcctgtgtcagaggtgaagcccaagacacggctcacaccgacattccagggcagtgccaagccttcccgggctccgggcagctcggaacttggggactttgcccccac

SEQ ID NO: 65422 - DNA, 601 bp, Human
tacaggcacacgccaccacacttggctaatttttttttatttttagtagagacagggtttcaccatgttatccaggatagcctcgatctcctgacctcgtgatccacccgcctcagcctcccgaagtgctgggattacaggcatgagccacctcacctggcctatcatccacattttctagatgagaggaagaatgtactacaggaaatctccccaggatctgagatttgtcctgtgtcagaggtgaagcccaagacacggctcacaccgacattccagggcagtgccaagccttcccggrctccgggcagctcggaacttggggactttgcccccaccctccagcatctccagaatgaggggagtgtgtatgtgtgcatcgtgcatggcccctcctgccttcttgttccttctccctcctgtctcctttttcctcttgctccgccattctcccgcccacaatatctgctctaataagccaggcggcagtgctccaactagcccataggtggttcacgctggagtaccttgtgcaggataatttgccaaatgggttagaggtctgtcttgcaaggcctgtgcatacatccacaattagaag

SEQ ID NO: 65423 - DNA, 601 bp, Human
cttctccctcctgtctcctttttcctcttgctccgccattctcccgcccacaatatctgctctaataagccaggcggcagtgctccaactagcccataggtggttcacgctggagtaccttgtgcaggataatttgccaaatgggttagaggtctgtcttgcaaggcctgtgcatacatccacaattagaagggagtgaaaggaggaggggaacctaacaaccaagaatggctccacatccatttgcacagtgtccaccctgtctctgcccttggcctcccaaatggatgttggtctggaygtcactggctccgctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctttggtgatgcgtcagaaatcacaatgaagcaaggaaacctgcaaggcatctaactgggaactatttatagtt

SEQ ID NO: 65424 - DNA, 601 bp, Human
ggctccacatccatttgcacagtgtccaccctgtctctgcccttggcctcccaaatggatgttggtctggacgtcactggctccgctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctytggtgatgcgtcagaaatcacaatgaagcaaggaaacctgcaaggcatctaactgggaactatttatagtttccaaaatttaggcagcacaaaataatccaataatgattttaagacagaccctccccatccatcaaggcctggctcctcccaggtgggtgatcagtgcttctggcaccagctggccctgagtggccagtggagctgcttagagcctgagccccaagtcttgtgtgttaggccccctgctcccagggtctctgtggcaatgtgctggcacctaattatttgctgaccctg

SEQ ID NO: 65425 - DNA, 601 bp, Human
ctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctttggtgatgcgtcagaaatcacaatgaagcaaggaaacctgcaaggcatctaactgggaactatttatagtttccaaaatttaggsagcacaaaataatccaataatgattttaagacagaccctccccatccatcaaggcctggctcctcccaggtgggtgatcagtgcttctggcaccagctggccctgagtggccagtggagctgcttagagcctgagccccaagtcttgtgtgttaggccccctgctcccagggtctctgtggcaatgtgctggcacctaattatttgctgaccctgagaagcatgcattgctgagatttaccagcatttatggcttactgaatatcaaatatttattagcagagtgtacagttattctatt

SEQ ID NO: 65426 - DNA, 601 bp, Human
catgcattgctgagatttaccagcatttatggcttactgaatatcaaatatttattagcagagtgtacagttattctattttctttcttccttgtttgaattcaaggaatcttattatttttactttaaaggctcttgatcatgcagattagttccaaaggaagggttctctactggacaccatcacctctcccatagtcttgtcattctatcagtactgaagggccaccagttcagagcagggaagtgaaggggggttatttccattcttcttacctcaaacacctgtaggtttctcagrgaacaagcccagaggtacaaatgtgaacctacttttgtaattgatttttccaacataaccccaattgactgccttagttaatctttccaacagaactgcaggccctatgtcctcccgggagagtgccctccttagtggaaagggtcacgctccccactttgcacaagccttcctaggagggaagctgcgagctcttcagctgaaaagcgaaaaggcctcttctgcaggtgtacttttcaaacctgtatccttggaggttaagtgtctgctgacaaatgcacaccctggatggtctctctc

SEQ ID NO: 65427 - DNA, 601 bp, Human
gcctcttctgcaggtgtacttttcaaacctgtatccttggaggttaagtgtctgctgacaaatgcacaccctggatggtctctctccccactccccacccttgccctgacaagatcacattgaactattcagggaaagtatttactgaatgcaaggagaatagagcacttctgcattatttattaggggctaacaatacccatcatatgtagatgatattgatacccatcaatgtatttggacataaattagtatgttaggaaactccagtggtccaaaaccttttaggatctctgacacrtatgtaaaaacacgtcgtagtcttacctcttatatgaggctgggaattggctatgagacaacctcacaaagaaaacaaacatctttaaccttttatttgccattagccctctgggcagttcatctactatcgagtaagacttgaaatcatgaactcttaacctctccttacacaccttctttctgctttctctaaggaaggaagaatgttcacatttcctgagtgtctactctgtgccaagtgttacagcaagccttttgatgtcctggagtgctggacattagcatccccactctatag

SEQ ID NO: 65428 - DNA, 601 bp, Human
ggcagttcatctactatcgagtaagacttgaaatcatgaactcttaacctctccttacacaccttctttctgctttctctaaggaaggaagaatgttcacatttcctgagtgtctactctgtgccaagtgttacagcaagccttttgatgtcctggagtgctggacattagcatccccactctataggatcaggaaactaaggctcacagtcctgcagctgataagtggctgacaaggagtaggaaacagggtcttggcttccatctgagcttcttacagtacatttgactcacccctggrcaggaaggcaaaggtcattcttggcttctgtatcagttacctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcaagga

SEQ ID NO: 65429 - DNA, 601 bp, Human
ctcttaacctctccttacacaccttctttctgctttctctaaggaaggaagaatgttcacatttcctgagtgtctactctgtgccaagtgttacagcaagccttttgatgtcctggagtgctggacattagcatccccactctataggatcaggaaactaaggctcacagtcctgcagctgataagtggctgacaaggagtaggaaacagggtcttggcttccatctgagcttcttacagtacatttgactcacccctgggcaggaaggcaaaggtcattcttggcttctgtatcagttayctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcaaggactggaagattctgacccggtgttgagttgctcttacttca

SEQ ID NO: 65430 - DNA, 601 bp, Human
ctgggcaggaaggcaaaggtcattcttggcttctgtatcagttacctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcraggactggaagattctgacccggtgttgagttgctcttacttcacaggcttcccagaaactgtggaggctgggaaggggttttccaagatcaaatccaggatccagtgctaattgagtcaccctaaacaaacgtgtttccttctccaagagtaaaatgggaatccatacctctgccccatcttcctttcagagatgttgtgaaaagaaattcccaatgggggatccagactttggcttccactgggactcacctcactgtgccttcagttcctaatgtgaaactgacaaccctggactgg

SEQ ID NO: 65431 - DNA, 601 bp, Human
ccaacaccccattactgctcagcatccaaatatccaaagacttttgttactagaaggaaaacgcacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgacyctgaccacatacctttgtgctgcccatgggtaggcgatggacagggccagggccggttagtctgggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatc

SEQ ID NO: 65432 - DNA, 601 bp, Human
cattactgctcagcatccaaatatccaaagacttttgttactagaaggaaaacgcacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacrtacctttgtgctgcccatgggtaggcgatggacagggccagggccggttagtctgggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatccagtggcca

SEQ ID NO: 65433 - DNA, 601 bp, Human
cacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacatacctttgtgctgcccatgggtaggcgatggacagggccagggccggttagtcygggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatccagtggccaccagggagaagcaagttggtgtctgaagatctcagagagggcttgtgcccgagg

SEQ ID NO: 65434 - DNA, 601 bp, Human
ggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacatacctttgtgctgcccatgggtaggcgatggacagggccagggccggttagtctgggtgtcagagggcagctgagctcctagaacgcccaggagcagccactctggaggcaaagtagayctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatccagtggccaccagggagaagcaagttggtgtctgaagatctcagagagggcttgtgcccgaggccagggcttcccttgttttaccctgggaacccagtgttttgaaaaatttatctaccaaggaacct

SEQ ID NO: 65435 - DNA, 601 bp, Human
gacctcctgaggggcaaaaatccagtggccaccagggagaagcaagttggtgtctgaagatctcagagagggcttgtgcccgaggccagggcttcccttgttttaccctgggaacccagtgttttgaaaaatttatctaccaaggaacctatatttttaggcagtagctgtctgccatccttgttaatcacagattatacacagatgtgtacatgcctgccagtaccaggtcctgggccacaggacacaaccagcatgaccaatctgagtcaatattatttctttcaaaaagtggggaaasgtagccttattgtaggtaaacaaatgacttctcttcgagtctttgaaatggaagcgagcgcttggccttccatgtggtcctacataggacctgcttccctgtgagagggagggagctcaagaatgtctgagggcttttgggatctacacccacctccccatcaggcagtgacacatcagctcctggcatgccctccctgctttcctcctaaaagagagaggagaagaatcagatccaaatggtctagacagggctgggctaaccttgcaccttccgtggcagaactggctttgagcagtt

SEQ ID NO: 65436 - DNA, 601 bp, Human
gagaccctgaccagcatgtgactgtgtcaagactgaatccatcaatgccactggaacacctgctgtttcgttgggtttctatcgcatccttgggttggagggagctattgacactttcctggctgttcaaaaatgggcacatgtggactatagagtgtagtaattgaacagcaccaaagccgtttgcactctgcttgtgcctgcaggcacacctggctccacagcccgggtctgaggatgctgaggtcacagcctcacaccagctcccagacgtcattggatctgtctcctttttcttagrctttcaaggcaggtgttctccctcctgtttttattttcctttagctcctgaccaactgcttttgtcaaaatcaacagctggcaattgctagctataaaaaccctgggcaacatatggacatactgcctcattatttagggcatttgggcttgctgtacacttctagactgcaagctacagctttgcatttgttgctgtggcatctggtggcttccaaaggctgttgggaaggcataggcaggatgtattgatctgttctctctgtgcagtttgcttcacgttaagtctttaatattttta

SEQ ID NO: 65437 - DNA, 601 bp, Human
ttattttcctttagctcctgaccaactgcttttgtcaaaatcaacagctggcaattgctagctataaaaaccctgggcaacatatggacatactgcctcattatttagggcatttgggcttgctgtacacttctagactgcaagctacagctttgcatttgttgctgtggcatctggtggcttccaaaggctgttgggaaggcataggcaggatgtattgatctgttctctctgtgcagtttgcttcacgttaagtctttaatatttttatcttaaatatgtgtgtgtatatatatatatwattttaaatatatgtatctcacacaaaatataatccgacaagccaatgtggacctgtacccaaactgtctaatcaccctattaaaagcacaaatacagcattatctgaagaataatcaatattggtatgaaaattgagagctatgtggttaatccaaaggagcgtgaattgacagaggacctcagccaatgtttgcagaagatatttgcctggattttgttatcaggagattatcatgcatcactatttattcagaatcctccagatgaaggcttgacaccagttgtcccaggggtaggg

SEQ ID NO: 65438 - DNA, 601 bp, Human
ctacatcttaaaaggggctgcagaggtttatagaagcacagattccagaaccttgccccacatggtgaaaatcagaatttctgggggtggagacccagaggctgccctgcaaagagggcccctctgatgtgcagttgggtatgggtgccattccctacaagagaagtgtttattctttctttccctgggtctgcagcaaacctgggatgcggtgtcagtgtcatcacatatactccaaggtctccatgtatttccttttaaaatgaaaatcatttttcctgatttgcctagctcagagttmctggggtaatacaatgagaaggagagtatgaagtgaagaggtacctgttatctcacttaagcctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgca

SEQ ID NO: 65439 - DNA, 601 bp, Human
aatacaatgagaaggagagtatgaagtgaagaggtacctgttatctcacttaagcctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgcagaatcccmggccctgtccaggctgaactgcatgagaatctgcgttttgatgagccctccagatgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaattagcaaagaagaaatcattaccggtaagctgttggaaggatggcagtgagcagtcttagccctttctgtctgagttccc

SEQ ID NO: 65440 - DNA, 601 bp, Human
cctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgcagaatcccaggccctgtccaggctgaactgcatgagaatctgcgttttgatgagccctccagrtgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaattagcaaagaagaaatcattaccggtaagctgttggaaggatggcagtgagcagtcttagccctttctgtctgagttcccactgcaggggaagcgctcctcatccaagaaagccaaaaggccccaaaagaatga

SEQ ID NO: 65441 - DNA, 601 bp, Human
acccttgcaactcaaaccgaggcatgtggaccagcagcatcagcatcacctgggtgctcatgagaaatgcagaatcccaggccctgtccaggctgaactgcatgagaatctgcgttttgatgagccctccagatgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaatkagcaaagaagaaatcattaccggtaagctgttggaaggatggcagtgagcagtcttagccctttctgtctgagttcccactgcaggggaagcgctcctcatccaagaaagccaaaaggccccaaaagaatgagttttaagatgaaaacaaattgtttttatgtggatgtgttgtgtgtgtttaattttgaagacaatatgaatacttttagaaatgagagaaggaaaaatcaggaagaaagtttagccaagctgatacagcctagcagctttcccattcaggggctctcctcttcctgcc

SEQ ID NO: 65442 - DNA, 601 bp, Human
attaccggtaagctgttggaaggatggcagtgagcagtcttagccctttctgtctgagttcccactgcaggggaagcgctcctcatccaagaaagccaaaaggccccaaaagaatgagttttaagatgaaaacaaattgtttttatgtggatgtgttgtgtgtgtttaattttgaagacaatatgaatacttttagaaatgagagaaggaaaaatcaggaagaaagtttagccaagctgatacagcctagcagctttcccattcaggggctctcctcttcctgccctttgagagtatcagkgcattttgattatttcaggaatgattcatttatattactttatagcacacagcatccagcagggagggcagccagttaggtagaaggaaattcagcttccaagtatctttcccgtaagtgtttgtcttcaggttaaatcctgtcttagtctgttaaggctccagtaacaaccacaacaacaaaataccgtgacttagtgcttataaacaatagaagtttatttctgacagttctggaggctgggaagtctaagattaaggtgccagcggattcagcgtcaggcgatagtctgtgtcctgg

SEQ ID NO: 65443 - DNA, 601 bp, Human
aaatcaggaagaaagtttagccaagctgatacagcctagcagctttcccattcaggggctctcctcttcctgccctttgagagtatcagtgcattttgattatttcaggaatgattcatttatattactttatagcacacagcatccagcagggagggcagccagttaggtagaaggaaattcagcttccaagtatctttcccgtaagtgtttgtcttcaggttaaatcctgtcttagtctgttaaggctccagtaacaaccacaacaacaaaataccgtgacttagtgcttataaacaayagaagtttatttctgacagttctggaggctgggaagtctaagattaaggtgccagcggattcagcgtcaggcgatagtctgtgtcctggttcacagagaagactttctcactgtgtcctcccgtggtagaaggggcaagaggtctctctcaggcttattttataagggcactaaccctattcctgagggctccaactttatggcccaatcacctcccaaaggccccacctcttagtaccatcaccttggatgttaggattgtaacatatgaatttttggggggacataaacattcagaca

SEQ ID NO: 65444 - DNA, 601 bp, Human
attaaggtgccagcggattcagcgtcaggcgatagtctgtgtcctggttcacagagaagactttctcactgtgtcctcccgtggtagaaggggcaagaggtctctctcaggcttattttataagggcactaaccctattcctgagggctccaactttatggcccaatcacctcccaaaggccccacctcttagtaccatcaccttggatgttaggattgtaacatatgaatttttggggggacataaacattcagacaccgtagcagaccgtccacataagatgctgcctgcagaacacawtgaacaggaaatgcagtgcccgaaggccaggaaacaaaatatacaagccagtgctttgagaaacataggaaagcatctgagcagcaccctgggtgccagtcttgggggaatgtcagtccactgcaaagggattctcaacctctggccagaatatccagtaggatggattctgagggcgactgccccatctgggcctctgctccttcctggcctttccccagtttttcctgttgaggccacactgtcaccacacccctaggggagctgggacttatttcaagtgatttttttttttttttt

SEQ ID NO: 65445 - DNA, 601 bp, Human
tctggccagaatatccagtaggatggattctgagggcgactgccccatctgggcctctgctccttcctggcctttccccagtttttcctgttgaggccacactgtcaccacacccctaggggagctgggacttatttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccacsatgcccagctatttttttgtatctttagtaaagacagggtttcaccatgttggccaggctggtctcaaactcctgacctcatgatacgcctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcc

SEQ ID NO: 65446 - DNA, 601 bp, Human
tggccagaatatccagtaggatggattctgagggcgactgccccatctgggcctctgctccttcctggcctttccccagtttttcctgttgaggccacactgtcaccacacccctaggggagctgggacttatttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccaygcccagctatttttttgtatctttagtaaagacagggtttcaccatgttggccaggctggtctcaaactcctgacctcatgatacgcctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtccca

SEQ ID NO: 65447 - DNA, 601 bp, Human
ctgttgaggccacactgtcaccacacccctaggggagctgggacttatttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccatgcccagctatttttttgtatctttagtaaagacagggtttcaccatgttggccaggctggtctcaaactcctgacctcatgataygcctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcccaaacattcattgtatccatggctccaaaaagaatcagtcaggaatactacagaggcctggttgctgccttctaggaacttgtaggc

SEQ ID NO: 65448 - DNA, 601 bp, Human
tttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccatgcccagctatttttttgtatctttagtaaagacagggtttcaccatgttggccaggctggtctcaaactcctgacctcatgatacgcctgccttggcctcccaaagtgctgggattacaggtgtgagccacygcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcccaaacattcattgtatccatggctccaaaaagaatcagtcaggaatactacagaggcctggttgctgccttctaggaacttgtaggctaagggagaggtcgtgacacataatggccttgactgcatatgtcagc

SEQ ID NO: 65449 - DNA, 601 bp, Human; identical to SEQ ID NO: 31329

SEQ ID NO: 65450 - DNA, 601 bp, Human; identical to SEQ ID NO: 31330

SEQ ID NO: 65451 - DNA, 601 bp, Human; identical to SEQ ID NO: 31331

SEQ ID NO: 65452 - DNA, 601 bp, Human
agttgaccctggaccccatggagccaattctcctgccaccccatcagatatctacatttggtagagattccaaaattgtgataggagactaagcagtgcaattagcggggaaaggaatgaggaagaagcatgttttattcactgtttgggcaatcaactagaacttccttgtaacttgtctggctgcttcagctttagctagttcaccaatatccagtctggacctgttatgacagaggccaccttcctgttcagattggtgggaattccattttctttctttcttttttttttttttttwtgagttggagtttcactcttgttgcccaggctggagtgcaatggcaccatctcagctcactgccacctctgcctgccgggttctagtgattctcctgcctcagcctcccaagtagctgggactacaggcacttgccaccacgcctggctaatttttgtatttttagtagagagggggtttcaccatgttggtctggctggtctcgaactcctgacctcaggtgatccacccacctcagtctcccaaagtgctgggattgcaggcatgagccactgtgcccggcaggaatttcactttaat

SEQ ID NO: 65453 - DNA, 601 bp, Human
tggctcactgcaacctccgcctcccaggttcaagcaattcttgtgcctcagtctcctgagtagctaggagtagccaggactataggcatgtgccaccacacctggctaatttttgtagttttagtagagacagggttccactgtgttggccaggctggtctcaaactcctgccctcaagtgatccacctacctcagcctcccaaagtgctgggattacaggtgtgagccactgtgcctggccaagaagttagtttcttgaaaagataaacaaaattgacaaacctttagctggactaactaaaaaaaaaaaaaaaaaaaaaagcaaaaaaagagagacccaaataaataaaatcagagctgaaaaagaagacattacaactgttaccacagaaattcaaagatcattagtggctactatgagcaactatttgccaataaattggaaaatgtagaaaaaaatggataaattcctagatacataaaacctaccaagattgaatcataaagaaatccaaaacccaaacagatgaataacaagtaatgagatcaaagccataataaaaagtctctcagcaaagaaaatcccaggacccaatggct

SEQ ID NO: 65454 - DNA, 601 bp, Human
ggcccctgtagtcccaattgttggggaggttaaggcaggaaaatggcatgaacccgggagggggagcttgcagtaaaccgagatcacccccttgcactccaacttgggtaacaaagcaagattttgtttcaaaaaaaaaaaaaaaaaaaaaaaaaaaaaaaaaaaagaactagaaaagcaagagcaaaccaaacccaaagttactagaagaaaagaaataataaagatcaaagcagagataaatgacattgaaacaaagaaaacaatacaaaagatcaatgaaacaaaaacggttttttgktttggtttggtttggtttggtttttttttggagacagagtctcactctgttgcccaggctggagtgcagtggtgcgatcttggctcactgcaacctccgcctcccaggttcaagcaattcttgtgcctcagtctcctgagtagctaggagtagccaggactataggcatgtgccaccacacctggctaatttttgtagttttagtagagacagggttccactgtgttggccaggctggtctcaaactcctgccctcaagtgatccacctacctcagcctcccaaagtgctgggattacag

SEQ ID NO: 65455 - DNA, 601 bp, Human
cctgccaacaccaagatttcagacttctgatccctgcatcaggagagagtaaacttctgttgttttaagccatccagttgtggtactctgctatggaagcccttggcattaaaacacacatcttacaacatttaagcccacacttaatatttattattattattattattgagacagagtctcactcctgtcacccaagctggagtgcaatggcacaatttcagctcactgaaacctctgcctcctgggctcaagcgattctcttggctcagcctcccaagtagctgagactgtgggcacrtgccaccactccaggctaatttttgtatttcgcatttaatctttaagcattctttatcacattccaaaggtaataagcatttttgagtcaaaaatatgtttaaaatctctaaatccattccaggcagagaaggggaagataagttcttaagagattcctttcaaactcattactttcaaacaggaggcttctgtgccatcattgtatattctttcataaaacatttctaagagagcttaaaatttaaaaaagagagagaaaatttcaatctacataattctgttttgtttcaagtcaccc

SEQ ID NO: 65456 - DNA, 601 bp, Human
tgggcgtggtggctggtaactgtgatcccagctactcagggggctgaggcaggagaatcgcttgaacccaagagaaggaggaggaggttgcagtgagccaagatggtgccactgcactccagcctggacgacaagagcgaaacacggtctcaaaaaaaaaaaaaaaaaagaatctgaaaaaaccaggtggatattctgagcttaagctatgtaatccgcacggcagacactaaaggttgattctggcgctaactagtgtgtgtagagttccctcggttacagcaacagttcttgcacagcwaaactcatgctctctggataactggatgctttgccacaattaggaaaaaaaatttttaagtaggccttttaaaatgtaaaaacagttcacaaaaataacttactgaaatttatgaccaaaattttaataaaaaatcaatgatctttttgggggggaaattcagcatctaactacaatgataaaagacaagcacaaaatagctttaattttaaggtgcaaataattttacaaagtaaggattttattttatttttttttaagatggagtttagctcttgttgtccaagctggagtgcaatg

SEQ ID NO: 65457 - DNA, 601 bp, Human
cgtctcttctttttctctcctctccacgcatcctccatccccacctagacacacattctaccccattttcataaaaccttaaagggtcaatcccagcaggtataacttttccaaatccaatgcttgccgtaaagaatctgataaagtgccgggcgcagtggctcatgcttgtaatcccagcacttggggaggctgaggcgggtggatcacctgaattcaggagtttgagaccagcctggtcaacatggtgaaaccctgtctctactaaaaatacaaaaattagctgggcgtggtggctggyaactgtgatcccagctactcagggggctgaggcaggagaatcgcttgaacccaagagaaggaggaggaggttgcagtgagccaagatggtgccactgcactccagcctggacgacaagagcgaaacacggtctcaaaaaaaaaaaaaaaaaagaatctgaaaaaaccaggtggatattctgagcttaagctatgtaatccgcacggcagacactaaaggttgattctggcgctaactagtgtgtgtagagttccctcggttacagcaacagttcttgcacagcaaaactcatgctctctg

SEQ ID NO: 65458 - DNA, 601 bp, Human
gcttatgggactttgagcaagttactttagcttactaggcctcagcttttctctgcaaaatggaggtcatgccaggcctgaccttctagactagaagaattaagtgtagtgacaacacaagttaagaagctgcctacggctattactgttaccctaatttggattgctgaccttaagagaagataactgcgccaggcacggtagctcatgcttgtaatcccaacactttgggaggccgaggtgggcggatcacctgaggttggaagttcgagaccagcctgaccaacatagagaaatgccrtctctactaaaaatacaaaattagccaggtgtggtggcgcatgcctgtaatcccagctactcaggaggctgaggcaggagaatagcttgaacctgggaggcagaggttttggtgagctgagatcacgccattgcactccagccttgataacaggagcgaaactccatctcaaaaaaaaaaaaaaaagagagagagaagataactggggtgcagttagaagacaaaaagatccttcttcccacatcacagtgaatatgtgaaactcctcttccctgctagaaggaagtaagggaaaatggt

SEQ ID NO: 65459 - DNA, 601 bp, Human
tatggcttatgggactttgagcaagttactttagcttactaggcctcagcttttctctgcaaaatggaggtcatgccaggcctgaccttctagactagaagaattaagtgtagtgacaacacaagttaagaagctgcctacggctattactgttaccctaatttggattgctgaccttaagagaagataactgcgccaggcacggtagctcatgcttgtaatcccaacactttgggaggccgaggtgggcggatcacctgaggttggaagttcgagaccagcctgaccaacatagagaaaygccgtctctactaaaaatacaaaattagccaggtgtggtggcgcatgcctgtaatcccagctactcaggaggctgaggcaggagaatagcttgaacctgggaggcagaggttttggtgagctgagatcacgccattgcactccagccttgataacaggagcgaaactccatctcaaaaaaaaaaaaaaaagagagagagaagataactggggtgcagttagaagacaaaaagatccttcttcccacatcacagtgaatatgtgaaactcctcttccctgctagaaggaagtaagggaaaa

SEQ ID NO: 65460 - DNA, 601 bp, Human
acaggctttggagtcaactcctagatccaagtcttggtcagctctatcatttatggcttatgggactttgagcaagttactttagcttactaggcctcagcttttctctgcaaaatggaggtcatgccaggcctgaccttctagactagaagaattaagtgtagtgacaacacaagttaagaagctgcctacggctattactgttaccctaatttggattgctgaccttaagagaagataactgcgccaggcacggtagctcatgcttgtaatcccaacactttgggaggccgaggtgggyggatcacctgaggttggaagttcgagaccagcctgaccaacatagagaaatgccgtctctactaaaaatacaaaattagccaggtgtggtggcgcatgcctgtaatcccagctactcaggaggctgaggcaggagaatagcttgaacctgggaggcagaggttttggtgagctgagatcacgccattgcactccagccttgataacaggagcgaaactccatctcaaaaaaaaaaaaaaaagagagagagaagataactggggtgcagttagaagacaaaaagatccttcttcccacatc

SEQ ID NO: 65461 - DNA, 601 bp, Human
ctccaacttgaatttctttccacttagcaactttgaacctaaggattaaaaataatgaggatttattgacattttaagttacaggcaagggaattactattctttctggatgttatagattctggaaaatatgcaagtcacagagaaaatgctaaaattttgctctttaatggatgtaaacatattaaaggggggcatgaaaatcgtattgacctctgaaggaagcaatgatgaatgactttgatacattcttttcatctaggtcatgtaaggaagagtttatgggggccacttatgtgcrtggcagggaaatacttgccacccccttttgtttttgcttatgtccaacttgcctccctgctgtgttccttctcagtgacccatcacttgctccatgctggtcccaggacagaagcacctacattatggcacccacctgggcctcccagagtcttcgtggggcttcagagcttgcctactctctgctgtttaaattatctttattatttatttattaattttttttttcattgagacagagtcttgctctgttgcccaggctggagtgcagtggcacgatctcagctcactgcaacttctg

SEQ ID NO: 65462 - DNA, 601 bp, Human
cttaaaaatctgttcctttctctgacacagataataacctcgatattattcatatctgtctggacgctgctcagcagttgataaagggctcagacacatatgctcctgtctgatccttttaccttccctgagaggtggagaaacgcaggtagtaagagctccacttcacagaggcgcaaaggtgagatcagtagggacagcagcaggtggcagaggcaaggccagatatcaagccgtctggtccacaatgccccgatttcagtggaatgaatgtgccttcaaaggccagctttaaatcagrcccatcgagacacacttacccgtccagttctgctgtttccacatagcagaggctgttaggctcagagctagacagcaggagaatgtcagcctgtccaaaacaaaacacacaaataacaccgagaccctgagggaaaagccgagcacaggggctgggggagaacaaggaacaagagaagcagaatttgttcacttactggaacaaaatcattttttttcagacgaatgacgtctccaacttgaatttctttccacttagcaactttgaacctaaggattaaaaataatgaggatttattga

SEQ ID NO: 65463 - DNA, 601 bp, Human
tttgggaggcagaggcaggcagatcacttgaggtcaggagtttgagaccaacctgacaacagaaagctctatcaggcaactgcccataatccaatttgggtatagcctcggggccttaaagagaatgcagtgtctttgtcagttaagcctttacaattaagaagtggttaattggtttttaaccaattagcctgtacaattaagaagtggttaattggctttaagtatttttttccgccaaaaaaaaaaaaaaaaagtgtgatagatttccaacagtcaattgcctgatctatgaagcaawgacagccctagttttcagtctcatgatttccgctctctgtaaagcagtgtatgcacatctggagcgtgaggcgcgaggagcagagggagcaatgtcccgactctaccacttactgtgtgaccttgggcgggctgctgcacctccctgggcctccgattcctcatgggtaatacagacgaataatattcgtctcacatggtcgtttagaggattaaatgagctaatatgtaaagtgccggcaacctcgtgagcactcaataaatgccttgaaaactggtcagaaaactggtcaaaaacaga

SEQ ID NO: 65464 - DNA, 601 bp, Human
aggagggtgtatcgtcttctccatcatagaggtaccaagaggaattgcccacctgtgcttcccaataagcatggccgatggcaagaccagcagaaagcagaataagaacaacaaagatctagaagacagaaaacatttaaatgcattctgaagatggatttccaacctcttgcatttcctagatgctaattaaccttactcaatacttcatatgattgagaatttagtagtctgaaaaataatatatgtcaaataaaaacagcactatcataacgctttgaaagtctatttgattgctgcrattgactgatgtatcctacatctcccatagaaggtaaggttttgttcccaaaattatctctccaaagagaaggtggtgtcttatattcaaatccttgaagaatcttatattacagggcattctctcaattacgtttactttgaacaataacatactgtttggggaagatatcttacttagcatgaaacaacttccaacaaggctgaactggaaaactggaatgcttatagaagatattcaacagatttttttttttttttttttttttttttagacagcgtctcactgtatcacccaggc

SEQ ID NO: 65465 - DNA, 601 bp, Human
aacaatgatatagccccagaaaatgaggaatccacggtaggagggtgtatcgtcttctccatcatagaggtaccaagaggaattgcccacctgtgcttcccaataagcatggccgatggcaagaccagcagaaagcagaataagaacaacaaagatctagaagacagaaaacatttaaatgcattctgaagatggatttccaacctcttgcatttcctagatgctaattaaccttactcaatacttcatatgattgagaatttagtagtctgaaaaataatatatgtcaaataaaaacagyactatcataacgctttgaaagtctatttgattgctgcgattgactgatgtatcctacatctcccatagaaggtaaggttttgttcccaaaattatctctccaaagagaaggtggtgtcttatattcaaatccttgaagaatcttatattacagggcattctctcaattacgtttactttgaacaataacatactgtttggggaagatatcttacttagcatgaaacaacttccaacaaggctgaactggaaaactggaatgcttatagaagatattcaacagattttttttttttttttt

SEQ ID NO: 65466 - DNA, 601 bp, Human
aaaatgccagagaggacagccttacctgacatagagagagatgggtaccatggtgttgagaacaatgatatagccccagaaaatgaggaatccacggtaggagggtgtatcgtcttctccatcatagaggtaccaagaggaattgcccacctgtgcttcccaataagcatggccgatggcaagaccagcagaaagcagaataagaacaacaaagatctagaagacagaaaacatttaaatgcattctgaagatggatttccaacctcttgcatttcctagatgctaattaaccttactcartacttcatatgattgagaatttagtagtctgaaaaataatatatgtcaaataaaaacagcactatcataacgctttgaaagtctatttgattgctgcgattgactgatgtatcctacatctcccatagaaggtaaggttttgttcccaaaattatctctccaaagagaaggtggtgtcttatattcaaatccttgaagaatcttatattacagggcattctctcaattacgtttactttgaacaataacatactgtttggggaagatatcttacttagcatgaaacaacttccaacaagg

SEQ ID NO: 65467 - DNA, 601 bp, Human
ggggactcacttgaacccagcaggtggaggttgcagtgagctgagatcgcgctactgcactccagcctgggaaacagagcaagactctgtctcaaaacaaaacaaacaaacaacaaacaaacaaacaaaaatcaaagcaaagcaaggtaaggagatatgaagatctccaggaaggagaagtggtcagaaacagaatgagtcaggaaaggtcagggtaataaggtgttgtctgagtaaaggcctttgtagtgaaaggggagcagatagatacctacgtaaggaatgcccctggcagagaaargagcagggacaaaggccctgtgcaggaagaatatcaaggggccagagtggcagaagcccagggaggtgggctgaggtgcagaaggtacgggcggagtggaaggctgagcaccagatcacacttggggccctggggttgggtttattctgaatgaggtttgaagtcaaagcagagatactatctggaagaacttgctccagcatgttttcaaaggacctttatctccaagaaaaaagaaatcgtatttgtcacatgacatacctttatataaaattatgtatacagtttcttttataatac

SEQ ID NO: 65468 - DNA, 601 bp, Human
tacaaaaattagccaggcatagtggcatgtacttgtaattccagccactaaggaggctgaggcaggggactcacttgaacccagcaggtggaggttgcagtgagctgagatcgcgctactgcactccagcctgggaaacagagcaagactctgtctcaaaacaaaacaaacaaacaacaaacaaacaaacaaaaatcaaagcaaagcaaggtaaggagatatgaagatctccaggaaggagaagtggtcagaaacagaatgagtcaggaaaggtcagggtaataaggtgttgtctgagtaraggcctttgtagtgaaaggggagcagatagatacctacgtaaggaatgcccctggcagagaaaagagcagggacaaaggccctgtgcaggaagaatatcaaggggccagagtggcagaagcccagggaggtgggctgaggtgcagaaggtacgggcggagtggaaggctgagcaccagatcacacttggggccctggggttgggtttattctgaatgaggtttgaagtcaaagcagagatactatctggaagaacttgctccagcatgttttcaaaggacctttatctccaagaaaaaag

SEQ ID NO: 65469 - DNA, 601 bp, Human
tccacttaccatatatctgcccgttgatacagcactttttaaaggtcatgatattttgtgtgagtgtccccgtcttatcagagaagatataatggatctgcccgagctgttcattgagtgtggtggttctagcttttgcgggtgtgtccttctcagcatagtacatttgcaggtcccagttgatgaagtgactctgtccaagacgaatcacttccacgctaggaagacagaagattattttccgtagagagctcggatacgagtggcaagtagtagagattttattctcattgtacagacragagcaagctgcttatttactgctatggtctgaatgttagaatccccctccaaattcatatgttgaaacccaatccccaattcaacagtattgaggtggggcctttagaaggtcattaggtcatgagggctccacccttatgaatgggattagtgcccttattaaagtggctcaaaggagcttgcttgccccttctgccatgcgaggacatagctagaaggcaccggctgtgcctataaagcagaaagtgagcctttgccagaccctgaatctgccgatgctttgatttgagacttccca

SEQ ID NO: 65470 - DNA, 601 bp, Human
agacacacgggggacaccacgtgacaacaaaggcagagacacagagttgtgtttccaagtctccaagccaaggaacaccaaggactgtgggcaaccaccaggagcagggaagaggcaacgaaagagtcttccctagaccttcaaaggaagcatggccctgctgggaccctgacatccccagcatcccaaacgattcttcggcttaaaggtcttacctctattttgttgtggttgtgttgagaggcatcccgatggtcccctgagaaacaaacaggacaaaacaaattgattctacacctaygtccagaggcccctccttacctggctttgcttatatagtgatggtgataagaccatatacggcctggacaggctaaaatatttatctggcactttacagaaaacgttagatgacccctggtctagatattcaaataccagtggctgtccctctccactaccttctcctaggggcctgaatcatatcctttgaaatgctttacctctcccaagtcagaaggactcacatatgtgagccacgtcctcagcccctcagtgccctaccatcttcactgatacttcttatgagaaaaggcactca

SEQ ID NO: 65471 - DNA, 601 bp, Human
ttctctggaaatttcatacctgctacatatgaaacattaaggttgagaaaagagagggacttatgtatgccgcactgactgaagtaaaaagtggaagatgtagtgaagtggatgaagtgagggaatgaagtgaaggcagactacgctttattacagaaacaccaaaagaactccttttgctctttctataaagtgcatgtgtgtctatataatttatcattatgaccatttgtgataaaatgactagctttccttgatacaggacaaacttgctgtgacaaagctggcacaaactgcatcraaggattctgcaaaggaacctacaagccattctggcttgttcccatgaaattcacattaattatgctcctttaaatggaaaaaggcaccttaaagagatccaggctgaggctcatattatttcaaacccaaactataacagaatctagtaaataagagcatatatctgaaattatttggtagaaaagattagtcaagttcaaagtccatttctgatacagataaagcttgacttttcactctcagtcaatgctcagtaataaatgtgctaagaaaagttagtttcttctatcatagttca

SEQ ID NO: 65472 - DNA, 601 bp, Human
cgaccttccaaatgctgggattacaggtgtgagccaccaagcgttggcctacacatttagtttttatgcatattccttctctggaaatttcatacctgctacatatgaaacattaaggttgagaaaagagagggacttatgtatgccgcactgactgaagtaaaaagtggaagatgtagtgaagtggatgaagtgagggaatgaagtgaaggcagactacgctttattacagaaacaccaaaagaactccttttgctctttctataaagtgcatgtgtgtctatataatttatcattatgwccatttgtgataaaatgactagctttccttgatacaggacaaacttgctgtgacaaagctggcacaaactgcatcaaaggattctgcaaaggaacctacaagccattctggcttgttcccatgaaattcacattaattatgctcctttaaatggaaaaaggcaccttaaagagatccaggctgaggctcatattatttcaaacccaaactataacagaatctagtaaataagagcatatatctgaaattatttggtagaaaagattagtcaagttcaaagtccatttctgatacagataa

SEQ ID NO: 65473 - DNA, 601 bp, Human
ctcctgggctcaagcgatccccacctgagtagctgggactacaggcatgtcccatcacacctggctaattttttgtattttttggtgagatggagttttgccatgttgctcaggctggtcttgaactcttgagctcaagcaatccattcacctcgaccttccaaatgctgggattacaggtgtgagccaccaagcgttggcctacacatttagtttttatgcatattccttctctggaaatttcatacctgctacatatgaaacattaaggttgagaaaagagagggacttatgtatgcckcactgactgaagtaaaaagtggaagatgtagtgaagtggatgaagtgagggaatgaagtgaaggcagactacgctttattacagaaacaccaaaagaactccttttgctctttctataaagtgcatgtgtgtctatataatttatcattatgaccatttgtgataaaatgactagctttccttgatacaggacaaacttgctgtgacaaagctggcacaaactgcatcaaaggattctgcaaaggaacctacaagccattctggcttgttcccatgaaattcacattaattatgctcctt

SEQ ID NO: 65474 - DNA, 601 bp, Human
tcgcgccactgctctccagcctgggcaacagagcaagactctgtctcaaaaaaaaaaaagaataaaaaagaaaagaaaaactaactattaagttctgtgttcactacctggatgatgggatcaattgtaccccaaacttcaggatcatgcaatatacccatgtaacaaacatgcacatgtatcccctgaacctaaaataaaaattgaaggtgtaaaaacaaactaaaaaaacaaacaaaaacaaagcaaccttcctaagaaaactctttatttatggcacatttagaggcaaccagaaagwccttctttttctttcacacactaatttgtggctcatgaaattgatgtaatcaaagaaagatgctcaaaccacaaatcccacctctcagttctcatcaacctgattccctagcttcagggtaatggtggcagagaaagctaaatgcacctttcttctctccttcacaactgcctcagctgattcactctaatttctttttgagatggagtctcactttgtcgcccaggctggagcgcagtggcaaaatctcggctcacagcaacctccgcctcgcgggttcaagcaattctcctgtctcag

SEQ ID NO: 65475 - DNA, 601 bp, Human
gtagtcaggaaagtacttttcttgtaatcactggaaaggaatgtaaagggaattctagggggattgataatgttcttttttaaaaatctgggtgctcattacaagagtattggtttgtgaaaattcattgagttatatacttatgatacgtacatatctctgtatacacatgttgtacttcaataaaaagtttaaaaaatactctccctacccaagatcttctatttttctactctagttattttgtctcaaaatagaaggaaaagcatttccgtggccagatgactttggacagaaagarcatttagttttccaaaatactttgaccaggatgaaggccacagatgcatgagcagctgtttatccgccagcctcacttggaatggttggtgctctggggtaacggtggcagagagagctaaacacaccttccttccttcacaattggctcagaggattcactttttaagtcaatattaatcacttcctaattaataattaaagatgacacttagggtctctctgtatttgttcactcagaaagtcattcactagaagctataaacgcacttcctaaatccggccatctagcaatcatata

SEQ ID NO: 65476 - DNA, 601 bp, Human
aataaatctcacagccagatacacaaaagagtacatatgctacatgattccactgaaataagccaaaaaactgacagagctaacctgtgttattcgtagtcaggaaagtacttttcttgtaatcactggaaaggaatgtaaagggaattctagggggattgataatgttcttttttaaaaatctgggtgctcattacaagagtattggtttgtgaaaattcattgagttatatacttatgatacgtacatatctctgtatacacatgttgtacttcaataaaaagtttaaaaaatactctscctacccaagatcttctatttttctactctagttattttgtctcaaaatagaaggaaaagcatttccgtggccagatgactttggacagaaagagcatttagttttccaaaatactttgaccaggatgaaggccacagatgcatgagcagctgtttatccgccagcctcacttggaatggttggtgctctggggtaacggtggcagagagagctaaacacaccttccttccttcacaattggctcagaggattcactttttaagtcaatattaatcacttcctaattaataattaaagat

SEQ ID NO: 65477 - DNA, 601 bp, Human
caaccaaccttagtttgatcactatccgatatcttaatgtttaaaagttaaataatggaaaattgtcttctattcacaactacatttcaacaataagaataagctaggttcagtggcacgtgcctataattgcaactattcaggaggctgaggcaggaggatcacttgagcccaggagtgtgaggttacagtgagctttgatattccactgcactccagcctggctgacagagcaagatgcagtctcttttaggaaaaaagaaaaaaccaataagaagaggaataaatctcacagccagayacacaaaagagtacatatgctacatgattccactgaaataagccaaaaaactgacagagctaacctgtgttattcgtagtcaggaaagtacttttcttgtaatcactggaaaggaatgtaaagggaattctagggggattgataatgttcttttttaaaaatctgggtgctcattacaagagtattggtttgtgaaaattcattgagttatatacttatgatacgtacatatctctgtatacacatgttgtacttcaataaaaagtttaaaaaatactctccctacccaagatcttctat

SEQ ID NO: 65478 - DNA, 601 bp, Human
ctcccacctcagcttcctgagtagctgggactataggcgcacatcaccacgcccagctaatgtttgtattttttgtagagacaggatctcaccatgttgcccaggctattttttctttaccatagctatattctccttattaaaaaaaaaaagaaaaaaaaaccacacaggctgggtgcagtggctcacgcctgtaatcccagcaatttgggaggctgaggcaggtagatcatgaggtcaggagatggagaccatcctggctaacacagtgaaactctgtctctactaaaaacacagaaaattagccaggcatggtggcacgtgcctatagttccagctactcgggaggctgaggcaggagaatcacttgaacccagaaggtggaggttgcagtgagccgagatctcgccactgcactccaccctggtgacagaccgagactccatttcaaaaaaaaaaaaaaaaaaaagaaagaaagaaaagttgaaacaaaccaaccaaccttagtttgatcactatccgatatcttaatgtttaaaagttaaataatggaaaattgtcttctattcacaactacatttcaacaataagaataagctag

SEQ ID NO: 65479 - DNA, 601 bp, Human
ttctttctttcttttttgtttttttgagacagtcttactctggcaccaaggctggagtgcagtggcaccatctcagctcactgcagccttgatcgcttcaggcgcaagtgatcctcccacctcagcttcctgagtagctgggactataggcgcacatcaccacgcccagctaatgtttgtattttttgtagagacaggatctcaccatgttgcccaggctattttttctttaccatagctatattctccttattaaaaaaaaaaagaaaaaaaaaccacacaggctgggtgcagtggctcmcgcctgtaatcccagcaatttgggaggctgaggcaggtagatcatgaggtcaggagatggagaccatcctggctaacacagtgaaactctgtctctactaaaaacacagaaaattagccaggcatggtggcacgtgcctatagttccagctactcgggaggctgaggcaggagaatcacttgaacccagaaggtggaggttgcagtgagccgagatctcgccactgcactccaccctggtgacagaccgagactccatttcaaaaaaaaaaaaaaaaaaaagaaagaaagaaaagttgaa

SEQ ID NO: 65480 - DNA, 601 bp, Human
tttctttctttcttttttgtttttttgagacagtcttactctggcaccaaggctggagtgcagtggcaccatctcagctcactgcagccttgatcgcttcaggcgcaagtgatcctcccacctcagcttcctgagtagctgggactataggcgcacatcaccacgcccagctaatgtttgtattttttgtagagacaggatctcaccatgttgcccaggctattttttctttaccatagctatattctccttattaaaaaaaaaaagaaaaaaaaaccacacaggctgggtgcagtggctyacgcctgtaatcccagcaatttgggaggctgaggcaggtagatcatgaggtcaggagatggagaccatcctggctaacacagtgaaactctgtctctactaaaaacacagaaaattagccaggcatggtggcacgtgcctatagttccagctactcgggaggctgaggcaggagaatcacttgaacccagaaggtggaggttgcagtgagccgagatctcgccactgcactccaccctggtgacagaccgagactccatttcaaaaaaaaaaaaaaaaaaaagaaagaaagaaaagttga

SEQ ID NO: 65481 - DNA, 601 bp, Human
gatttttctgtttcttttttctttttagagacagaggtctccctatgttgtccaggctgctcttgatctccggggcccaagtgatccttctgcctcagcctaatgagtcgctagggctacaggctcatgtcacctcacctggcttattctctttctttcttgtttttctgaaacagggtctcaccgtgttgcccaggttgcagtgcagtggcacgatcatggctcactgaagcctcaatctccccaggctcagtgatcctcctacctcatcttcccatgtagctgggattactggtacacrccaccacacctggctaattttttgtattttttgtagagacggggtttcaccatgttgctcaggctggtctcaaactcctggactcaagtgattcgcctgcctcagtccctaaagtgttcggattacaggcatgagccactgcccctgggcccctggcttattttctaagagcagattcctattaggaaaatactgagccagagaacactgataattttaaaactcattggtatacaatactaatttgttttccaagaaggttgtaccagtttatcttccctctaaaaaagtatgttttct

SEQ ID NO: 65482 - DNA, 601 bp, Human
accagggcaccttcatcgggagaggctgcctggtagttgagctgacctaacaaggaagcgagagaaatcccagaaaagctgtaaaaacaaatgcagagctcattgttgaggcctctgctgaggctcctgtgggggtcagatgggctgcaaagcccaaaacatccccaggaaaacgagtcattgacttggaagggttatgccaagattaaaacttctttgttttatcttgacttataaacagtaatataaactaaaaaagaaacattggtggagaatgagggaaaattcccataatcccacyatccacaggagaaacaacaggtgttgacattttatcattccctccagtgccttttaaaatgtctgtatctgaaattgtttctatcaagctgaatatacatttacatcctgattattttaatgctgtatctgagcatattgccatccctttttaaattctttataaacatttgaacaaatgtaaatatgttatcattttcccattacagacacttaatttccaaatttttttactctcaaaaagtcacactttaataacccttttgtatgtgtgtaaagatttttctgtttcttttttctt

SEQ ID NO: 65483 - DNA, 601 bp, Human
accagtaaacatctcattactttatagtcacatcttttttattttgaccaagttttgctcttgtcgcccaggctggagtgcaatggtacgatctcggctcactctaccccctccctctggggttcaagcgattctcctgcctcagcttcccaagtagctgggattacaggtgcccaccaccacacccagttaatttttttgtatttttagtggagacggggtttcaccacgttggccaggctggtcttgaactcctgacctcaggtgatacacccgccttggcctcccaaagtgctgggaytacaggcatgagacaccaaatactcaatcagttgaaccgcttctgccatcttggctagacaagatgtgacctatagtcagctctgtcatcctgtcacatatgaatgctttccttcctttgcactacaacttgaagttagtggaggtcttggggaccacacacatagtaagactacaacctagtatggttatgtagcttgctcaaggccactggaagagagctaagccattcccctgcctcagtcctatagaccttgaagacccacatgctgggagagggcaccatggtgatatcccagga

SEQ ID NO: 65484 - DNA, 601 bp, Human
ttttaaacagtttcaacatgaaccagtaaacatctcattactttatagtcacatcttttttattttgaccaagttttgctcttgtcgcccaggctggagtgcaatggtacgatctcggctcactctaccccctccctctggggttcaagcgattctcctgcctcagcttcccaagtagctgggattacaggtgcccaccaccacacccagttaatttttttgtatttttagtggagacggggtttcaccacgttggccaggctggtcttgaactcctgacctcaggtgatacacccgcctkggcctcccaaagtgctgggattacaggcatgagacaccaaatactcaatcagttgaaccgcttctgccatcttggctagacaagatgtgacctatagtcagctctgtcatcctgtcacatatgaatgctttccttcctttgcactacaacttgaagttagtggaggtcttggggaccacacacatagtaagactacaacctagtatggttatgtagcttgctcaaggccactggaagagagctaagccattcccctgcctcagtcctatagaccttgaagacccacatgctgggagaggg

SEQ ID NO: 65485 - DNA, 601 bp, Human
atgaattaccctttttgtctccagtaagcacccagatcttaatgtcagcttttgcaagttttgaaatggtttctggaactccatcctgtagcttgtcttcaatagctgtagctcccaggagctagaatgtatattaaaaaaaaaaaaaaaaaaaaaggaattagcaaacaaaccaaaagttttctgtaattacaggttgccaacctgtaaaaagaagggctaattatacatcctggttgctgctctcctggggccaatggccagtgttaacagggaaggctgccatgtttcacaattactrcaaaccaacacagctaaaaactttttccctaaaggatgaactatttaatttaccaagacaaaaatgcaagtacaaaatcaaggatgttaaaaatacacttttcttgtgtatttgtggctttatactgacataaaccgtaaaccagttgcaatactagctatttgttgaatattttccacttatctaaaccctacaaaaactatgtattaaatttggaaaacttttagaaacaatatatttttcttatttcaagattttgcagaatatgaattgtttcggtaattcccccaatgtaataag

SEQ ID NO: 65486 - DNA, 601 bp, Human
gttgacgatttcagcgcaagagacattatttgatttcttgtggaaggcttacaaagtaaagtatcaataccaaacaagtgcttgttgagttctaaagttaaaaaattaaaatcgttctttccttaggtatacaattttattgccaagcaataaaattggcaagaaaaccaaagttattgttcagtactttgtattgttctactctgtgcccaccaaatgtcaaagcactggaaggacagagggacaagagggatggccctttcaggacgggaacccacgtctggctggagagataagaccrattataatcagcaagacatggccaggagctaaattataaggaagaaactgctactgagggggatcaggaaaggatgcagaaggatgtgctggaaaaacagaggagggtttctcagaaaaagcatcttccgtccaaagaaacagtgtttgtacaggatgaaaagtctgaggaggtcatcttgggcaaaggaaacggcagctataaatatttgtgaattaacagatatgcttccctgcacaatgaattaccctttttgtctccagtaagcacccagatcttaatgtcagcttttgcaagttt

SEQ ID NO: 65487 - DNA, 601 bp, Human
cagttcctggttcaattactctgttattggcggggggcgggggcagagggaagcataataatttccaccaacccttacgtgaagattttttttccttttaaattaccacccaatttggcatttatttaaggtcagggctgtgcttcccataactttgcagagtgtgtaacccgttgacgatttcagcgcaagagacattatttgatttcttgtggaaggcttacaaagtaaagtatcaataccaaacaagtgcttgttgagttctaaagttaaaaaattaaaatcgttctttccttaggtrtacaattttattgccaagcaataaaattggcaagaaaaccaaagttattgttcagtactttgtattgttctactctgtgcccaccaaatgtcaaagcactggaaggacagagggacaagagggatggccctttcaggacgggaacccacgtctggctggagagataagaccgattataatcagcaagacatggccaggagctaaattataaggaagaaactgctactgagggggatcaggaaaggatgcagaaggatgtgctggaaaaacagaggagggtttctcagaaaaagcatcttc

SEQ ID NO: 65488 - DNA, 601 bp, Human
gcaaagatgagctattacgtaatttcatactgcaggcttttactcacttaatatcctccccatagcagatggtggtgtcttcagtcagaagttcacaagcaaatcctatattttcagcagtttctacaatagaataaaattaagtcaaatgtcattcctgctgtttttattttattttattttgttttttgagacagcatctcactcccactgcctaggctggagtgcagtggcacaatctctgctcactgcagcctcaacctccaggattcaagtgatctgcccatctcagcaccacccrcagcccccaagtagctgggactacgcaactcgctgccaagccaccaaacaatttgtgttttttctagagatggggttttgtcatgtttgccaggctcattcttactgttgaactgaataattgattttacctagtaatgatattttttagttcatgaacataaccagattcacacaaacacactatttttctatagcaatctgtaggaatcacatgcagaagaaaaatccttttctccataataaaacaagtgaaagtcaaagtctaatttgaaatgttttcaataataaaatgtgctat

SEQ ID NO: 65489 - DNA, 601 bp, Human
caagtgacacatcgtaacccctatttcttcatatctgctatcttctacagacagtcttgcatttgcaaagatgagctattacgtaatttcatactgcaggcttttactcacttaatatcctccccatagcagatggtggtgtcttcagtcagaagttcacaagcaaatcctatattttcagcagtttctacaatagaataaaattaagtcaaatgtcattcctgctgtttttattttattttattttgttttttgagacagcatctcactcccactgcctaggctggagtgcagtggcacratctctgctcactgcagcctcaacctccaggattcaagtgatctgcccatctcagcaccacccacagcccccaagtagctgggactacgcaactcgctgccaagccaccaaacaatttgtgttttttctagagatggggttttgtcatgtttgccaggctcattcttactgttgaactgaataattgattttacctagtaatgatattttttagttcatgaacataaccagattcacacaaacacactatttttctatagcaatctgtaggaatcacatgcagaagaaaaatccttttct

SEQ ID NO: 65490 - DNA, 601 bp, Human
cacctaggctggagtacagtggcgtgatcttggctcactgcaacctctgcctcctgggttcaagtgattctcctgcctcagcctcccgagtagctgagataacaggcaccgggcaccacacccagctaatttttgtagttttagtagagacggggtttcaccatgttggccaggctgctctagaactcctgacttcaggtgatccacccgcctcggcctcccaaagggctgggattacaggcatgagccactgcgcctggcctgagctgagaaggaatggagaaaaatggcctctgaaggkccccaagtttccctaaaagtaaaatctgctcaaatttaggctgcaccttgattacttggaactgcctgttgttgtcttgcctcatttaaacatgaggaaactgccccaagtgacacatcgtaacccctatttcttcatatctgctatcttctacagacagtcttgcatttgcaaagatgagctattacgtaatttcatactgcaggcttttactcacttaatatcctccccatagcagatggtggtgtcttcagtcagaagttcacaagcaaatcctatattttcagcagtttctacaat

SEQ ID NO: 65491 - DNA, 601 bp, Human
tttccaggtctgctgcgactctgattcaaagctaacaaacgtttcagcatatgctaacatttgaattatcaggcctgccccacctagactagattacaggggacctacatgatgtaacccacccacacatttccttcccgcaaaagttttgggttttttttttcctttcttctatttccctttcaaaagtaaaagttcctagaaaaagcaaaataggactataattcatattaatttgctagcgatattacaggctttttacggattttttagtaggtgaaccgagtttttttttttttttaatgagacagagtttcactcttgtcacctaggctggagtacagtggcgtgatcttggctcactgcaacctctgcctcctgggttcaagtgattctcctgcctcagcctcccgagtagctgagataacaggcaccgggcaccacacccagctaatttttgtagttttagtagagacggggtttcaccatgttggccaggctgctctagaactcctgacttcaggtgatccacccgcctcggcctcccaaagggctgggattacaggcatgagccactgcgcctggcctgagctgagaagga

SEQ ID NO: 65492 - DNA, 601 bp, Human
gttctcaaaatcctgacctcgtgatccacccgcctcggcctcccaatgtgctggtattacaagcatgagccaccgtgcccagcctgttgctacttttttaaaacctaaaagcacaaaggggcatggcttatgtacctctatttgggcacataaactaaatcagttctaaatggaactgatttagatcataaggctactgattttgtctaatttgacggaatacctaatatactagaacaactagaaaatgctttatcaccatcattagaaataagactaatattgaccatcaattccctcrtcactttatcacacctggcaaatgtgtatgttaacagtttaatctgacctcatgctggcctgagagaagctctgtagggaaaaatcttgaggaactgtcaggccatcagtaaacacatcacagtaactgtgtgcagcatatttatagcttcagaacaagacagggctttttcatcatacatttccaggtctgctgcgactctgattcaaagctaacaaacgtttcagcatatgctaacatttgaattatcaggcctgccccacctagactagattacaggggacctacatgatgtaaccc

SEQ ID NO: 65493 - DNA, 601 bp, Human
attcctctctctataaaggtaaactcagctaagggcatggtcacaacatttgctacttgcatacattttatcttttactttagcttcgggaccaatttttaagactttcaaaagagagaccagaaatttttttacagccccatctacaaaaaataaacaaagccatatagtaattaatcagattacttgaagcccaaaactactaaagtaaactcattaagcattaagcatttatttgtctgttgctactttttttttttgagacggagtcttgctctgtcacccaggcaggagtgtagtrgcactatcttggctcactgcaacctctgcctcccaggttcaagcaattctcctgcctcagtctcccgagtagctgggattccaggcacatgccaccatgcctggctaatttttgtatttttagtagagacggggtttcatcatatcagtcaggctgttctcaaaatcctgacctcgtgatccacccgcctcggcctcccaatgtgctggtattacaagcatgagccaccgtgcccagcctgttgctacttttttaaaacctaaaagcacaaaggggcatggcttatgtacctctatttgg

SEQ ID NO: 65494 - DNA, 601 bp, Human
cactgcactagaggattaagtatctagtatcccttttccacatcaatttaattctcattttcaagttaaaagtgagtgactaagacaaatcattgaaaggccgttaagagaaaaaaaatgaagataccttctattcaaatcattttataggaatcatcaatttaagagccacctgggaagatgattcctctctctataaaggtaaactcagctaagggcatggtcacaacatttgctacttgcatacattttatcttttactttagcttcgggaccaatttttaagactttcaaaagagacaccagaaatttttttacagccccatctacaaaaaataaacaaagccatatagtaattaatcagattacttgaagcccaaaactactaaagtaaactcattaagcattaagcatttatttgtctgttgctactttttttttttgagacggagtcttgctctgtcacccaggcaggagtgtagtagcactatcttggctcactgcaacctctgcctcccaggttcaagcaattctcctgcctcagtctcccgagtagctgggattccaggcacatgccaccatgcctggctaatttttgtat

SEQ ID NO: 65495 - DNA, 601 bp, Human
cctttgcactcttgatgtcttgggcctaataatcctttattttgtgtggccatcccttgcactggaggatgtttagcaacatccctggcctctacccactagaagccaggagcacttctctgcagctgaaacaagcaagtgtctctggacagtgccaaagggtccctggaaggcaaactcactccccacggagaatcactgcactagaggattaagtatctagtatcccttttccacatcaatttaattctcattttcaagttaaaagtgagtgactaagacaaatcattgaaaggccgttaagagaaaaaaaatgaagataccttctattcaaatcattttataggaatcatcaatttaagagccacctgggaagatgattcctctctctataaaggtaaactcagctaagggcatggtcacaacatttgctacttgcatacattttatcttttactttagcttcgggaccaatttttaagactttcaaaagagagaccagaaatttttttacagccccatctacaaaaaataaacaaagccatatagtaattaatcagattacttgaagcccaaaactactaaagtaaactcattaagc

SEQ ID NO: 65496 - DNA, 601 bp, Human
agcctttgcactcttgatgtcttgggcctaataatcctttattttgtgtggccatcccttgcactggaggatgtttagcaacatccctggcctctacccactagaagccaggagcacttctctgcagctgaaacaagcaagtgtctctggacagtgccaaagggtccctggaaggcaaactcactccccacggagaatcactgcactagaggattaagtatctagtatcccttttccacatcaatttaattctcattttcaagttaaaagtgagtgactaagacaaatcattgaaaggccrttaagagaaaaaaaatgaagataccttctattcaaatcattttataggaatcatcaatttaagagccacctgggaagatgattcctctctctataaaggtaaactcagctaagggcatggtcacaacatttgctacttgcatacattttatcttttactttagcttcgggaccaatttttaagactttcaaaagagagaccagaaatttttttacagccccatctacaaaaaataaacaaagccatatagtaattaatcagattacttgaagcccaaaactactaaagtaaactcattaa

SEQ ID NO: 65497 - DNA, 601 bp, Human
caagattgcaccactgcactccagcctgggtgacagagtctttctaagaaaaaaaaaaaaaaaaaaaaaggaaaggcaatcttgatctgaattagaatactggctattgtttgttaggaataaacttattttcatataaacaaaactatatctgtgtttgagaaattctcagtgctttatatcaacaaattaaatgtttgtgttaaaatgatatatgtgacaaggctacgtgtaacactttcatgtgatagaaaaatgagtcatgaaattttggagtggaagggaccttaaatatcttgtycaatctcttcatgttacaaataaggaaatcaagccagaggaaggtgatgtgatttgcctgctgcaggttgataggaaaactagaatgaggactcagttatcttgtaacttctggctcaggactcttactattacatacaaaaagccattgttcttctccttccaaagaaggcttctcagcctttgcactcttgatgtcttgggcctaataatcctttattttgtgtggccatcccttgcactggaggatgtttagcaacatccctggcctctacccactagaagccaggagcacttctct

SEQ ID NO: 65498 - DNA, 601 bp, Human
catatatgtgaaatcaaacagtatttgtctttctgtgactggtttatttcacttagcttaatgtcttcaaggttcatctatataatatatgtcataatttccttcctttttaaagttgaatatattccattatgtggaagcaccacattctgtttatccattcactcactgatgggcacctgggttgcgtccatctcttggctgctgtgaacagtgttgctgtgaacatgggtgtgcatgtatctctttgagatcctgctttcaattattttgtggatatacccagaagtgggattgttgmatcatatggtaatcctttttgaaattttttgaaacatcaccatactgttttgcatagtggctgcaccattttatatatttcatcaacaacacacaaaggttccttcaacaatgattgttattttctattgtgttttgtttttgatagtagccatcctaaagggtgtgaggtgttatcttgctttggttttgatttatcttcccctaatgattagtgatgatgagcctcctttcacatgtttatcagccatttgcatgtcctctttggaaaaatgtctactcaaagtgctttgcccatttt

SEQ ID NO: 65499 - DNA, 601 bp, Human
tcctgcacaggaggtgcaaactttgcgtagacgccacctctattcctctggttttccatccttgcatgaagaagagaactaggggaaaccaaatttcagtgtttaaagtgtaagaccctaaataggcccttgactctgagataactttgacttaaaaaaaattgtgacaaaaaaacaaagtttaccatcttacctatttttgtttctttattttattttcattataatttttttgagagagggtctcactctgtcacccaggctggagagcagtggcatgatcatggatcactgcagcctygacctcccagcctcaagtgattctcctgcctcagcctcctgagttgctgggactataggcacacgctatcacgcctggctaatttttgtattttttgtagcaatagggttttgccatatcccgggctttgaccatttttaagtgtacaacttagtagtgttaactatagtcacattgttatccaaccaatctctagaactttttcatcttgcaaaacggaaactctatacctattaaacaataacacctcacctcactcgccctccagtccctggtaacttccagttaactttctgtttg

SEQ ID NO: 65500 - DNA, 601 bp, Human
gcatctaaaagtggctccaaatgaacttctttcttttgagttaaaggcacagatacactaatgatacgtaccaaccaagaaccagtgatgattaaggcacggtttccaccgggtggaaaaaaagattcctgcacaggaggtgcaaactttgcgtagacgccacctctattcctctggttttccatccttgcatgaagaagagaactaggggaaaccaaatttcagtgtttaaagtgtaagaccctaaataggcccttgactctgagataactttgacttaaaaaaaattgtgacaaaaaaacaaagtttaccatcttacctatttttgtttctttattttattttcattataatttttttgagagagggtctcactctgtcacccaggctggagagcagtggcatgatcatggatcactgcagccttgacctcccagcctcaagtgattctcctgcctcagcctcctgagttgctgggactataggcacacgctatcacgcctggctaatttttgtattttttgtagcaatagggttttgccatatcccgggctttgaccatttttaagtgtacaacttagtagtgttaactatagtcaca

SEQ ID NO: 65501 - DNA, 601 bp, Human
aatcttatttctcttggtctttttctcgagaagaatttcattctgtgaaatcagagagggaaaaggttacattcactttagttttaccccaggagtaccattcccaagatttaaattatgtgaaggataatttttggattatgtcactgattatatttgacaaataaatttgattttataaccaaaacatgtatatatatgtgtgcgtgtgtatgtatatacacacgcacacatatatgtatgtgtgtatgtatatacacacacacacacacacacacacatatatatatatatatatatwtttttttttttttgagatggagtctcactctgttgccaggctggaatgcagtggcacgatctcggctcactgtaacctctgccttccaggttcaagcaatttccctgcctcagcctcccgagtagccgggactacaggtgtgcaccaccacgcctggctaattattttttttgtattttagtagagacggggtttcaccatattggccaggatggtctccatctcctgaccttgtgatctgcccgccttggcctcccaaagtgctgggagcacaggcgtgagccactgtgctcagctata

SEQ ID NO: 65502 - DNA, 601 bp, Human
tcagaatcttatttctcttggtctttttctcgagaagaatttcattctgtgaaatcagagagggaaaaggttacattcactttagttttaccccaggagtaccattcccaagatttaaattatgtgaaggataatttttggattatgtcactgattatatttgacaaataaatttgattttataaccaaaacatgtatatatatgtgtgcgtgtgtatgtatatacacacgcacacatatatgtatgtgtgtatgtatatacacacacacacacacacacacacatatatatatatatatwtatttttttttttttttgagatggagtctcactctgttgccaggctggaatgcagtggcacgatctcggctcactgtaacctctgccttccaggttcaagcaatttccctgcctcagcctcccgagtagccgggactacaggtgtgcaccaccacgcctggctaattattttttttgtattttagtagagacggggtttcaccatattggccaggatggtctccatctcctgaccttgtgatctgcccgccttggcctcccaaagtgctgggagcacaggcgtgagccactgtgctcagc

SEQ ID NO: 65503 - DNA, 601 bp, Human
tcttgggaacttcagcttcagaatcttatttctcttggtctttttctcgagaagaatttcattctgtgaaatcagagagggaaaaggttacattcactttagttttaccccaggagtaccattcccaagatttaaattatgtgaaggataatttttggattatgtcactgattatatttgacaaataaatttgattttataaccaaaacatgtatatatatgtgtgcgtgtgtatgtatatacacacgcacacatatatgtatgtgtgtatgtatatacacacacacacacacacacacayatatatatatatatatatatttttttttttttttgagatggagtctcactctgttgccaggctggaatgcagtggcacgatctcggctcactgtaacctctgccttccaggttcaagcaatttccctgcctcagcctcccgagtagccgggactacaggtgtgcaccaccacgcctggctaattattttttttgtattttagtagagacggggtttcaccatattggccaggatggtctccatctcctgaccttgtgatctgcccgccttggcctcccaaagtgctgggagcacaggcgt

SEQ ID NO: 65504 - DNA, 601 bp, Human
ctcctgatgggctgtgggctttctgggggtagggtcacaggcgttgtcatggttaagtgactttatgaaacatctgctctatgaaaacctaagctgtaaaatctaaaaaaagaaaatccaccccctacacattccagccatttctcctctctagcacgttgggcctcactggccgtgggtgcatgactcacttttgatcatgttcacgtcattggccccatctccgatggccagcgtgatggctttcttgtacctcttcaccaggtccaccaccatggccttctgcttgggggtgacgcggcagcagatgactgcgctgcactcgcaggccaggtccacaaagtttttctgccgctgctctttcttagcttctagcctccttttactttgggtccgcatccgtctttcttcttctgttcttgggaacttcagcttcagaatcttatttctcttggtctttttctcgagaagaatttcattctgtgaaatcagagagggaaaaggttacattcactttagttttaccccaggagtaccattcccaagatttaaattatgtgaaggataatttttggattatgtcactgattatatttgacaa

SEQ ID NO: 65505 - DNA, 601 bp, Human
cagcctcccacgtagctgggactaccggtgtgtgccccatacttggctaaactttctgtatattgttattgatgtggttggaagaaatgacagcttttacaaagtacataaaggcactaatactacttgtataacttctaaggagacccctaaagtttcctatatttttatcccaaagggatgctctataacttatatataaaagtacctggggccaggtgaggtggctcatgcctgtaatcctagcactttgggagactgaggcaggcagactgattgagcccaggagttcaagaccagsctgagcaacatggcaaattcccaactctacaaaaaatacaaaaattagctgggcatggtggctcatgcctgtagtcccagctacttgggaggctgaggtgggaggattgtttgaggccaggaggtggaggttgcagtaagccaaggtcatgccactgcaccccagcctgggccacagagggagaccttgttttttttttaaatgcacctggcatataacagtgcttaataaaaattttaagacaacttaagaaaaacaagcccctctaagattatctacattgacttcgtgcaatccctc

SEQ ID NO: 65506 - DNA, 601 bp, Human
aggccctggtatccagtcctcaaccttcccgctgagcagaccaaggacaaatgtgaaatgaacactgtcatagttcccagggcaaccaaaagcactgaacagatacactataaggtaacattggtcttttttgtaaaatttaagtacaggcatttagagtttcctgaaatctcaaatgcggtgttaggtgcctcactggtagacattcttttatcattccttaacaaaaagaatatttcctcgctacagcaataatccctcttgcctttttttttttgagatggagtctttttctgtcgcycaggctggagtgcagtggtgcgatcttggctcaatgcaacctctgcctcctgggttccagtgactctcctgcctcaggctcccgagtggctgggattacaggtgcccgccacccccatgcccggctaatttttgtacttttagtggagatggggtttcatcatgttggccaggctggtctcgaactcccaacctcaggtgatctgcctgccttggcctcccaaagtgctgggattacaggcatgagccaccatgccccaccttgcctttatctctctcctgcttcacgtacattctcagg

SEQ ID NO: 65507 - DNA, 601 bp, Human
ccctgccccaggccctggtatccagtcctcaaccttcccgctgagcagaccaaggacaaatgtgaaatgaacactgtcatagttcccagggcaaccaaaagcactgaacagatacactataaggtaacattggtcttttttgtaaaatttaagtacaggcatttagagtttcctgaaatctcaaatgcggtgttaggtgcctcactggtagacattcttttatcattccttaacaaaaagaatatttcctcgctacagcaataatccctcttgcctttttttttttgagatggagtctttytctgtcgcccaggctggagtgcagtggtgcgatcttggctcaatgcaacctctgcctcctgggttccagtgactctcctgcctcaggctcccgagtggctgggattacaggtgcccgccacccccatgcccggctaatttttgtacttttagtggagatggggtttcatcatgttggccaggctggtctcgaactcccaacctcaggtgatctgcctgccttggcctcccaaagtgctgggattacaggcatgagccaccatgccccaccttgcctttatctctctcctgcttcacgtac

SEQ ID NO: 65508 - DNA, 601 bp, Human
gccctgccccaggccctggtatccagtcctcaaccttcccgctgagcagaccaaggacaaatgtgaaatgaacactgtcatagttcccagggcaaccaaaagcactgaacagatacactataaggtaacattggtcttttttgtaaaatttaagtacaggcatttagagtttcctgaaatctcaaatgcggtgttaggtgcctcactggtagacattcttttatcattccttaacaaaaagaatatttcctcgctacagcaataatccctcttgcctttttttttttgagatggagtcttkttctgtcgcccaggctggagtgcagtggtgcgatcttggctcaatgcaacctctgcctcctgggttccagtgactctcctgcctcaggctcccgagtggctgggattacaggtgcccgccacccccatgcccggctaatttttgtacttttagtggagatggggtttcatcatgttggccaggctggtctcgaactcccaacctcaggtgatctgcctgccttggcctcccaaagtgctgggattacaggcatgagccaccatgccccaccttgcctttatctctctcctgcttcacgta

SEQ ID NO: 65509 - DNA, 601 bp, Human
atcacttaccagaagagtagaagctcttctggtaagtgacccagcctagaccctgcttctgtagaccatccagagcttttgaaagtacctagtcccctgtatgaatcttttcttgcttaaataccaactggggtctgtttcctgtgctaaaccctgactgacagaaaacccaagctgagccagtctctctcttgatattctggaattagaagtcagttattttgtgtctagaattttaaggtctaaattcttgaggtaagaaatagttatatttctttctctctcttttttttttttttttgagatgaagtctcactctgtcacccaggctgcagtgcaatggcgcagtcttggctcactgcaacctctgcctcctgggttcaagcgatactcttgcctcagcctctcgagtagctgggattacagatgtgcgccaccacacccagctaatttttgtagagacggggtttcaccatgttgtccaggcaggccttgaactcctgaactcaggtgatccacctgccttggcctcccaaagtgctaggattacacacatgaacaactgtgcctggccgaaatagatatatttcttcctgaagat

SEQ ID NO: 65510 - DNA, 601 bp, Human
gtggtagatactacaaatcggctcccccaacttcattccatccttgttctaattagagaggtgggaaaggaaataaaaaccctacatttcccagactcccttgcagctaggctctttgtgaattaggttccactgtttagatccacttatgacttggaagcagaagtgaatcagagcccagcatcgcttcctcttttgggatttctgcagcagagctcatatctactttccagctacctggatgttgacaggcaactataaaggcttcttaatttggaagctctttagaggaacctcttaycacttaccagaagagtagaagctcttctggtaagtgacccagcctagaccctgcttctgtagaccatccagagcttttgaaagtacctagtcccctgtatgaatcttttcttgcttaaataccaactggggtctgtttcctgtgctaaaccctgactgacagaaaacccaagctgagccagtctctctcttgatattctggaattagaagtcagttattttgtgtctagaattttaaggtctaaattcttgaggtaagaaatagttatatttctttctctctcttttttttttttttttg

SEQ ID NO: 65511 - DNA, 601 bp, Human
acctcaggtgacccgcccacctcggcctcccaaagtgctgggattataggcgtgagccactgcacccagccctgttatcgctactcttaatgtcaacatgaaaaaataaccaaagataaagataaaaacatacaagcaaatcccctcctttttttttttttttttgagacaaagtcttgcccaggttggagtgcaatagcgcagtctcggctcaccacaacctctgcctcccaggttcaagcgattctcctgcctcagcctcccgagtagctgggattacaggtgcctgccaccacaccckgaaaatttttgtatttttagtagagaccaggtttcaccatgtcggccagactgatctcaaactcccgacttcaggcgatccacctgcctcagcctcccaaagtgctgggattacaggcgtgagccaccatgcctggccaaatcccctcctttctaaggtaaaatgtttttacagcaccagaaacatttagagaagtcatgatcattcttaattatgccccaactgtaaggagacacagccccaaaactacaaatatagaagaaataaattgtcttttcagaactagatttttattcattt

SEQ ID NO: 65512 - DNA, 601 bp, Human
ggctaatttttgtgtattttgttgagatggggtttcaccatgttggccaggttggtctccaactcttgacctcaggtgacccgcccacctcggcctcccaaagtgctgggattataggcgtgagccactgcacccagccctgttatcgctactcttaatgtcaacatgaaaaaataaccaaagataaagataaaaacatacaagcaaatcccctcctttttttttttttttttgagacaaagtcttgcccaggttggagtgcaatagcgcagtctcggctcaccacaacctctgcctcccrggttcaagcgattctcctgcctcagcctcccgagtagctgggattacaggtgcctgccaccacacccggaaaatttttgtatttttagtagagaccaggtttcaccatgtcggccagactgatctcaaactcccgacttcaggcgatccacctgcctcagcctcccaaagtgctgggattacaggcgtgagccaccatgcctggccaaatcccctcctttctaaggtaaaatgtttttacagcaccagaaacatttagagaagtcatgatcattcttaattatgccccaactgtaaggag

SEQ ID NO: 65513 - DNA, 601 bp, Human
tggctaatttttgtgtattttgttgagatggggtttcaccatgttggccaggttggtctccaactcttgacctcaggtgacccgcccacctcggcctcccaaagtgctgggattataggcgtgagccactgcacccagccctgttatcgctactcttaatgtcaacatgaaaaaataaccaaagataaagataaaaacatacaagcaaatcccctcctttttttttttttttttgagacaaagtcttgcccaggttggagtgcaatagcgcagtctcggctcaccacaacctctgcctccyaggttcaagcgattctcctgcctcagcctcccgagtagctgggattacaggtgcctgccaccacacccggaaaatttttgtatttttagtagagaccaggtttcaccatgtcggccagactgatctcaaactcccgacttcaggcgatccacctgcctcagcctcccaaagtgctgggattacaggcgtgagccaccatgcctggccaaatcccctcctttctaaggtaaaatgtttttacagcaccagaaacatttagagaagtcatgatcattcttaattatgccccaactgtaagga

SEQ ID NO: 65514 - DNA, 601 bp, Human
aggttcaagtgattcttctgcctcagcctcccaagtagctgggattacaggcacacgccaccatgtctggctaatttttgtgtattttgttgagatggggtttcaccatgttggccaggttggtctccaactcttgacctcaggtgacccgcccacctcggcctcccaaagtgctgggattataggcgtgagccactgcacccagccctgttatcgctactcttaatgtcaacatgaaaaaataaccaaagataaagataaaaacatacaagcaaatcccctcctttttttttttttttttgagacaaagtcttgcccaggttggagtgcaatagcgcagtctcggctcaccacaacctctgcctcccaggttcaagcgattctcctgcctcagcctcccgagtagctgggattacaggtgcctgccaccacacccggaaaatttttgtatttttagtagagaccaggtttcaccatgtcggccagactgatctcaaactcccgacttcaggcgatccacctgcctcagcctcccaaagtgctgggattacaggcgtgagccaccatgcctggccaaatcccctcctttctaaggtaaaat

SEQ ID NO: 65515 - DNA, 601 bp, Human
atgttgcctaggctggcctcgaactcctggccttaagcgatctccccatctcagcctcccaaagtgttgggattataggcaaaactctatgcacctggcctgttatcaatattctttttttttttcttctgagacagagtctcactctgtcgcccaggctggagtacagtggcgtgatcttggctcactgtaccttctgcctcccaggttcaagtgattcttctgcctcagcctcccaagtagctgggattacaggcacacgccaccatgtctggctaatttttgtgtattttgttgagayggggtttcaccatgttggccaggttggtctccaactcttgacctcaggtgacccgcccacctcggcctcccaaagtgctgggattataggcgtgagccactgcacccagccctgttatcgctactcttaatgtcaacatgaaaaaataaccaaagataaagataaaaacatacaagcaaatcccctcctttttttttttttttttgagacaaagtcttgcccaggttggagtgcaatagcgcagtctcggctcaccacaacctctgcctcccaggttcaagcgattctcctgcctcagcc

SEQ ID NO: 65516 - DNA, 601 bp, Human
accaacctgtaaattgaaatgcagatggaaagagaacatgtattccagcactatgaaagtcaaacatgatgccaaaataaagtgcaatgcttccaaaaattgaaaaagcattcacaaaagtccaataagaagtatccaagccaatctgttgggaaaccagagaaaaacagagcactcattttggggagttagcaagaaataaaggatctaacaatcctgaaaacagaattcagcaagttaggcatgatgtggcttgaatactggaccagaaactaaaccatccttgactcaggcaagaaayagaaaatgtgcttggtataagagatgaaaatagcatttatattttgtaagtggcacaggtgcagtgggagtcaggtggatgtgcatgccaccctatatacagaaatataagtaggtaccaatagacactgaatacggccaatgaaagccacgtacctggaaattgactgttattacaagagcagaggcaatggtgacggcaaaagactggtagtcggaaggtgcctctccatcctgccctacggtttgcagataagctccaagaggtatgaagaagaggatcatcgatgttaggacccca

SEQ ID NO: 65517 - DNA, 601 bp, Human
tattttaatttgtcttcctcccatcatgttatgccctttcaacccaccatcaccatttaatttccagacaagacattaattttcactagcaataataatttgtatatatttgttttgttgtgctttgttttttttgttttttttttgagacagggtcccgctctgtcacctgggctagagtacagcagtgccatcacgactcactgtagcctcaacgtcccaggtcaagcaatcctcccacttcagcctctccagtagctagaactacaggcatgtgccaccatgcctggctaatttttttgtattttttgtagagatggggtttagccatgttgtccaggctggtcttgaactgctgggctcaagcaatccacttgcctcggcctcccaaaatgctgggattacaggtgtgagccactgtgcccagccattccaccttgtatattttattacttaacagaagttatgtcaaaatctaaactaatgacatttgtctgtacatttatttttggaatttggaaataccaacctgtaaattgaaatgcagatggaaagagaacatgtattccagcactatgaaagtcaaacatgatgccaaaat

SEQ ID NO: 65518 - DNA, 601 bp, Human
taaagctattttaatttgtcttcctcccatcatgttatgccctttcaacccaccatcaccatttaatttccagacaagacattaattttcactagcaataataatttgtatatatttgttttgttgtgctttgttttttttgttttttttttgagacagggtcccgctctgtcacctgggctagagtacagcagtgccatcacgactcactgtagcctcaacgtcccaggtcaagcaatcctcccacttcagcctctccagtagctagaactacaggcatgtgccaccatgcctggctaayttttttgtattttttgtagagatggggtttagccatgttgtccaggctggtcttgaactgctgggctcaagcaatccacttgcctcggcctcccaaaatgctgggattacaggtgtgagccactgtgcccagccattccaccttgtatattttattacttaacagaagttatgtcaaaatctaaactaatgacatttgtctgtacatttatttttggaatttggaaataccaacctgtaaattgaaatgcagatggaaagagaacatgtattccagcactatgaaagtcaaacatgatgc

SEQ ID NO: 65519 - DNA, 601 bp, Human
gaaagaataggcttttatccagccttttaagtcttaagttatctaattcaacacacgtacagcgctattgtaaagctattttaatttgtcttcctcccatcatgttatgccctttcaacccaccatcaccatttaatttccagacaagacattaattttcactagcaataataatttgtatatatttgttttgttgtgctttgttttttttgttttttttttgagacagggtcccgctctgtcacctgggctagagtacagcagtgccatcacgactcactgtagcctcaacgtcccaggkcaagcaatcctcccacttcagcctctccagtagctagaactacaggcatgtgccaccatgcctggctaatttttttgtattttttgtagagatggggtttagccatgttgtccaggctggtcttgaactgctgggctcaagcaatccacttgcctcggcctcccaaaatgctgggattacaggtgtgagccactgtgcccagccattccaccttgtatattttattacttaacagaagttatgtcaaaatctaaactaatgacatttgtctgtacatttatttttggaatttggaaatac

SEQ ID NO: 65520 - DNA, 601 bp, Human
actctgttacccacgttggagtgcagtggcgtgatcatggctcactgcagcctcaacctcctgggctcaggtgtcctcctaccttagcctcctgaatagctgggactacaggtgtgcgccaccacgcttggctaatttttgtattttttgtagagatggggtttcaccatgttgcccaggctggtctcaaactcctgagctcaagtgatccacccatattggcctcccaaagtgctgggattacaggcgtgagctaccacatctagccccagtattaggttttatgggaaagaaagaatargcttttatccagccttttaagtcttaagttatctaattcaacacacgtacagcgctattgtaaagctattttaatttgtcttcctcccatcatgttatgccctttcaacccaccatcaccatttaatttccagacaagacattaattttcactagcaataataatttgtatatatttgttttgttgtgctttgttttttttgttttttttttgagacagggtcccgctctgtcacctgggctagagtacagcagtgccatcacgactcactgtagcctcaacgtcccaggtcaagcaatc

SEQ ID NO: 65521 - DNA, 601 bp, Human
taccttatcactttctgatggccagatggtcattgacaggaatcgaatggcaacgacgggtagtaagcacacagcaacagtcaggatgatagttaaccaaatgtatggctgtctcagagcgtttgaagctgtgcctgtaaagaacatggcaaatgcatcactgtggttcttttttcctaagaacatagttaatatttcgccaggtgtggtggctcatgcctgtaatcctaacactttgagaggccaaggtgggtggattgccagagctcaggagttcgagaccagcctgggcaacatggtraaaccccgtctctactaaaatacaaaaaatcagccgggcatggtggtgtgcacctgtagtcccagctactcaggagacagcagaattgcttgaacccggaaggcggaagttgcagtgagccgaaattgtgccaccgcactccagcctgggtgataaagcaaaactctgtctcaaaaataaaaaataaaataaaaaaaagaacatagttaatatttcataatctataaatagatcatttatggtaaagttttacaactggattggcctccccaaaatatccattatggctcaaagaacaga

SEQ ID NO: 65522 - DNA, 601 bp, Human
tgttgggaaacgctttggtttctgtgagggacagagttgggaaaggactatattctttataccttatcactttctgatggccagatggtcattgacaggaatcgaatggcaacgacgggtagtaagcacacagcaacagtcaggatgatagttaaccaaatgtatggctgtctcagagcgtttgaagctgtgcctgtaaagaacatggcaaatgcatcactgtggttcttttttcctaagaacatagttaatatttcgccaggtgtggtggctcatgcctgtaatcctaacactttgagargccaaggtgggtggattgccagagctcaggagttcgagaccagcctgggcaacatggtgaaaccccgtctctactaaaatacaaaaaatcagccgggcatggtggtgtgcacctgtagtcccagctactcaggagacagcagaattgcttgaacccggaaggcggaagttgcagtgagccgaaattgtgccaccgcactccagcctgggtgataaagcaaaactctgtctcaaaaataaaaaataaaataaaaaaaagaacatagttaatatttcataatctataaatagatcatttatg

SEQ ID NO: 65523 - DNA, 601 bp, Human
gtagccccgctggtgcgagaaggcgtaggccgagcgccgcgttgacacgccccggcggaacacctgctgccgtcgctgccactgctcctccgccttcaaccgcttgcgatgcttctggatctgcaagggggagagatggggagggatgaaaataagatccacaccagggaggaggcctggccagacggttgacagaaatgaacactgatgaactcccctgacacctgccccattttgatgcaggcagttctgtccccacttgtgtgtgtgtgtgtgtgtgtgtgtgtgtgtgtgtgtgtgtatgtgtatgtgtgtctatatctttttttttgtttttgagacagtctcgctctgtcacccagacttgagtgcaatggcacgatcttggctcactgcaacctctgcctcccaggttcaagcgatcctcctgcctcagcctcctgagtaactggggttacaggcacgcactgccacacccgtctaatttttgtatttttagtggagacagaatttcaccatgttggccaggctggtcctgacctcaagtgatctgcctgcctcggcctccaaaagttctgggattacaggcatgaaccacagt

SEQ ID NO: 65524 - DNA, 601 bp, Human
cgcttcttgcggatgctgcgcccggaggagatgaggtccgcgtagccccgctggtgcgagaaggcgtaggccgagcgccgcgttgacacgccccggcggaacacctgctgccgtcgctgccactgctcctccgccttcaaccgcttgcgatgcttctggatctgcaagggggagagatggggagggatgaaaataagatccacaccagggaggaggcctggccagacggttgacagaaatgaacactgatgaactcccctgacacctgccccattttgatgcaggcagttctgtccccacgtgtgtgtgtgtgtgtgtgtgtgtgtgtgtgtgtgtgtgtgtatgtgtatgtgtgtctatatctttttttttgtttttgagacagtctcgctctgtcacccagacttgagtgcaatggcacgatcttggctcactgcaacctctgcctcccaggttcaagcgatcctcctgcctcagcctcctgagtaactggggttacaggcacgcactgccacacccgtctaatttttgtatttttagtggagacagaatttcaccatgttggccaggctggtcctgacctcaagtgatctgcctgcct

SEQ ID NO: 65525 - DNA, 601 bp, Human
gcgcttcttgcggatgctgcgcccggaggagatgaggtccgcgtagccccgctggtgcgagaaggcgtaggccgagcgccgcgttgacacgccccggcggaacacctgctgccgtcgctgccactgctcctccgccttcaaccgcttgcgatgcttctggatctgcaagggggagagatggggagggatgaaaataagatccacaccagggaggaggcctggccagacggttgacagaaatgaacactgatgaactcccctgacacctgccccattttgatgcaggcagttctgtccccagttgtgtgtgtgtgtgtgtgtgtgtgtgtgtgtgtgtgtgtgtatgtgtatgtgtgtctatatctttttttttgtttttgagacagtctcgctctgtcacccagacttgagtgcaatggcacgatcttggctcactgcaacctctgcctcccaggttcaagcgatcctcctgcctcagcctcctgagtaactggggttacaggcacgcactgccacacccgtctaatttttgtatttttagtggagacagaatttcaccatgttggccaggctggtcctgacctcaagtgatctgcctgcc

SEQ ID NO: 65526 - DNA, 601 bp, Human
agagtctttcataaaaaaatagacgtgctttgtggccgcatcccagcctgggggtaagggatcagctgtccccggtgcgcctgtactccgcggtgccatccgccacgatggcatcaagcggcgagcgcttcttgcggatgctgcgcccggaggagatgaggtccgcgtagccccgctggtgcgagaaggcgtaggccgagcgccgcgttgacacgccccggcggaacacctgctgccgtcgctgccactgctcctccgccttcaaccgcttgcgatgcttctggatctgcaagggggagaratggggagggatgaaaataagatccacaccagggaggaggcctggccagacggttgacagaaatgaacactgatgaactcccctgacacctgccccattttgatgcaggcagttctgtccccacttgtgtgtgtgtgtgtgtgtgtgtgtgtgtgtgtgtgtgtgtatgtgtatgtgtgtctatatctttttttttgtttttgagacagtctcgctctgtcacccagacttgagtgcaatggcacgatcttggctcactgcaacctctgcctcccaggttcaagcgatcctcctgcctca

SEQ ID NO: 65527 - DNA, 601 bp, Human
caactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggagrctgaggcaggtgggtcacatgaggccaggagttcgagaccagcctggccaacatggcgaaatctcgtctctactaaaaatgcagaaattagctgagcatgatggcctaagcctgtgatcccagccacctgggaggctgaggcatgagaattgcttgaacccagaatgcagaggttgtagtgagctgagatcatgccgctgtactccattctgggcaacagagtgagactctgtctcaaaaaaaaaaaaaaaaaaaaagattatattgaaaaatgaatgtttatgttattctgaaattttt

SEQ ID NO: 65528 - DNA, 601 bp, Human
aatgcagaggttgtagtgagctgagatcatgccgctgtactccattctgggcaacagagtgagactctgtctcaaaaaaaaaaaaaaaaaaaaagattatattgaaaaatgaatgtttatgttattctgaaatttttacgctttttagaattcagaattttttttttttttaagacaggatcttgctttgtcacccaggctggactgcagtgagcatagtttcaactccctgggctcaagcgatccttctgcctcagtctcccacatagctgggactacaggcacacatcaccatgcccasctaatttattttttgtagaaacagggtctcattatccctctgagttgctcaggctggtcttgaacccctggactcaagtgatcctcccacctcaacctcccaaagtgctgggattacaggcatgagctaccagacccagcccaggataagattttttaacatgttagaataatagatctttggaaatagaatttaaagaggtaggagctgccatcatgccagaaataggaggaaagaagccatcctaagacagtatgtacaggaaaatcaggcttactgttttaaaatccatttagagac

SEQ ID NO: 65529 - DNA, 601 bp, Human
gaatagaaattggaaagtgtaatactgtaaaatacatatgtgtttttgatgccatttcctggcattcaactcttaaaatccttgaaacctctgaagtgatgtctttttgtatgctaatgagttaactggtagatgacagccccctaggtagctttaggatgggggctggtcagcagaaagactaaggcaggattagagtcagaactttcagttcccgcccccaccaacccccaacatttagggaggggagaagggcgaaggttaagttgatcaccagtgacccgtggtttaattagttgtrcctacagaatgaacgttccataaaaatccaaaagaactgggttcagagagcttctggatagctgaacatgtgcaggctctggtgccctgtacatctctttatctgtcctttgtaacatcccctataataaacctgtaaacataaatgtttccttgaattctgtcagccgctctaagcaaactaatagaacctgaaaaaggggttgtgggtacctggatttatggctggttggtcagaagcacaggtaaaataacctgggcttgccattggcattggaagtgggggccgtcttgaggatgg

SEQ ID NO: 65530 - DNA, 601 bp, Human
tgatggggagaaaccctcacacatttggtaagaaaagtcttccctgttgattgttttggtgagagggcagaggaaaaatagtttgagtgttttccatactcacagaaggcaagggaattaatttcatgcagagcccagagcggggtggaggcagagcttgaaagtgtatagaatgtacagaagatagaataatttttgtatggcttgaatttagaataggagagagagtttgagggacaaggctggaaaggaccttatgaagaattttgaatgccatggcaaggagtctagactttatttkgtgaaaaatgggcagtcattgaaaaattttaacatttaaagatattttggatcgtaattttttgttaaaattaatatgatggttgtgttagtcagttttcatgctgctgacaaagacatacccaagactgggcaatttgtaaaggaaagaggtttaatggactcatagttccatgtggctagagaggccttacaatcatggcagaaggtgaaaggcacatcttaggtggcagcaggcagagagaatgagagccaagtgaaaggggaaacctcttacaaaatcatcagatcttgtgagacg

SEQ ID NO: 65531 - DNA, 601 bp, Human
taatgaagctgtcaacttaagatggaggtcaacttacccgtttaagcattggttgtttagaaaatgtttaattttcttctattcccctatgtactatactcttcagctggtgatttgaaatcgtccttccttttctctactctcttctcttggcatatttttggccctttctctcttgtggagtgcctgtgaactttaaaaaccccatctcaaatgccaattcatccctaaagttctttctaatctgtattgctttgactctaaatatatgtcttttcctagtctaaagcccccaaagcasttatttttattctacaggatattacttttttggtccctattaaactatgtggcagcaagtcacaaaggaggaatcagaaagtaacctgctccccacccttggtgtgtagtccagttagcaaggtatgtatataagtaatataagtaatgataaccaacattgccatgcaaaagtgaggaatgccacaggagtaaattgttgcttctagtcagagtcctgtaactgagaagcacaggtagaacataggaggttatgtgagctgagctttgaaagatgagtaaaatttagatgggtaaagga

SEQ ID NO: 65532 - DNA, 601 bp, Human
tatttgggagatgaaccaaaaagcagaagtgagagaatgggaaaagtgagacagagaagggagtgaagtttcattaagtgggtgatccagttccccctgcgggcagctgggcttcagccctgtgggtgtcttctgaatgtacctcactgttgtcccaccaaaggacagggagcctgagacatgcatgcaccaactttcacctgttgttaattgaaggttgctccgtgagctttaactccggcaggtctgtgcttgtgcctccatgctgttgagcagtctcccttaggtttgcaaagtctcygaggaacaaaacagagcagtgcctccactcccacttgagtcaggtgctgtgcatgccacatagacctgcccaccagagccacagtgcggagaggggtgagctgcagagcaccacgaaggtctgctgtggtctgccccttttaccagtgagactccctcatgccccattagatctactctgtcactgaccctgcagattggtggctgattatgatcactaaaagaaatatctaacaggtgcagtggctcacgcctgtaatcccagcactttgggaggctgaggcgagtggatcatgaggtc

SEQ ID NO: 65533 - DNA, 601 bp, Human
tctgtcccccgccgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagrggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaa

SEQ ID NO: 65534 - DNA, 601 bp, Human
cgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagaggtggagtctcrctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaactttatcttcca

SEQ ID NO: 65535 - DNA, 601 bp, Human
ttaagttttaaagatactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacrgtggtttgggaacttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttaggga

SEQ ID NO: 65536 - DNA, 601 bp, Human
atactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaayttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgcc

SEQ ID NO: 65537 - DNA, 601 bp, Human
ctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgccccttttgtttttctttttcctcattgcctctttttaaaatgatcttttttttatttttaaaagattatatattggccaggcacggtggctcatgcctgtaatgccaacactctgggaggccaargtgggaggattgcttgaggccaggagttcgagaccccatctctatttaaaaatacacacacacgtgtgtatgtgtgtgtataaagattatgtaagcagcctattaataagttcctatataaaattttaaacactatgcaccaaagccttttagtccctcttccccacccttcaccccattgccctcctcaccaccctccttgccctccatcccactgccatcttggggacctctgtttcttaggttattggtctgtttgtgtattccattccctgttgagttaatttttgtattaatatc

SEQ ID NO: 65538 - DNA, 601 bp, Human
gtagaacagtgcctggcctatagagctctaagtgttaactattatttaatattattatgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcrgttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagcgccccctctataatagttttcttccacttccctattctcattgcctctt

SEQ ID NO: 65539 - DNA, 601 bp, Human
taacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagcsccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgtt

SEQ ID NO: 65540 - DNA, 601 bp, Human
cttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttgggaggctgaggcaggagaatggcttgaacctgggaagcggaggttgcagtgagctgagatagcrccaccgcactccagcctgggtgacagagcggactccatttcaaaaaaaaaaaaacagttcattgctcaataagtgaatatttccaggatgcttaaattaaacagggtagactaagcagctaaataaaggtggtcttatctactgcttttcaaatttagtgtacgcgcatgtcacctgggggtcttgttagaagattctaattcagcacggtctgggattctgcatttctagccagcttgcaagctagccagctctgcccagtgagggtgtaattcactagattggctacttaaacccatt

SEQ ID NO: 65541 - DNA, 601 bp, Human
aagtatattcaggtcctccattttatgatgtgagtctaaatttctgttctctgatgtctagaaatcacaaaaggatggtgattttgggaacgaagttcttgagctagcactgtcagtagtaactggccgttactgtaagatctagagatatatttttagatgccattatacttacaaagaactgttagagtgcattttatggttttatggttggtttaattccccaaatatattgcccttagcaagttattactattttttatttcttaaatttatttattgaacatttttattcctttgyttagaaatgtgctagacagtggcaattacattgctgcaagataagtaaaaaaatcagctgactaagctttataagaggaggaatcatgtctcttttatttaccgttggatagtcactacatggcacataaccaagtcatcattaagtcatttttgagtgaacattgctcaagatctgcaaagcagctgtgatgtgtgcggggtgtactggaagttgaacgggactcctcaagcagcctaatgagttgggattgaggattgcatacacaagggaactcgcagatcaagtcctgaagagaac

SEQ ID NO: 65542 - DNA, 601 bp, Human
tactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatattgcttttcaaactggctaggwttgttgatatctgatgttttaatggctttactgcataactatttcttttccagaatggccactttgcccttcctttagcagttgaaaatctggatgcctctcaccgtactggagttttgggaatttgtgcttcaaaaaactcagatgcttcataacaaaaattgctgcaaaaagactttctttcagtaatatcatagactttattggttttgaaattttatatttaattcccagcttcttgtgacataaaggataaccacagagtttgacaatagaatgttcattcactacatcgttgta

SEQ ID NO: 65543 - DNA, 601 bp, Human
taacccatactcaaaggaattagtttccacctcttaaaaagaagagtatgaaagagtttgtggacatatttaaaaaccaccacagatggtttattcagtaaagttcttaatatgaattagtattaatttattaattcatttgcacattttgaaggagaaaaactctgtgctcatatcactagatgaagcaaaagcacttgatgaaatttaactccatgatgaaacctctcagcaaactaggaagggaacttccttaatgtgataaagactttcattaaatttataattaatttaggaacarttgacataccttatattgaagctttctgtacgtaatatgattcatctatttgttaaacttattattttgttcttcagtattttaaaattgtgtttatatcagtgttttacatttggaattgcaaaatgatatagtgaaagatgaagactggaagtcctagctagagcaattaggcaagagaaggaaataaagggcatctaaattggaaaggaggaagtcgaattgccacgatcatatatatatgtggaaaaccctaaaaacttcaccataaaacttttagaactgataaatgaatttagt

SEQ ID NO: 65544 - DNA, 601 bp, Human
ttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagatkcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaa

SEQ ID NO: 65545 - DNA, 601 bp, Human
ggtgtggtttttatatcatttcagttgtgttgagatagggaaatgggatagtttatccactgtactgctcttttgggaaagtctggtttgtatataaaagtgaaaggaattggcataatgttttaatttcttctgctccattcagtcattccctcaataaatatttatttagtatcgactctgtgccaggcactgttccaggtgctaaaaatataaagtgagtgaaacagactaaccctcctggcctcatggagcatatattctagagcaggtggcaggcaataaaatacagaaaaattayatcaaattatatagcatgacaaatgctaaagagaaagaaacagccagaaaggagaggagtgctaggcatggggatgggattacagttttaaatagggtgggcaggaagcctgtaaataagaaagggattttgagtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgt

SEQ ID NO: 65546 - DNA, 601 bp, Human
tgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaa

SEQ ID NO: 65547 - DNA, 601 bp, Human
aattttcctttatctacccaaatcctataaaacggccccaccctcatctcccttcgctgactctcttttaggactcagcccgcctgcacccaggtgattaaaagcttttattgctcacacaaagcctgtttagtggtctcttcacacagacgcacatgaaactaggcaagaatcagtgtttctctacaaattgagttgacaaaaagaaattatcttcccctgcccccacaaaaaaagaaccagtatttctcaacaaggagagtactgttagcatttggttctttattttgaaggattgtcyctgcacattgcattttctatcctggtccctggtcaaactgtatgtcctgtcatatcccagacattattccaaccaaaaagtcacctacatatttttagatcctcttaggagggggtggtaacccagccactgctgatgcctgaggggagtgcaaagctgggtttttgaggagctgggactgagatcctgagtagtaggcaccactgggcctaaaaggattccatggggttggttctgggagtgtggaaggaagcagagagtgtagattgctgctgccaattgaatgccagtggcattcag

SEQ ID NO: 65548 - DNA, 601 bp, Human
cgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggrgagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaa

SEQ ID NO: 65549 - DNA, 601 bp, Human
ataaggagcagagcagccatgcgaacaatggccttggagccaggaagtctgcagtgagtctattccttctcagaaagcttgtcagacccggcgcctggagctgcctggcggggagggacccctggaaaggggagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagat

SEQ ID NO: 65550 - DNA, 601 bp, Human
tttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctgrccaacatggtgaaaccctgtctatactgaaaatagaaaaattagctggacgtggtggtgcgtacctgtagtcccagctactccgaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgac

SEQ ID NO: 65551 - DNA, 601 bp, Human
cttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctggccaacatggtgaaaccctgtctatactgaaaatagaaaaattagctggacgtggtggtgcgtacctgtagtcccagctactcygaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgaccaacatggagaaactccatctctactaataatacaaaaattagctgggcgtgatggcgcatgcctgtaatctcagctactcgg

SEQ ID NO: 65552 - DNA, 601 bp, Human
gaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatasaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcct

SEQ ID NO: 65553 - DNA, 601 bp, Human
gggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatac

SEQ ID NO: 65554 - DNA, 601 bp, Human
ggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgcwctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatacgtattgagctcgtagtcagggaagatttgatggctgttctccatacaagttatcacagctttttttgt

SEQ ID NO: 65555 - DNA, 601 bp, Human
attttttattttaaaaattattttaaatatgtgtttgctgttatctcatttggttctcaaaataactgtcagttaataaatatcattccagatttgtttgtttgttaagatggggtcttgctgtgttgccaaggctggagtgcagtggctcttaactgttgtgatcacagtgcattgtagcctggaatttctgggctcaagtgatcctgtttgagcccaggattacagctgagattacaggcggtcaccaccacagttggcctcattccagttttaaagatgaggaaactaattcagagargttaagttaaaggcagatccagaatttgaacttatgccagggtagcagggtcgtggatgtttttgcggaaggaactcacacacagtcctttcctctgaaagggaaagcacttagagtctcacggccagccagctctgcagggtgccttggttgtggctctaatgagacaaggccacatattagctttaaataaaccaatgaggaaacagtgacaatgaaagatgtaacaaggcatagcggtcagtctcctgcccaagactgtgagttccttgcagcaggaacaaccatactcatatttgt

SEQ ID NO: 65556 - DNA, 601 bp, Human; identical to SEQ ID NO: 29680

SEQ ID NO: 65557 - DNA, 601 bp, Human
cattacaggcgtgagccactgtgcctggctgatattttcatcttaaagcacaaacatagaatgaaatctatagcttctttttattttgccttagtattataacaatatccttagtattacaacaatatccttagtattaccatgctaagaatacagagccttcagcaaaagccacttttacttgtgaaacaccaaattatttagtacaatacctttacttcaatatctgttacatgccttgttgatcagcatcaaccaaagctgctatagttttgaagatgagttaaattcatagtaataytatatttgctacctcacttccaggtaatctccattttggcataaatttttttaaaatctgtttagatcacacgtaggcaatatgatacaaaattctcagtcttcgccccagttcacattgttctataataaacttttattaggtggaataagttggtaattagttactacgtaaaagcaaaagatcttattaagaattacatttctctgataaagagtgaaatttgttacatttcctttcaaaaaattattttgatagttgcttcaaataacacacaaatgtttgctcttaaagctaaaa

SEQ ID NO: 65558 - DNA, 601 bp, Human
tttgtcttaagtcttaatcattcctaatagcaagagctactggaaaacagagaaacaggattgtcacaattgtcttaatctatatccattgcctagggctgggtgtgttgttcccccaaacaaaatcagagtttggttagctgggaaaagggggaaaataggtatcaattggacaattaaaaggatctgggagagatttaattttttccatcaattagaatgttttcctctacaaataattaaaaaaaaattaaaagagcttaaacatgacattttgggctaggtgatttttatttttttwaaaaaaagtttgaacaataaagagcatgtagtaacacacaggaagtctgtatataaggggactgtagttggttatgtggctcatcaagacccaagttctttgtcttttcaactgtgacatctctaaatgtcaggttagccacagtgtcacagtgtggctgctgagagactagacatcacatgcagatgaggtaagcttgagttgacaatgctcagttaaagaagagggaaatctgtttgtgtctctttttaattgataaatctttccccattcactcacttcctctccccaacagacttc

SEQ ID NO: 65559 - DNA, 601 bp, Human
ataaaacttccattcagaggaagaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgartcagcctgggatatctttggaagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagt

SEQ ID NO: 65560 - DNA, 601 bp, Human
agaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgagtcagcctgggatatctttggmagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtct

SEQ ID NO: 65561 - DNA, 601 bp, Human
agttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctcygtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcaggga

SEQ ID NO: 65562 - DNA, 601 bp, Human
ttaattttgaaaactggtaaatagagggagaaatcaaacattaatcttgcctttctaacatgaactgtgccacctgtatccaattagtaggtgagggaaagcatctcatagatgtattccaagtcataaaaaagagaaatgataggattagatacattattttatactatgccgattgaattagtgaatctagaccttaaaaacagagataagcaggcatttggttccctcctgcccacaacatacagagcagctgcatttcagcgctcaatagacacatgtgacttgtggctaccatatyggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataa

SEQ ID NO: 65563 - DNA, 601 bp, Human
agatacattattttatactatgccgattgaattagtgaatctagaccttaaaaacagagataagcaggcatttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctwcaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagata

SEQ ID NO: 65564 - DNA, 601 bp, Human
atttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcktatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagataaatggacatatctggtattagcttcataattatatgaaagggggagggagtgaaacaagaagggccatg

SEQ ID NO: 65565 - DNA, 601 bp, Human
cacccgcctcggcctcccaaggtgctgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccraaagtgtcataaaataagcctaatcattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgac

SEQ ID NO: 65566 - DNA, 601 bp, Human
tgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccaaaagtgtcataaaataagcctaatyattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgacacatgaaaattatatggaattcaaa

SEQ ID NO: 65567 - DNA, 601 bp, Human
accaaccgtttgccatctgagttctgttgtagacattctatcttaaggttgcggcagagggcatttatttgctgtagaaaaaggaagccaataaattattgggaaaatatgaaaaattacttagccaggaataaaaatctagtaaaatcattgatgccaaaaattgctgttgatgacaaggacctgtaaatgtgcctgtgtatggtcatgtgtctcttgtaactgtttgtctctttgtatgtatatgttttcattttttcctgagatgttatacttaaacatgtaagctattaaatatttygtgtgtgtttgttttgaaatataacctatacccccagtccaccccagggctcgtagtttattctttgtaaatacacgggacttgtgggtggcgagagattgacatgttcagaactgacagaaggccatgtgccaagtaaagtgatgatggtgaggcctgcaggacccagatcctgttgggccctgggagcacacagtggaggttggattttattctgagtgcattgtggagccattgattggttttatataggagtgacagatttgtgtttataaaatgtctctggctgctctgtggaaa

SEQ ID NO: 65568 - DNA, 601 bp, Human
gattttattctgagtgcattgtggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtyaggagatgtctaagcaggtcatggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcactttttttttttttttttttgagatggattttcgctcttg

SEQ ID NO: 65569 - DNA, 601 bp, Human
ggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtcaggagatgtctaagcaggtcayggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcactttttttttttttttttttgagatggattttcgctcttgtcgcccaggctgaagtgcaatg

SEQ ID NO: 65570 - DNA, 601 bp, Human
gtttttaagatgtagcttagatttcattacttttgacacctaagatcagtttgagtttgacacctaggatgagccttttcctttgtttacatgtaaacacctccgtattttgtcactttttttttttttttttttgagatggattttcgctcttgtcgcccaggctgaagtgcaatggcttgatctctgttcactgcaacctccacctcccaggtcaagtgattgtcctgcctcagccacctgaatactgggattacaggcgccttgccaccacgcccagctaattttttaatatttttastagagacggggtttcaccatgttgaccaggctggtcttgaactcctgacctcaggtgatgtgcccactttggcctcccaaagtgctgggattacaggcgtgagccaccgcgcctggcctttgtattttgtcacttttcacattgtatttatttgcttttgtgcttattccccctctgctttccaccaagtttctcaaggccacatatgtggttttgatgccacatctttgcgtttctagcatttaataccttgcctgcacataatagacccctactaagtattctgttgaatatttggca

SEQ ID NO: 65571 - DNA, 601 bp, Human
ggaaaggtgacatggcttgcccaagaccatccagctaggtaaagcggggtaggcccatggcaaaacagaatcccagtctcctcatttcctgctcagtggatttcttcccttcctgtacctcctgcttcccccaccccatcttttacagttgatgtttctaacataaaggaggtctttccgctttgtagcaatcagatccaacggaagccttgacattatattacggaatttatttctgaaaggagagtggtgtggggggcgcggggatgagtaatatatgtatgtacacaaacttccagctttttttttttttttttaagtgttttctctcctggccgggcacggtggctcatgcctgtaatcccagcactttgggagactgaggcaagtggatcacttgaggtcaggagtttgagaccagcctggccaacatggtgaaaccctgtctctaccaacaaaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgac

SEQ ID NO: 65572 - DNA, 601 bp, Human
aaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgacagagtgagactctatctcaaataaaaatgttctctatactcattcagtagcaaattcttttactaaatattcggtataagaaagtgaaggttattggccaggcatagtggctcacggctatattcccagcacttcgggaggctgaggcgggaggatygcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttc

SEQ ID NO: 65573 - DNA, 601 bp, Human
cattcagtagcaaattcttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactrtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaa

SEQ ID NO: 65574 - DNA, 601 bp, Human
aagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactag

SEQ ID NO: 65575 - DNA, 601 bp, Human
gcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcrgcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtca

SEQ ID NO: 65576 - DNA, 601 bp, Human
gcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacytgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagact

SEQ ID NO: 65577 - DNA, 601 bp, Human
ccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctrtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactct

SEQ ID NO: 65578 - DNA, 601 bp, Human; identical to SEQ ID NO: 29679

SEQ ID NO: 65579 - DNA, 601 bp, Human; identical to SEQ ID NO: 29678

SEQ ID NO: 65580 - DNA, 601 bp, Human; identical to SEQ ID NO: 29677

SEQ ID NO: 65581 - DNA, 601 bp, Human; identical to SEQ ID NO: 29676

SEQ ID NO: 65582 - DNA, 601 bp, Human; identical to SEQ ID NO: 29675

SEQ ID NO: 65583 - DNA, 601 bp, Human; identical to SEQ ID NO: 29674

SEQ ID NO: 65584 - DNA, 601 bp, Human; identical to SEQ ID NO: 29673

SEQ ID NO: 65585 - DNA, 601 bp, Human; identical to SEQ ID NO: 29672

SEQ ID NO: 65586 - DNA, 601 bp, Human; identical to SEQ ID NO: 29671

SEQ ID NO: 65587 - DNA, 601 bp, Human; identical to SEQ ID NO: 29670

SEQ ID NO: 65588 - DNA, 601 bp, Human
ttttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcrttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgaggaaaagacgttcgcatacctccttgtttttattataattcctcaccctcaacaatggggt

SEQ ID NO: 65589 - DNA, 601 bp, Human
tccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggcggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaag

SEQ ID NO: 65590 - DNA, 601 bp, Human
tattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggrattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtct

SEQ ID NO: 65591 - DNA, 601 bp, Human
ctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtcttgagactgcctgcagtgccttcagccacmtagtaaagaaccctatcagccaggtgtgtgctctctaagcaatgggtaggatgtttcttaaggaaatctgttcagcccaagagataaaacctaaaaatactgctgttagggcccagtgaaatggtccaggcagattatcttacagtgaagcttgtaatcagtaaaccctacccatatactaacagcttgccaatcaaggtgtcaggctgtgaaggatactgatctctgagaaaccagaaacaagtgaggtgagccttgtgattgcccaccttcttctccctgaacagagtttcgggttgg

SEQ ID NO: 65592 - DNA, 601 bp, Human
cagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcggkaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagtt

SEQ ID NO: 65593 - DNA, 601 bp, Human
cagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaaca

SEQ ID NO: 65594 - DNA, 601 bp, Human; identical to SEQ ID NO: 29669

SEQ ID NO: 65595 - DNA, 601 bp, Human; identical to SEQ ID NO: 29668

SEQ ID NO: 65596 - DNA, 601 bp, Human; identical to SEQ ID NO: 29667

SEQ ID NO: 65597 - DNA, 601 bp, Human; identical to SEQ ID NO: 29666

SEQ ID NO: 65598 - DNA, 601 bp, Human; identical to SEQ ID NO: 29665

SEQ ID NO: 65599 - DNA, 601 bp, Human; identical to SEQ ID NO: 29664

SEQ ID NO: 65600 - DNA, 601 bp, Human; identical to SEQ ID NO: 29663

SEQ ID NO: 65601 - DNA, 601 bp, Human; identical to SEQ ID NO: 29662

SEQ ID NO: 65602 - DNA, 601 bp, Human; identical to SEQ ID NO: 26543

SEQ ID NO: 65603 - DNA, 601 bp, Human; identical to SEQ ID NO: 26544

SEQ ID NO: 65604 - DNA, 601 bp, Human; identical to SEQ ID NO: 26545

SEQ ID NO: 65605 - DNA, 601 bp, Human; identical to SEQ ID NO: 26546

SEQ ID NO: 65606 - DNA, 601 bp, Human; identical to SEQ ID NO: 26547

SEQ ID NO: 65607 - DNA, 601 bp, Human; identical to SEQ ID NO: 26548

SEQ ID NO: 65608 - DNA, 601 bp, Human; identical to SEQ ID NO: 26549

SEQ ID NO: 65609 - DNA, 601 bp, Human; identical to SEQ ID NO: 26550

SEQ ID NO: 65610 - DNA, 601 bp, Human
aaaatctcaaaagtacctgggcccagttacttactcagctttcagcctcttaaatgtccataataataagtataatgttttattcatagtacctactttctatggtttagcggtttaaatgcaatcctatatgtaaagtgtttagcatactatatatttaatgtagtagttgctgttcttattgtaatcatcattttaataaacggcagtatagactgggtgaccaaaggtgaagagtcattgaggctaattaggaaattatattgggaactaaatgtgagaaatactgagaaaagaattsataggatttaggagttgattagatttgagtcagggtgaatggataattcctgtaggaaagttgtgggtttagggtagggattggtaattatacccggagtttgagctagtgattatttcagcaggcagttggaaatacagagttcgagtttgcaagaaaagtcagaatataattagtcacacaaaatcctggaagaaattagaaaaaaagcaatttcttcctctaatgttattgtggactttttttttttaggtgcttgtggcagaatattgtggattttttgaacccatttttggttat

SEQ ID NO: 65611 - DNA, 601 bp, Human
actcatacttctcatgcttttctttattcatctccatgggaactatgaaataacaatccttagatatggaatccatctgatctttgcccttttgctgttgattttccttttcctgctgacctcagtcttataccttaagtaagtgagaccaggtatgcatattaaggaatttctgtagtcaacaaatgaactttactttctttagtatatttcttttatctcaagaaacaagaataaatacttagaagatcagtagttgcaaaactactaattgcttttcataactcagttttttcacctmattatagttgattggttaggaaaacagcagaaagttaaagtcttaattttaagttgttcttggtggacatattatatatatctacaaacactttcaaaagccttttatgtttatattgccttagtgctgataggttttgagtgattgaatcacatactcatatttcaccagctgtcatttagcttccatttaaatattttctgcgtaagataaaattacagttcaaccatcctaatttatacctgtacatgtagggttcttggactaatttctgctgtgaggtgaacatccctgcttagc

SEQ ID NO: 65612 - DNA, 601 bp, Human
ctgatgtgtccatttcatgtgttacacgggactgttgttaaggcagtgtatcatagtttaattggaagtgtttttttcttttttagagatttataaaagtatggtgctgcttacaacttccatgaaaagaatcattggcatataggtagtagttgaagacatgggaatggaggaaacatctaggggaacaaagaatgaagtgaggtctctgtgaataggatctggtatagattctggtgtgtgtgtattttccatttagcagtagaggcagaatgcatacctgctctgactgctaaatgcmtgcatttcttgatctccatcagcttttgctccaaaatttggcagtgacctttttactttcctaagccaaagaatagtagcgccaaagaatagtagcaccaaagtgttactagtgagaactatgtgttctcaccatgttagaacatggtgttccaaggaatttaatcctgcctctggaagtgatgtatgcaggtaagccaaggaaatgctctatataaaaatagaggaagacccccccccaaaaaaaaatcattagtaatgttatatgctaatgaggcaccagatcaagaaaaaagcagaa

SEQ ID NO: 65613 - DNA, 601 bp, Human
tgtacctatcgtatatggctatgacaaacattcagtcctaattttatgtggtagtggtgtttttttgagtaaaagctagtggttaatctgatagttcagcagtataatttttgcacctttattcagctttccagttaaactataagttaaaaaaattcttttgttaggttatcctgtgtttttgaatgttgttgaaaatgaggtaaatttaactaggttaccagatattatttcaggtaagaatttccagtaacataaggttattatataaactgtaatattatatctcctataaattatrttttaaagtccagaataagcaccattcccaggtagtttgagcacagcagatttcttatgatactgcgttcttgtaagcccatgtttctacgcagtgatagaagtaagattatacttctttagaccacatagacgaggtcatacttcgtaggtcagtcttgttacaaatagaagagtctagcatggaatcagagtagtttgcaaagttgagcctttgggtttctagaattggaggaggagaccttcagttatagaaggggttaattacaaattgtatacggatttgaagatctgtgacgtt

SEQ ID NO: 65614 - DNA, 601 bp, Human
tggtactgttcttggtaccagagactcaacactcaacactgaacaagctgaactcatcatcttcctgccaccaatcctgctcttctgagtttcttatcttgttgagtgttactaccaccattccagtttcccaggtcagaaatctgggaggcattcttgattcttctctttttattccctctccacatggagtcagtcatcaagcccatttcgtaccctttagtctgtccgttttctcttttcctcctaccagagtgttggttctgttaacacagcccagtaattctcagccgcagtatawtaatactagtaaagtaccaaagtttgcaaatggtttatcttaaaaagcaaacgaaaaaaacctaagggaataatcctgtcaacatcagtttcactgacttgcattccaccgaacttttgcaagaggaagagaaagctgtagcatgatagctagtatattaggaattaattacacatagtcctcaggtcacctatcggaatattttttgaatgtgaactttcagttttgcatgtctttcgtaaaagctgagagtctctgagttggaggaatacaatcacttttttttttctttttttgaga

SEQ ID NO: 65615 - DNA, 601 bp, Human
tttgagttgagaaccccagtgtactccttgccctcctaaaagcagattatttatttgaataggataaaaataattttgttttgtcttcactggtaccctcaattggagattacacagcgtatcacaaggccatgggggataatcatacatgaaaaatgcatttgtcagtcagaccctttactttttgagaattcccaattagagtctggagttggttctaaattgttgttgtcattgactagacaggggataaatattggcaaagtaaaaggagtgaatgtttagagccaaaaagattgaktatagatcttggttccatgacctactatttttgtttctttgggtgtaacaatttcttttgagtttcagtttcctcatctgtaaaatgagataataatacctacctgaaatgattgtgaaaataaacagtagtttctagaacagtagtacctaacaaagaataaggttttcataaatttcagctcttatctgattggtatcaatacaactctaggaataggtaaaagatcttcctgttaaactaaatgttgagttatttgtcttactgagtagttgttacactatctctgctttcccaagc

SEQ ID NO: 65616 - DNA, 601 bp, Human
acgctctgtcacccaggctggagtgcagtggcgtgttctcgcctcactgcaacctccgcctccccagttcaaatgattctcctgcctcagcctcccaagtagctgggattataggggcatgccaccacacacagctgatttttgtatttttagtagagacagggtttcaccatattggctaggctggtctcgaactcctgacctcaagtgatccgcctgcctcagcctcccacagtgctgggattacaggtgtgagtcactgcaaacaacctattgtttctctctcatctccaacatactygcagtgaaaaaatccagcctcattattcagcttttatgtttacagattcagttaacattttgtgaattctctatttcaaaggtacaaaggtaattttaaattatgatttaattaagaatgctctttccgaaatttttatacctgtttgactgtttatgtaaatcctgtaacatagctgatcatcctcagtaaaacagtaataccttacttgaagcagcaatttgtttttaaatatacacggaagtctatgttttgaatgtgaggattggaggtggagagagaatcgatatttagtgaaac

SEQ ID NO: 65617 - DNA, 601 bp, Human
gcttccaagaatttgctctaaaataaaaaaaaagaaatacaatgtcatttattaaacattatgcatgatagaaagacatatgatgtctctcttattcttcctggcaattctggactgcattatcatccccatttatagtgaggaaacaaatgttcaatgtttctcttaggccacatagccaggaaattagagagttagtagttttttttgtttttgtttttgttcttttgagatggagtttcgctctccaggctggattgcaatggcgtgtcccgtgatcttggctcactgcaacctccayctcctgggtttgagcaattcgcctgcctcagcctcacaagtagctggtattacaggcacccgccactatgcccagctaattttttttgtagttttagtagagatggggtttcaccatttggccaggctggtctcgaactcctgtcctcaagtgatccgcccacctcggcctcccaaagtgctgtgattacaagccagagccaccatgccagagttttgatttgaaccctaagccttcagaacttccatgacattgtgatgtttaattattaagccagttttattgcatgtttgtacttgt

SEQ ID NO: 65618 - DNA, 601 bp, Human
gtttttaataagttaaagggccataatttctttttcagtctttttaatggatctcattatttagacgttttatataaaatgacagcagatgaccaaagatacagtggatcaacttacctgtctgatcctcgtcttacagcgaatggtttcaagataaaattgataccaggtatgatagtgtggtttaatattttctgatgtggaaaaattagtcttgttccaagagttacatttgggtttcatgatttacagatatggtggtatatttttgtctcactataagtacagtgtcagctatgtgaaaacatttttttcaaaacatcacctctgcctgaaacaagtaagtttggcatctctttcagtccaatgctttgcatttgcattttcataactaatcaaatagttttattgtaatttttgtcatcctttgacacaatattcaaactgcctgctttgtttaaattattaaaatactcctttaaatgataaaacacaaacatgtaggatattggaattgcctaacaaaaatggacatctttgcttttcaaaaaacatttgcttgttttgccaattagacgtgtaacatcagcagttgtactat

SEQ ID NO: 65619 - DNA, 601 bp, Human
aagtgatcctcctgcctcggcctcccatgtagctgggactacaggcatgccccaccgtgcccacttttttttttttttttttttttgtggagactgggtctcactgtgttgcccaggctggtctcgaactcctggcctcaagcagttctcctgccttgtctcccaaagtgttgagattacaggcctgagccactgcacccagcctggttccttatttaaattcaagcttaaagtcatctcctcaagtaatctttttccaactctacaatcactctatcatgtggcccagtttaattttacrcattatttattgactaaaatgttctgtcttttgtctgttttctgtttctctgcactagaatgtaaattgcacaagagcaagtcttgttttttggttcaccactacatcccgagagctgacaacatagttgatacttaataaatatttgttgagtgaattcataaaatgaaaataatcaagattctgtcttcctttttgccaggataacatgttttcagcttcagggtatatcatggtaaaatgtgtgactttccctttggacagggagaagcagtgcgtctatccagacaattacccatg

SEQ ID NO: 65620 - DNA, 601 bp, Human; identical to SEQ ID NO: 34382

SEQ ID NO: 65621 - DNA, 601 bp, Human; identical to SEQ ID NO: 34383

SEQ ID NO: 65622 - DNA, 601 bp, Human; identical to SEQ ID NO: 34384

SEQ ID NO: 65623 - DNA, 601 bp, Human; identical to SEQ ID NO: 34385

SEQ ID NO: 65624 - DNA, 601 bp, Human; identical to SEQ ID NO: 34386

SEQ ID NO: 65625 - DNA, 601 bp, Human; identical to SEQ ID NO: 34387

SEQ ID NO: 65626 - DNA, 601 bp, Human; identical to SEQ ID NO: 24977

SEQ ID NO: 65627 - DNA, 601 bp, Human; identical to SEQ ID NO: 24978

SEQ ID NO: 65628 - DNA, 601 bp, Human; identical to SEQ ID NO: 24979

SEQ ID NO: 65629 - DNA, 601 bp, Human; identical to SEQ ID NO: 24980

SEQ ID NO: 65630 - DNA, 601 bp, Human; identical to SEQ ID NO: 24981

SEQ ID NO: 65631 - DNA, 601 bp, Human; identical to SEQ ID NO: 24982

SEQ ID NO: 65632 - DNA, 601 bp, Human; identical to SEQ ID NO: 24983

SEQ ID NO: 65633 - DNA, 601 bp, Human; identical to SEQ ID NO: 24984

SEQ ID NO: 65634 - DNA, 601 bp, Human; identical to SEQ ID NO: 24985

SEQ ID NO: 65635 - DNA, 601 bp, Human; identical to SEQ ID NO: 24986

SEQ ID NO: 65636 - DNA, 601 bp, Human; identical to SEQ ID NO: 24987

SEQ ID NO: 65637 - DNA, 601 bp, Human; identical to SEQ ID NO: 24988

SEQ ID NO: 65638 - DNA, 601 bp, Human; identical to SEQ ID NO: 24989

SEQ ID NO: 65639 - DNA, 601 bp, Human; identical to SEQ ID NO: 24990

SEQ ID NO: 65640 - DNA, 601 bp, Human; identical to SEQ ID NO: 24991

SEQ ID NO: 65641 - DNA, 601 bp, Human; identical to SEQ ID NO: 24992

SEQ ID NO: 65642 - DNA, 601 bp, Human; identical to SEQ ID NO: 24993

SEQ ID NO: 65643 - DNA, 601 bp, Human; identical to SEQ ID NO: 24994

SEQ ID NO: 65644 - DNA, 601 bp, Human; identical to SEQ ID NO: 24995

SEQ ID NO: 65645 - DNA, 601 bp, Human; identical to SEQ ID NO: 24996

SEQ ID NO: 65646 - DNA, 601 bp, Human; identical to SEQ ID NO: 35187

SEQ ID NO: 65647 - DNA, 601 bp, Human; identical to SEQ ID NO: 35188

SEQ ID NO: 65648 - DNA, 601 bp, Human; identical to SEQ ID NO: 35189

SEQ ID NO: 65649 - DNA, 601 bp, Human; identical to SEQ ID NO: 35190

SEQ ID NO: 65650 - DNA, 601 bp, Human; identical to SEQ ID NO: 35191

SEQ ID NO: 65651 - DNA, 601 bp, Human; identical to SEQ ID NO: 35192

SEQ ID NO: 65652 - DNA, 601 bp, Human
gaccttggagaagtagcccacgatgtggaagcccttacagtcatactctgtcatgacgtagaagaggaaagggtctgtgtcatagtacagtgtcttatggtcaaggaaacacttggccaaaagacacaggttctgggaataactctgcaagagaaaaggcttgtcaccactctgggtatcccgccttgagcctggccagtggttcagggtcaaccaggagcttcactgttcgtgctatgccccaggctgctaggtgatgagtgttcttccctggctgggcctgacccactccaccagcccrcagcttaggcagggctgctcctcagtgttgaaaagcctgtgtgccagatgtgtgatggtgtctgagtgcctccctgctcagtcaggcaagtttcccgccttgctccgcacacctccattctaagcctgaccaggagagaccactgccttttaatgttttttaacagcagccaacgaactaatgtgtccaaagtgagactctgaccacggctcctcaaactaatgtgtccaaagtgagactctgaccactgactccctatctaacagtcttgggagtctagctgttaaaaaacctaacatt

SEQ ID NO: 65653 - DNA, 601 bp, Human
gagtaagaggctgggaagaaggggcctcagggttggggagggcactgaagagcccatgtgtgatgaagttcagagtcccttctggctttaagagactgacctcactggacacaaggagcgagggacaacatgcttacgtctatctgctgacagcattttggatacctgcctgcaaggctcaggggacaactggggacattagccactggtccttgccccagtactcgtatcatggcacacgttaccagatacatcagcaccagcggctcactaaccttctgcccatggctccaggcaggakcacgtaagtcagatttggggaaagctgagtggcacttagaaccctggccaaggagcaaactggggggctgagaacctaccccagataagcagggcagtcagcctgaacggagagaaccccgggagagtgccactgttatttctggctggctcccctagaggctgggctgcacagccagggttgagaatcacagtagcctggcccatctgcctgtgaggcaccgatagtgggtccactaccccctggccgcagcacacatactcactgaactcgatcagcagcttgccgtagccccggcgc

SEQ ID NO: 65654 - DNA, 601 bp, Human
agggaggaagagaccgggacccagggtgactgctgccggggaagtcttcctcccctggctggtggagagctgggggccattgtttggagcaggccggagggtggccaggctcaggccctagtcttggcctggccagttggaggagatcttagggtgaccactggccacttctggttcccttccaggaatgcacagatggctatgagtgggacccagacagccagcactgccggggtgtgtgtgcctgggggaccaaacacccccaggaacccggaaagggattgatagctgctttccaagrgacagccccacctccaagaactgccgtgggagcccagcagcccgttctatgcccagctctgctacacagaggccagctctggctctctggaggccagttgagctaggggtggcctcatcctctcccagaaacccaggaaaccttgtccctacccctcagaggagctggatcctgtacgccttctctgaaccactctcctgtcccagctctttgtctcatcacaacctgggagggtagcgtccccaggggtgggtaaggaggccccccatcttgggctgagctagggctagggccgtgggg

SEQ ID NO: 65655 - DNA, 601 bp, Human
ccccatctccagccttggccaaccctggggaggggtcctgagcaggcagacttagcttgttgagcagagtgggaaggctttgctggggccacacatctcagagaaggccgagctgggttcctgcctccgctccctccagggccagcccaggagactggctgtgcccagcaggcccctctctgcagatgtcaacgagtgtctgaccatccctgaggcctgcaagggggaaatgaagtgcatcaaccactacgggggctacttgtgcctgccccgctccgctgccgtcatcaacgacctacayggcgagggacccccgccaccagtgcctcccgctcaacaccccaacccctgcccaccaggctatgagcccgacgatcaggacagctgtgtgggtgagtggggactgctctggtgcctggcttccagtcctctcaccaggcgtcttaaactcagacctcatgttcctccccagctcaaaagggccactggtgatgtccacaccctcatccagacactcatgttgtttaggacctgccgcaggtggccccagcttgtgtgccactgctccagccagctccgggcccctcccctcggttgctgc

SEQ ID NO: 65656 - DNA, 601 bp, Human
gtggttttagaggttaggggtgcctttcctgatggctccaggctggtgaactcttacgcgtgctgttgagagaaccgaatacaagtgttggaactatctgtcatgttgggtggtgtgcgggatcccaggcaggggctgagtggtgtctctcgcagatgtggacgagtgtgcccaggccctgcacgactgtcgccccagccaggactgccataacttgcctggctcctatcagtgcacctgccctgatggttaccgcaagatcgggcccgagtgtgtgggtgagtccaggaagcagcttctstagtcccggctttgtgtccctggtctggcccttgccctagcacctgacccccattcaagccaggcttcacccccggcccctgccacctcaccctccgtcatcagacacagaggactgtagcggggagtgtttgggaggtgtcctggctgaccctgcctaattcagctcctcggacacaggattatgggtggtgaagccttgagtcccagccggctcgagcccacctgccctctgccctctgccctccgccctccttctcctgcctctatccctagacatagacgagtgccgctaccgcta

SEQ ID NO: 65657 - DNA, 601 bp, Human
aggctcctgggtcctgggcagggaggtgtgaggtgggggcgctcccttcttgaccagcccaggtagagtggaggctctgggctcctcctccgctttcatccctcctgtttttcctggcacccccagatgtgaacgagtgtgacatgggggccccatgcgagcagcgctgcttcaactcctatgggaccttcctgtgtcgctgccaccagggctatgagctgcatcgggatggcttctcctgcagtggtgagagctccatccctgctgtgtactcctctgtggacccccaggccctagctaygccgtgcctcctgccacacagttctccatttgaggcctccgcctcctgtcactgtgcacccagctgcctcctgggtactcgaccccggctggctgtggagcactcccaggctagtgggggaggcacaaggagaggcagctacgtccttactgaagcctactggtgagactgaggatgtgggtgccacctgtcccacatatcaggctcacctgcatttacctgcatttgaattttgcactaggacaagtcactcctctctgagcctgtttcttcttctataaaatgggttgtcttgaggat

SEQ ID NO: 65658 - DNA, 601 bp, Human
cgctgccaccagggctatgagctgcatcgggatggcttctcctgcagtggtgagagctccatccctgctgtgtactcctctgtggacccccaggccctagctatgccgtgcctcctgccacacagttctccatttgaggcctccgcctcctgtcactgtgcacccagctgcctcctgggtactcgaccccggctggctgtggagcactcccaggctagtgggggaggcacaaggagaggcagctacgtccttactgaagcctactggtgagactgaggatgtgggtgccacctgtcccacrtatcaggctcacctgcatttacctgcatttgaattttgcactaggacaagtcactcctctctgagcctgtttcttcttctataaaatgggttgtcttgaggattaggtgagagtgtgatagatgggctccagcaagtctcaagctgcagtgctttaaagtgaatgaactgccacttaatgagaacctgccctcgtagtgtattccctgacacacttggcctccttcctctcaagaatcctaggaggtatgattttctccttcctctacaaaatgaggacattcatatctccctccacgtt

SEQ ID NO: 65659 - DNA, 601 bp, Human
acaaaatgaggacattcatatctccctccacgtttgttgggaggattacataaaaataatcacaaagtcctgggtaaatggtgactttcatgattcagctaagagaggttaagtgacccgcccaagctcatacagccaggatgagatggggccagggctggatcccagacttcttacaccctgtaaactggcatgtaccccctatgttatgctttgctgcgggatgaggcctcactgctacctggcagcatgaggggaacaagagaaaggaaatgttctgcctgtgaagctcacagttagytggaggtgaccactgggtgctcaggttgactgtgggttgcaggaattgggcgttacagcacaagccagacccataagactcatctagtctaacacactcattttactgattgggaaaatgagattcccctagatcagctggtgggattcacacccaagcctctagattcccagtaacttatttagtgtttcttccagttctgggcagagagaagtctgtgagctgcggcagcctgggcaaactttctttgaaccctccatctcccggctgaacttgtggcttgtctcatccccctctgtc

SEQ ID NO: 65660 - DNA, 601 bp, Human
gctccgaggcccaaacctgtgtcaacttccatgggggctaccgctgcgtggacaccaaccgctgcgtggagccctacatccaggtctctgagaagtgagtcaattcgatgccaggcccccacagaaactacgtctcccagggggctttggggctgactggcatctattcagaccagcgagtgcccctgagggatgatgggaatcatagtccttcatgaaaaccagtcacaggggtagaagggtccttttgggattccctccctttgtagggtaggagaaattggggggacgggcaaggagytcatttgtgtcccccacctcggggtctctagccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattagggtaaggtttctgcaaccctcaactgacatgcacaatctaaaactgaactccaggacgccttaagggggaactc

SEQ ID NO: 65661 - DNA, 601 bp, Human
accccggtgcctacaatgcctttcagatccgtgctggaaactcgcagggggacttttacattagggtaaggtttctgcaaccctcaactgacatgcacaatctaaaactgaactccaggacgccttaagggggaactcggccaggctgctatgccccacccctcccccaaagccccgcccccggaggcggggtttctgcaggaagacgggggtactctaaatgcaattctaacggttaaatgcaattctaacgaagcactcggacacgggagtttgagtcctggtactggttttccatatcgatctcagtttcttcacccacaaaccaagggaatggcgtgtgcagggccctggggtcagaaagtccactccttgctagtggatctgttaggtgggagggggccaggggcggctcacagtgagctgctcacagtgactggcagccgcatgcatgggtctcagcaggagaaggggtttgtctagtaccagcccttctctttctttttgaaattgaatgctctgaagggagtctgctcactttgggtcaccaaaggtcccaccagtcccaagagccacatgtggccttgaatcgtcagttagc

SEQ ID NO: 65662 - DNA, 601 bp, Human
atggcgtgtgcagggccctggggtcagaaagtccactccttgctagtggatctgttaggtgggagggggccaggggcggctcacagtgagctgctcacagtgactggcagccgcatgcatgggtctcagcaggagaaggggtttgtctagtaccagcccttctctttctttttgaaattgaatgctctgaagggagtctgctcactttgggtcaccaaaggtcccaccagtcccaagagccacatgtggccttgaatcgtcagttagcctgggtcagacagagcaggctggagagggtgasaagagccccagcaggagatttctgagggcaggagcctgggtggggaggagagacatcgagggtgtcaaagagctgcatgagaggctggggtggcagcctggccagggctgttcctctgcctcacggccacggggcagggaggtgacgctggggcaggggcctagcacacaggctgacacaatatatatgtccccccacccactgccctgcagcaaatcaacaacgtcagcgccatgctggtcctcgcccggccggtgacgggcccccgggagtacgtgctggacctggagatggtcacca

SEQ ID NO: 65663 - DNA, 601 bp, Human
cctcctgccagttcagcctggggcgaggctgcctgtcccatcaccaagggcagggcgaagggctggggcctcactcacctcctgctccgagtctgtcccggacagcttcttgtccttgcttttcgttcccatcccaccgttcttccggccgccgctgcctggcttccggcccctttgggaaggtacagtccatctgcccggagtgctccctactccttggccacccccaagccctgtggccttggccttccccactgtatgccaggccctggccccacctgcgggcgcccttgtccccatacatgtggttgtcttccccgtccccctgcatgtcgggaacagatgccaccaggtccttcaagaagtcaaactgctgctccagctcgatgcactgcttcctggaagaggtgaggaggggctggcactcaagaggggcccagacacccaaacccgcagtgggtggcagcaaggggccccagatgtcaggctggagcccgggccgatctccgctcccgggcctgccctgctttactcaggtggctccctctgcctggaagcccagcctctcctctgccagtctgtggccttgctggtgtcccgg

SEQ ID NO: 65664 - DNA, 601 bp, Human; identical to SEQ ID NO: 33152

SEQ ID NO: 65665 - DNA, 601 bp, Human; identical to SEQ ID NO: 33153

SEQ ID NO: 65666 - DNA, 601 bp, Human
tgggtgggtgtgtgttagtgtgcgtgcttgcttgtgtgtggaagaaaccaacagggttcacgctggtgcccatttctggaaatgccaatcgcgcccgactgcgggagccaggatcaggtccccagggcgcccttgcagacagcaccctgagcgaaggagctcagaaggcagtccggcttcacccagacccccaatcccacagaagcgccgtcccccagcggcacagcaccccctccccggcgcggtggtagggcccgacgtgacgtcacccattgtttacaaatcaacccgagccggcagrattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctgctgcagcagtcagtggcgctgggcagctcggg

SEQ ID NO: 65667 - DNA, 601 bp, Human
gtaggaaagctgggtggaaacttacaaaagactcctgtctttgcccctggcacatttataccattctgtccctaagcagtgacataacaggccatgtctatccttatggttctgacttacttcagtctgttccctcatggaaggagctaatttcctccctctgaggaaagagtacccagagtttaagcccacttctgaagtgggaagggaaccttggacaagttgctctacctctgtggcttcagtttcctcatccgtacaacagggataatgaaataaaaggtgggccaggcccagtagyttacacctgtaatcctagtagcactttgggaggctaaagtggaggattgctggagcccagaagttcaagaccagccagggcaacatagtgagacctcacctctccaaaaataaatagataaatggccgggcacagtggctcatgcctgcaatcccagcactttgggaggccaagaagggctgatcacgaggtcaggagttcaagaccagcctgaccaacatggtgaaaccccatctctactaaaaatacaaaaattaactgggcatggtggtgcatgcccataatcccaggtactcagga

SEQ ID NO: 65668 - DNA, 601 bp, Human
caacatgcccagaaagggctgtgggggcctcagtccagtgttctccagcatgggaagggtaactatggaggctctaatacaaactgaggaaaaggagcccccaatagtgtagtgggcaccacctctgggcgctgagcatgaggggaaagtggccaggtgctgatgtcccctggcatgggagtagccctgaagtccccagttcccattcttagttgatgtacgatttatccaaggtcaaggggttatgagcaatccagggctttccatcctgaaataggctatgatttgatgtcactgcacygactgtgcatagcttcttgtaataagaatgactggttaagttcagactcaaccttagggcccatgcagaacaacccactcctaaaaaaggaaaattgggaaaaactaaagcctctctacataaagcaagttagcactctaaacacattataatccagtaaccgttcatctgtgtttttattttttatcttatttacttatttatttttgagacagagtcttgctctgtcacccaggctggagtgcaatggcgtgatctcggcccactgcaagctccacctcctgggttcaagtgattctc

SEQ ID NO: 65669 - DNA, 601 bp, Human
tatcttatttacttatttatttttgagacagagtcttgctctgtcacccaggctggagtgcaatggcgtgatctcggcccactgcaagctccacctcctgggttcaagtgattctcccgcctcagtctcctgagtagctgggactacaggcacccgccatcacgcccagctaatttttgtatatttgtagaggcggagtttccccatgttacccaggctggtctggaactcctaacctcaggtgatccgcctgcctcggcctcccaaagtgctgggattttaggcgtgagccaccgcatcyggcctgtttttttttttttttttttttttaaatcctgccaagttttttctttttttttagacgaagtctcgctctgtcacccaggctggagtgcagtggcatgatctcggcttactgcaacctccacctcctggggtcacaccattctcctgcctcagcctctggaatagctgggactacaggtgcccgccaccatgcccggctaattttttgtatttttagtagagatggggtttcaccgcgttagccaggatggtctcgatctcctgacctcctgatccgcccgcctcggcctcccaa

SEQ ID NO: 65670 - DNA, 601 bp, Human
tttggattcaatttttacccgtttttgctctttttccagctcagatgcagaaagctggagcgaagatcagacaccactttcctatctagcaaagtctatgttgaaacctgtgatcccttccttccaatcaggaaagagttaccttggcaacgaaattactaactcactcaattagcccccacttctaccaatgctcagtaatcacagaccatcagcccccggagagctcagctttcagcagtctgatgctaccgcctcatttagagatggaagctcagagaggtttccactccgaggtgcrctccatttgaacactgtgaaagctggtgcaggcaaaggggcaaaactcttccgagtagtgtttcctcctggttttccatcataactgaagggagagcaattgacctgcccctaccagtgttacccaaaagacataataggtaagagtggggggtctgcaggcagccctccactgtcggctgtgtgatatgggacaggttcagtaagctcaatgaactcatttgcaaaatgtgggtaagggtagagcaccttgaagacttgtgtgaaaattaaattagaaccaaagagcaaatggtatggg

SEQ ID NO: 65671 - DNA, 601 bp, Human
gtttcctcctggttttccatcataactgaagggagagcaattgacctgcccctaccagtgttacccaaaagacataataggtaagagtggggggtctgcaggcagccctccactgtcggctgtgtgatatgggacaggttcagtaagctcaatgaactcatttgcaaaatgtgggtaagggtagagcaccttgaagacttgtgtgaaaattaaattagaaccaaagagcaaatggtatgggaaccaaagagcaaataataaacaaaacagaacactgttcctgagagacgttgcattaagsccacttctttgagtcttctgcagaaaaccctgcctcttactgacttcttcaatatttcttaacaggcacaaacctgtttcttctgaaggtcagaccagtttcctgatcatgcaccccagttgcataggtgggtgttaagggaagtgtagaagaagggaataagggcggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatac

SEQ ID NO: 65672 - DNA, 601 bp, Human
aaatgtgggtaagggtagagcaccttgaagacttgtgtgaaaattaaattagaaccaaagagcaaatggtatgggaaccaaagagcaaataataaacaaaacagaacactgttcctgagagacgttgcattaaggccacttctttgagtcttctgcagaaaaccctgcctcttactgacttcttcaatatttcttaacaggcacaaacctgtttcttctgaaggtcagaccagtttcctgatcatgcaccccagttgcataggtgggtgttaagggaagtgtagaagaagggaataagggyggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatacaaaaattagctgggcgtggtggtgcatgctacttgggaggctgaggcaggagaatcgcttgaactcaggaggcggaggttacagtgagctgagatcacgccactgcactccagcatgggcatctaaaaagagagagaaaaaaagggtggagccaagctaagcctgc

SEQ ID NO: 65673 - DNA, 601 bp, Human
tcagaccagtttcctgatcatgcaccccagttgcataggtgggtgttaagggaagtgtagaagaagggaataagggcggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatacaaaaattagctgggcgtggtggtgcatgctacttgggaggctgaggcaggagaatcgcttgaactcaggaggcggaggttacagtgagcygagatcacgccactgcactccagcatgggcatctaaaaagagagagaaaaaaagggtggagccaagctaagcctgcaaagcagctcagggttggaactggtggaatagagggagcaggaatatcacaaaggatagggttggcagttggcagtgaacacagcctggggccacagctcttaactcccccatttcctatcagaaaacctatccttttccaaaattcaaatactcaagttctacttgctgtcctgtccagtcctggctataatctgcactgagaaaaccatacaataggccggg

SEQ ID NO: 65674 - DNA, 601 bp, Human
aagggaagtgtagaagaagggaataagggcggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatacaaaaattagctgggcgtggtggtgcatgctacttgggaggctgaggcaggagaatcgcttgaactcaggaggcggaggttacagtgagctgagatcacgccactgcactccagcatgggcatctaaaaagagagagraaaaaagggtggagccaagctaagcctgcaaagcagctcagggttggaactggtggaatagagggagcaggaatatcacaaaggatagggttggcagttggcagtgaacacagcctggggccacagctcttaactcccccatttcctatcagaaaacctatccttttccaaaattcaaatactcaagttctacttgctgtcctgtccagtcctggctataatctgcactgagaaaaccatacaataggccgggtgcggtggctcacacctgtaatcccaacactttgggaggctgagacg

SEQ ID NO: 65675 - DNA, 601 bp, Human
tctaaaaagagagagaaaaaaagggtggagccaagctaagcctgcaaagcagctcagggttggaactggtggaatagagggagcaggaatatcacaaaggatagggttggcagttggcagtgaacacagcctggggccacagctcttaactcccccatttcctatcagaaaacctatccttttccaaaattcaaatactcaagttctacttgctgtcctgtccagtcctggctataatctgcactgagaaaaccatacaataggccgggtgcggtggctcacacctgtaatcccaacactytgggaggctgagacgggtggatcacctgaggtcaagagttcgagactagcctggccaacatggtgaaaccctgtctctactgaaaatacaaaaattagccaggcacggtggcatgcgcctgtagtcccagctactcggagggctgaggtaggagaatcgcttgaacccatgaggcagaggctgcagtgagctgagatggtgccattgcactccagcctgggtggcagagtgagactccatctccaaaaaaaaaaaaaaaaaaaaaaagagaaaaccatgcatgcaatttcttcacaggaa

SEQ ID NO: 65676 - DNA, 601 bp, Human
catgcgcctgtagtcccagctactcggagggctgaggtaggagaatcgcttgaacccatgaggcagaggctgcagtgagctgagatggtgccattgcactccagcctgggtggcagagtgagactccatctccaaaaaaaaaaaaaaaaaaaaaaagagaaaaccatgcatgcaatttcttcacaggaagtggcctttgagttcatttcattctcactctcacatttcatttactgtcattatagagttatctcagggactcatatgtgaatgaatgtgttctcttccccaatagattatrtattttgtgatggcagaggagtgacaagatgatgaggatgttttaggcagattgtcaggctgcatggcatggggagtggtctggagctgaggaaaacactgatggtcagccagatcagccgaatggtgttaaagctcccaggcacccaggcgattaagggagaggaaaacacaagagacacttccaaaagaaaaccggtaggcctcagttaactgtactgtgtagctgtaaaatcatggctctggagccagactgcctggctccttccttgaaagctccttcctgtgaccttgggcaggt

SEQ ID NO: 65677 - DNA, 601 bp, Human
gctccttcctgtgaccttgggcaggtaacttcacctctctaaccttacgttcagttgcaaagtcccatgataaaaaaaaaaaagtccccccctcagagggttgttgtgaggattaattgagctaatgctagtaaaaatgcttaggccactgcctgcctgcaacatagctgcatttagcaacagcaccagggtactggtatttagtaaatatttgcagagcaaacaatgggcaatttcaacagactggcagaggctaagggagtggggtgcttaggacgtagatgatgtgttgtggtgcctrcaagtctgaagatgggaaaagagtgactacagctaaaaagggaaaatggccaagggaaggattcactcagccaggggagaactgtgctcatctgggtgtggagagaggatacaaaagggtgaaattgccaggcacggtggctcacgcctgtaatcccagtactttgagaggctaaggcgggtggatcacttgaggtcaagagtttgagaccaacctggccaacatggtgaaaccgtctctactaaaaatacaaaaattagctgggcgtggtggcatacgcctgtagtcccagttactcag

SEQ ID NO: 65678 - DNA, 601 bp, Human
gaggatacaaaagggtgaaattgccaggcacggtggctcacgcctgtaatcccagtactttgagaggctaaggcgggtggatcacttgaggtcaagagtttgagaccaacctggccaacatggtgaaaccgtctctactaaaaatacaaaaattagctgggcgtggtggcatacgcctgtagtcccagttactcaggaggctaaggcatgagaatcacttgaacccgggaggctgaggttgcacgccactacactccagcctgggtgacagagcgatatgccgtctcaagaaaaaaaaaaaggggtgaaatcaaagggaagatgctataaaggtctaagttcctggaggagtgggacagtatggggtcctcagacagggcaggtttgaagggcagggcttagggggactgtggttgtggatgccccacatgacagctccctgtgtcactaactgtcctgccacagtgtggctgcaacctgacagattggttgctgaaaccatccttcatgcctgggatggctggacatgtttctgttgtttttgtgtgaatgaattatctgtagctgatgctataatggaatgaaaatgaaaactgatacc

SEQ ID NO: 65679 - DNA, 601 bp, Human
cctggccaacatggtgaaaccgtctctactaaaaatacaaaaattagctgggcgtggtggcatacgcctgtagtcccagttactcaggaggctaaggcatgagaatcacttgaacccgggaggctgaggttgcacgccactacactccagcctgggtgacagagcgatatgccgtctcaagaaaaaaaaaaaggggtgaaatcaaagggaagatgctataaaggtctaagttcctggaggagtgggacagtatggggtcctcagacagggcaggtttgaagggcagggcttagggggactstggttgtggatgccccacatgacagctccctgtgtcactaactgtcctgccacagtgtggctgcaacctgacagattggttgctgaaaccatccttcatgcctgggatggctggacatgtttctgttgtttttgtgtgaatgaattatctgtagctgatgctataatggaatgaaaatgaaaactgataccaaggagtttaagtgctccctcttatcaactgttaactgactcatagcaagtaaaatcacaacccccaactgataggctgcccaggcagtttgtttgacttattgatttg

SEQ ID NO: 65680 - DNA, 601 bp, Human
ttgagaattaacttcaggattcaaagacagtgaaagtcattgaataagatctgattccatatgccccggacctctgtggcctgactacagaggatatacatagggataatagatacagctgtgtttgtgttatgtgcacatgtggacccactactgttcaccctacagtctcccttggcttctcctgggtctacttttattttctgtctgttccttttgtgtagtcttcttcctcccagagatttgatgagttgggtatttgtaaagtgcttagaaggccgggcacacacaggctgggtgyggtggctcacgcctataatcccagcactttggaaggccgaggcgggtggatcacttgaggtcaaaagttcgagaccagcctggacaacatggcaaaacccgtctataccaaaaaaatacaaaaaaaaaattagccagatgtggtggtgcccgcctgtagctacagctccttgggaggctgaggcagaagaatcacttgaacctgggaggcagaagttgtagtgagtcgagatcacgccactgcactccagcctgggcaacagtgtgagactgtctcaaaaaaaaaaagaaaaaagaaaga

SEQ ID NO: 65681 - DNA, 601 bp, Human
cccaggcccaggccctccacaggctttgcaaatggctggatcagtagcaagagttggggtgagaagagcgtactgtgtgtaggctcagacaggtgacaagggtgtgtgagaagagcattgtgtgtaggctcagacagggggcaagaggaccaacttaagtgccctgagttctgattctgctctaccaccaataattcctttcaccattgtaaaaagcaaagtagggccaggcacggtggctcacacctgtaatcccagcactttgggaggccaagacaggtggatcacttgaggttagcartttgagaccagccagggcaacacggtgaaacctcatctctgctaaaaatacaaaagttagctgggagtggtggcgggcacctgtaatcccagctacttgggaggctgaggcaggagaattgcttgaacccaggaggtggaggctgcagtgagccaagatcatgccactgcactccagcctggggacagagcaagaccacgtcttaaaaaaaaaaaaatgccaggtgccgtggctcatgcctgtaattccagcactttgggaggtcaaggtaggcggatcacaaggtcagatcgagaccat

SEQ ID NO: 65682 - DNA, 601 bp, Human
cggtgaaacctcatctctgctaaaaatacaaaagttagctgggagtggtggcgggcacctgtaatcccagctacttgggaggctgaggcaggagaattgcttgaacccaggaggtggaggctgcagtgagccaagatcatgccactgcactccagcctggggacagagcaagaccacgtcttaaaaaaaaaaaaatgccaggtgccgtggctcatgcctgtaattccagcactttgggaggtcaaggtaggcggatcacaaggtcagatcgagaccatcctggccaacatggtaaaacccygtctctactaaatatacaaaaattagctgggtgtggtggcatgctcctgtagtcccagttactcgggaggctgaggcaggagaatcacttgaacccaggagagggaggctgcagtgagctgagatcacaccactgcactctagccaggcgacagagcgagattccatctcaaaaaaaaaaaaatcttgtaaaaggtgccaaccagggtgcctgccctaacagggatcagctccatctctacctaggaagtagagaaacactcagatcttgtaggtcttttcccattgtctgtagtcctta

SEQ ID NO: 65683 - DNA, 601 bp, Human
aaaaaaaaaaaatgccaggtgccgtggctcatgcctgtaattccagcactttgggaggtcaaggtaggcggatcacaaggtcagatcgagaccatcctggccaacatggtaaaaccccgtctctactaaatatacaaaaattagctgggtgtggtggcatgctcctgtagtcccagttactcgggaggctgaggcaggagaatcacttgaacccaggagagggaggctgcagtgagctgagatcacaccactgcactctagccaggcgacagagcgagattccatctcaaaaaaaaaaaaatcttgtaaaaggtgccaaccagggtgcctgccctaacagggatcagctccatctctacctaggaagtagagaaacactcagatcttgtaggtcttttcccattgtctgtagtccttatctataagatggaaaaatagtgcctacctcgtggcacataaagccatgtggtagtaccaagaatgagcagctatcactttttgagcaatgaagtctccccttcaagtcctcatttaacccttccaactcccctattaagtactattgttttacaaatcacaagggaaaaactcagagtcttga

SEQ ID NO: 65684 - DNA, 601 bp, Human
accaagaatgagcagctatcactttttgagcaatgaagtctccccttcaagtcctcatttaacccttccaactcccctattaagtactattgttttacaaatcacaagggaaaaactcagagtcttgacttgcccaccatgacacagctggtgagcagaaagggctgaggcaactgagcatcagccttcctctgcagccccagcctcgggagtgtgctgagcaggagaggttccccgggggctgggttagtagagctgggcaaggaaggggcaaggcaggggccaggtgtggtggctcacrcctttaatcccagcactttgggaggccgaggagggcagatcacttgagctcgagttcaagaccagcctgggcaacacagtgagaacccatctctactaaaaatataaaaaattagcctggcatggtggtatgagcctgtagtcccagctactcaggaggttgaggtgagaggactgtttgagcccaggaggttgaggctgcagtgagccaagatcgtgccactgcactccaacctgggttacagagtaagacaccatctcaaaataataaaattaaattaaaaagagaaaagggcaaggc

SEQ ID NO: 65685 - DNA, 601 bp, Human
taaaaatataaaaaattagcctggcatggtggtatgagcctgtagtcccagctactcaggaggttgaggtgagaggactgtttgagcccaggaggttgaggctgcagtgagccaagatcgtgccactgcactccaacctgggttacagagtaagacaccatctcaaaataataaaattaaattaaaaagagaaaagggcaaggcaggaactaggaagggattcagcaagggctctatgcctgggaagacagggcagagagagaatgaggagaggaggagggctacttcggtcaaatctaasccctgagtgctcaaaccaagccattttacaactaccaaatacactgctgtaaaaccctgtttttctctcccaaggccatagctcaagactaggtcagtctcaaaggggaaagcaggctggcttcgcctgtgccctccccattttgcacaaaaacgtccagatgaaaacccacctccctccaccacagcacctctttgctctccagcccagaaagcatttctagaatacattgtctttccacaaagggagtggaagcccatcttgcagcttctaaaaacctggactcaattttctgatctt

SEQ ID NO: 65686 - DNA, 601 bp, Human
agggtcatttgagcagcaagagaacagggtgggggctctgtggctccagggaccatactggaccagcaggagggtccagggtgtaggtggcatcaatttgggaagggacatttatcaaaatccagctgcctttctcaggagtaatttttaagtgggggactctcagcgttgtaacatatttttgaaataataaatgaaaatcacttgtattttgttcctatttaatgcgattaatttctgtaaaatcctaaatagtgtcttctaaatggcaagccgctgtgccagtagctttttatatcartggggttttaattcccaccttcctgcttgcatcaagaattccttctcagttgtgatgggggactttgtcaagcattagaaagggacgaggtggtctctcctcttgatgcctccagtcggcaggagcccaggaagaggagggtttgagaacagggtcattacaaatcaattgcgggggctctgcacagtcagaagcagtgagaaatttgagggccggagggtttggtttttgtatttacacattctgaaccttctattttttgttaggtgggtgtatgtgtgtgtctgttttatacagcat

SEQ ID NO: 65687 - DNA, 601 bp, Human
agatacctcttttccaggtttttttggccacactctctggatgaatattgcctttcagttcagaccactctaggaagaggagatagttttggtttaaatgagagagtgtaggatgactttttcataagctttagaaaaaataaattaagtgttcttttataaaggaaggtagcacattccttctgttttatgcatctttaccatggaaaccaaagaaacagctaccagtcacattcatcccttcatcatttccacccctcacttacctccaaccctggctaccctcccacccccacccccyatacacacacatagacacctaggagagggaaagggacagactgcctctaggggactggaaagaagggaaggcaaaggcctgggcctttcctcttacatcatttcctggattaacatttttcaaggcccacagacagtgctgttatgttctggagacacccaatctgaaaacattgactgagatattaagttatttccgaaggatcaaataggaaaacaattggaaaggagtgaaaagatactgaaaaccacagcgctctccatagatgtaagggattatcaaccttttccttatttattt

SEQ ID NO: 65688 - DNA, 601 bp, Human
gaatattgcctttcagttcagaccactctaggaagaggagatagttttggtttaaatgagagagtgtaggatgactttttcataagctttagaaaaaataaattaagtgttcttttataaaggaaggtagcacattccttctgttttatgcatctttaccatggaaaccaaagaaacagctaccagtcacattcatcccttcatcatttccacccctcacttacctccaaccctggctaccctcccacccccaccccctatacacacacatagacacctaggagagggaaagggacagacygcctctaggggactggaaagaagggaaggcaaaggcctgggcctttcctcttacatcatttcctggattaacatttttcaaggcccacagacagtgctgttatgttctggagacacccaatctgaaaacattgactgagatattaagttatttccgaaggatcaaataggaaaacaattggaaaggagtgaaaagatactgaaaaccacagcgctctccatagatgtaagggattatcaaccttttccttatttattttctttctttctttttttttttgagacagagtctcactctgtc

SEQ ID NO: 65689 - DNA, 601 bp, Human
tgcctttcagttcagaccactctaggaagaggagatagttttggtttaaatgagagagtgtaggatgactttttcataagctttagaaaaaataaattaagtgttcttttataaaggaaggtagcacattccttctgttttatgcatctttaccatggaaaccaaagaaacagctaccagtcacattcatcccttcatcatttccacccctcacttacctccaaccctggctaccctcccacccccaccccctatacacacacatagacacctaggagagggaaagggacagactgcctcyaggggactggaaagaagggaaggcaaaggcctgggcctttcctcttacatcatttcctggattaacatttttcaaggcccacagacagtgctgttatgttctggagacacccaatctgaaaacattgactgagatattaagttatttccgaaggatcaaataggaaaacaattggaaaggagtgaaaagatactgaaaaccacagcgctctccatagatgtaagggattatcaaccttttccttatttattttctttctttctttttttttttgagacagagtctcactctgtcacccag

SEQ ID NO: 65690 - DNA, 601 bp, Human
gccaacaactttggccaagaaagataatccatgcatagagtaaatattggactaacttctctccacccttcctgtgccttcaactattcctatgtgcaccttaaaattagtgtttcccaattcatgccatcgccatttattagatcatctgtttggactttggtgcggttaaaagataaatgtggttaactcagttatatgtctctttgagatagttatctttgtcttttatcacttttctgttgatgcatgtggctctgtggtttgctgaggggataattaggcttacctctaacatggcacttttagggaattagagtctgggaaaggcatcaatgatgtcaatctcagtcctaggagatttctgtttatttcaaaatctatcactaaatagtaatgggcactcattagtctttgtgtttggaagtcttaggaaaatgcagaaactaaaggtaaataaacataaatataacactagttcaactgttctattagcccctaggtgatttgttcatatgacacttggaacagcttatatgcccagcacctgacagtgatcctggcacagattaggtgttcaatattcattgaataaatgaat

SEQ ID NO: 65691 - DNA, 601 bp, Human
tctgtagttaataagatgtttatttcatagaggcaatgacacttcatgccatgtagccaacacagctagattaggtaactagtaatgtattactgcttcatttgtaaaatattctggcagctgtctactgctagtatctcaagataataataatgaattctattgagaagcattccccagcacttttattaaaaaagagtaagtggcataaattggcaaatacatgttaccctcactatcacacgcatttctttctttatggtaacataaggtgaataattggaaaataaattttatttgytctcagactcaacctgtatgggtaatagtttttattgcctagccttacggctatgtcagtattcagcaaacgtgaacagaataatttgtttccactagctgcaatacttgaaccaagttgtaatattaatatgatttgtagataataaaaaagaaagtagaacaccagtgcatttttcacataaaaatttgacccagttcaaggtcgacgcttaaggatgttgtcaaccgatcaatgaggagtgcctagaaatcatgggattgtaaaaggtatgttccttggtgtttggaagaaaaatta

SEQ ID NO: 65692 - DNA, 601 bp, Human
cattccccagcacttttattaaaaaagagtaagtggcataaattggcaaatacatgttaccctcactatcacacgcatttctttctttatggtaacataaggtgaataattggaaaataaattttatttgttctcagactcaacctgtatgggtaatagtttttattgcctagccttacggctatgtcagtattcagcaaacgtgaacagaataatttgtttccactagctgcaatacttgaaccaagttgtaatattaatatgatttgtagataataaaaaagaaagtagaacaccagtrcatttttcacataaaaatttgacccagttcaaggtcgacgcttaaggatgttgtcaaccgatcaatgaggagtgcctagaaatcatgggattgtaaaaggtatgttccttggtgtttggaagaaaaattagggagcgttgtctccttctaacacataggtaagggaagtccaagtttttcagcaatcctgggctagtgtttcagcgataggtactaggaaggttcatattcccattctcaggagatgattgcataaaaagatggagcacacacacacacacacacacacactcatgctga

SEQ ID NO: 65693 - DNA, 601 bp, Human
tgtagataataaaaaagaaagtagaacaccagtgcatttttcacataaaaatttgacccagttcaaggtcgacgcttaaggatgttgtcaaccgatcaatgaggagtgcctagaaatcatgggattgtaaaaggtatgttccttggtgtttggaagaaaaattagggagcgttgtctccttctaacacataggtaagggaagtccaagtttttcagcaatcctgggctagtgtttcagcgataggtactaggaaggttcatattcccattctcaggagatgattgcataaaaagatggagaacacacacacacacacacacacactcatgctgaggagagcagcattggctgggtgtatttcaggggatgaaattgaagtcttttactggagaggagctgcattatttaaataaaaagaatcatggtgactgcatagaagttgaatcacagaatttgtgtcttcacagtgggatacaaaattctgtctaaaggatgtgttgtctctgcacagttagtcacatttagggaatggaaaaatctgggtcatcaaaaatacccagtttcttccattttcttctcagtgttgaggctgtgactcaa

SEQ ID NO: 65694 - DNA, 601 bp, Human
cagacagaggctcagggatattgggatgatatttggtatgaagggtttcttatttggactgcaccaagttaactgtgtgctgtgaaacattatatggcttcattttcattgggagaactagtgatataaatgatgtaacgtgaactaagtgatttagctaattacacatatttttggatgcttctaaaaaactaatatgtgatccttggagtagaggaagttgtacattcaaggttttctaccctttttgtgtgtgtttattttaatgaggacaatgggaactacaccatttctttcctgytagttcatcctggattacctttttatatccattaaacatagaaattctgaagccatgtctgcctacatgtcatcctgattgcctttgtgtataattgcagatcaaatgtagaagcagtgactacttaaaaaaaaagttgttatagaccaaggcttgaggaaagagaaaggtacagtgacaatgagatatcttgggggaaatttggtcccgtagaccaggggttagcaaatcatatcctgtgggccaaaccacagtcacctgcctgttttggtaggcctataagctaggaatggtttttac

SEQ ID NO: 65695 - DNA, 601 bp, Human
aatagtaagacatatctgaatttttgttctagaaggtcccagagctctcctttaccattctacctcagagagcccttttccttctgcatgttatcttgggactgtccagggctctatgcctgcagggcctagagccagtccatgaagtgctcattgagtgctttgtggtctaatgttctacccttcctgcaagcttacaaatcaaccccttcaagactgataaagacagagcagaggttctttagtatctagagtccccagaagtcaggaaggttgtgaacttggatgggtaaaaaaaatwtctgttttgagatgaagtcttgctctgtctcccaggctggagtgcagtggcacgatctcggctcactgcaacctccacctcctgtgtccaagcgattctcctgcctcagctctctgagtagctgggattacaggcacgtgccaccacacccggctaattttttatatttttggtagagatgggttttcaccatgttggccaggctggtcttgaactcctggcctcaggtgatcctcctgcctaggcctcccaaagtgctgggattacagatatgagccactgctcccagcagtaattttt

SEQ ID NO: 65696 - DNA, 601 bp, Human
agagcagaggttctttagtatctagagtccccagaagtcaggaaggttgtgaacttggatgggtaaaaaaaatttctgttttgagatgaagtcttgctctgtctcccaggctggagtgcagtggcacgatctcggctcactgcaacctccacctcctgtgtccaagcgattctcctgcctcagctctctgagtagctgggattacaggcacgtgccaccacacccggctaattttttatatttttggtagagatgggttttcaccatgttggccaggctggtcttgaactcctggcctcargtgatcctcctgcctaggcctcccaaagtgctgggattacagatatgagccactgctcccagcagtaattttttttttataacttgtaacagaaatttggcattttcttcaattatgaagacaggcaacaaaccacagcaatattagcaatacttgtgactatgtcaccagtagaaaccacagatactttaatatcagattatatcgttgcagatattgcaaaatatctgtgctttttataactagaaaattaagatctataaaaagatctataaaagagttataaaaatacttcaaaat

SEQ ID NO: 65697 - DNA, 601 bp, Human
tataaaacaaggaatgtgtatgtagttatgaaatcattctcttggtttataccatatcaactagatatttgtcagtgaaaaattgaaaatctacctcttcaccctctttgaattgtagtttgcattaaaaagattcgcatatttgaattttcaaaacttggtatgtgtgtattttgtaagtttggaattggataaaaattacaaatattataataagttaatgacataatcccttttgtattcttctgtgtcttgagtggttttgttgctgtaagtcaagcacatttattattcatgtatagggggccaagtttcatctgagaatgtaatttcatgctaataggttgcgttgtaagtccctggttaggatttacttatacctgcatgggttttatgcttccctgtgttccattcattacgctgctattctgaatgcatctcctaatttagtgagatctgagagccaccttagagattacgtagtccagtttttctccaccctgctaagcttcacaaaatattgatgcctggacctcactcctagtgaatatgattgaatggatctgtgttggggaatggaggcagtcttcaaaaactggct

SEQ ID NO: 65698 - DNA, 601 bp, Human
atattataataagttaatgacataatcccttttgtattcttctgtgtcttgagtggttttgttgctgtaagtcaagcacatttattattcatgtatggggggccaagtttcatctgagaatgtaatttcatgctaataggttgcgttgtaagtccctggttaggatttacttatacctgcatgggttttatgcttccctgtgttccattcattacgctgctattctgaatgcatctcctaatttagtgagatctgagagccaccttagagattacgtagtccagtttttctccaccctgcyaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttttttttttttttttttttaatgtaaagccatttcccagccagtgcagtctt

SEQ ID NO: 65699 - DNA, 601 bp, Human
gacataatcccttttgtattcttctgtgtcttgagtggttttgttgctgtaagtcaagcacatttattattcatgtatggggggccaagtttcatctgagaatgtaatttcatgctaataggttgcgttgtaagtccctggttaggatttacttatacctgcatgggttttatgcttccctgtgttccattcattacgctgctattctgaatgcatctcctaatttagtgagatctgagagccaccttagagattacgtagtccagtttttctccaccctgctaagcttcacaaaatattratgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttttttttttttttttttttaatgtaaagccatttcccagccagtgcagtcttctgtggtcactacattcc

SEQ ID NO: 65700 - DNA, 601 bp, Human
atttagtgagatctgagagccaccttagagattacgtagtccagtttttctccaccctgctaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccasatttcttttttttttttttttttttttaatgtaaagccatttcccagccagtgcagtcttctgtggtcactacattcctcatggaatatttaaaattaaatattccatgaggaatgtagctggaacgtttaaaagcttactatccttgtcctgttttaccgttacctaatgggaagacagctttctggaaaaacctgaagaccattctttcttagtgagctgttcttgacggtggtgactttatctttggaaatttgcccgattcccatatcacaattaaggaagtggcttaagaaagta

SEQ ID NO: 65701 - DNA, 601 bp, Human
atctgagagccaccttagagattacgtagtccagtttttctccaccctgctaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttytttttttttttttttttaatgtaaagccatttcccagccagtgcagtcttctgtggtcactacattcctcatggaatatttaaaattaaatattccatgaggaatgtagctggaacgtttaaaagcttactatccttgtcctgttttaccgttacctaatgggaagacagctttctggaaaaacctgaagaccattctttcttagtgagctgttcttgacggtggtgactttatctttggaaatttgcccgattcccatatcacaattaaggaagtggcttaagaaagtagcttgtaatt

SEQ ID NO: 65702 - DNA, 601 bp, Human
gtggcttaagaaagtagcttgtaattctctagagtgtaagtctccagatctcactgttgaactttgtatgttccagtaggactaaatctaaaataatttccttgtcacatttgatagacatgagtattagggacccacattggaagaaccctccaaaaacggacctgtctttcctttgtgagttttcagtgtaattctagcatttctgggagaaatatgtaagtacctcaagggcagaaatcctgcccacttaaatgtttcataattatcacctaaaacttagaatggatcaaattaactcattagctttgtaccttttcaacacaagctaatagattgcctgacttcgtttatctgatcatgaattttgatcaactttatctcattaggtttaaaaattaatatgttgcgttatatagcacttatctttacagagattattcatcttcaatgcaataaataaaagaaaagccaagccaggtgtgatggcacatgcctgtagacacagctacttggcaggctgaggtgggaggatcacttgagcccagcggttccaggcctgcagtaagcccagattgtgccactgtactccagtctggat

SEQ ID NO: 65703 - DNA, 601 bp, Human
ggcttaagaaagtagcttgtaattctctagagtgtaagtctccagatctcactgttgaactttgtatgttccagtaggactaaatctaaaataatttccttgtcacatttgatagacatgagtattagggacccacattggaagaaccctccaaaaacggacctgtctttcctttgtgagttttcagtgtaattctagcatttctgggagaaatatgtaagtacctcaagggcagaaatcctgcccacttaaatgtttcataattatcacctaaaacttagaatggatcaaattaactaaatagctttgtaccttttcaacacaagctaatagattgcctgacttcgtttatctgatcatgaattttgatcaactttatctcattaggtttaaaaattaatatgttgcgttatatagcacttatctttacagagattattcatcttcaatgcaataaataaaagaaaagccaagccaggtgtgatggcacatgcctgtagacacagctacttggcaggctgaggtgggaggatcacttgagcccagcggttccaggcctgcagtaagcccagattgtgccactgtactccagtctggatga

SEQ ID NO: 65704 - DNA, 601 bp, Human
gatctttttctagttgttacaactcacagtaagggaagcgggtgttgctgctattatcctacaatgcacaggaccacaggacagccctccaacacaaagaattctcaggttcaagacatcaatagtgccaaggttgagaaaccctgctgtacatagcgttggatcgtgtgaatataccaccatttatttctctgtgtatttcttagagcctcaacttgagcattcatgagcataatgcagctcagccctggctttgaagttcttgaaaccatgcttaccaccatcagaataaaaagactaycaaacaggaggagttttaaatgtttacaataactgttagagtcaaaatacactgtcatgtatagccttggtcatagacaaaaattgtacattttggaactactacaagaatttgaagaggttttaagtgagaaagtgaaatgggctaagtcaaggttttcatcaaagaatgaaaagacttttcttagaaacagctttattgagaaataatttatatactataaaattcacccattttaactgtacagtttaaagattcctagaaaatttacagagttgtacaaccatgatcacactctaa

SEQ ID NO: 65705 - DNA, 601 bp, Human
gaggatttcctggcactatataaaaccccttccatcaatgggagttgttctcccttcttgaattggagtgttcattaagtccataaaatggaaagcacatgtaggataataacacagatattttgtgttagagaaaagttatgaagcatggcatcgaaagaggttagaaaaaaaaaattcactaaaaacaatcatgaaatggtaaagaaaattcccatcctcaacccatctgcatcaaatgaagatgctgctgacagtagatattaaaagagatgttgaacacataaggtccaggtggccrcaatgctttccttttatcccttcctacatagatagatggaagggactcggcacaataaaaagaaggagcatgtagaaaaacatgggcgatttgagaccttccaaggcagagcaggccagtaaaggtgaagcagctggaagccttttttctccaccaggaaaggaggatagagagcaagggaggttttaagtgggagatgctgcgcgtgctttccccataaattctgagggcagtgcacagtattccaagttgtgtagcttctcacatgcaagctaggcccagaaccacttgagttcacaa

SEQ ID NO: 65706 - DNA, 601 bp, Human
agaaaattcccatcctcaacccatctgcatcaaatgaagatgctgctgacagtagatattaaaagagatgttgaacacataaggtccaggtggccacaatgctttccttttatcccttcctacatagatagatggaagggactcggcacaataaaaagaaggagcatgtagaaaaacatgggcgatttgagaccttccaaggcagagcaggccagtaaaggtgaagcagctggaagccttttttctccaccaggaaaggaggatagagagcaagggaggttttaagtgggagatgctgcgygtgctttccccataaattctgagggcagtgcacagtattccaagttgtgtagcttctcacatgcaagctaggcccagaaccacttgagttcacaactatttctttctttttctttttcttttttttctttttttcttttcctttttcttttttcttttttttttttttgagacagagtcttggtttgtcccctaggcactggagtgcagtggcatgatctcagcttaccaccatctccctctcccgggttcaagcaattctcctgcctcagcctcctgagtagctgggactgcaggtgtg

SEQ ID NO: 65707 - DNA, 601 bp, Human
ctgcgcgtgctttccccataaattctgagggcagtgcacagtattccaagttgtgtagcttctcacatgcaagctaggcccagaaccacttgagttcacaactatttctttctttttctttttcttttttttctttttttcttttcctttttcttttttcttttttttttttttgagacagagtcttggtttgtcccctaggcactggagtgcagtggcatgatctcagcttaccaccatctccctctcccgggttcaagcaattctcctgcctcagcctcctgagtagctgggactgcargtgtgcaccacctcacccagtgaatttttgtatttttagtagagacggggtttcaccatgttcgccaggctggtcttgaactcctgacctcaggtgatccacccacctcaggtgatccgcccacctcagcctcccaaagtgttaggattacaggcgtgagccaccgtgcctggcccacagctatttcttgaaaatgagttcaacaatgtggaccttctgtgtgtgcaagggaatatgccttatattcatcctctattctatcacctgacaagaacgaaacagagttcaatggtctaaatt

SEQ ID NO: 65708 - DNA, 601 bp, Human
cagtgaatttttgtatttttagtagagacggggtttcaccatgttcgccaggctggtcttgaactcctgacctcaggtgatccacccacctcaggtgatccgcccacctcagcctcccaaagtgttaggattacaggcgtgagccaccgtgcctggcccacagctatttcttgaaaatgagttcaacaatgtggaccttctgtgtgtgcaagggaatatgccttatattcatcctctattctatcacctgacaagaacgaaacagagttcaatggtctaaatttgcattcacgtgcagggytcctagaaatgatgatcctgcataattgttgtggaaatcatttgtcttctattggattcatgaaggcttaaacacatggtcaggggatcagactcactaatagctcttttatgtttcttccacttattgagataaaatctttttttttttttttgaaacaaggtttcactctgtcacccaggctggaatacagtggtgtgatgatggcttgctgcagcctcaacctcctaggttcaagtgatcctctggcctcagcctccagagtagttgggaccacaggtgcaaaccaccacacacact

SEQ ID NO: 65709 - DNA, 601 bp, Human
catttgtcttctattggattcatgaaggcttaaacacatggtcaggggatcagactcactaatagctcttttatgtttcttccacttattgagataaaatctttttttttttttttgaaacaaggtttcactctgtcacccaggctggaatacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcrctatgttgcccaagctggtcttgaactcctggcttcaagcgatcctcccaccttggcctcccaaaatgcttggattacagaagcgtgccaccacacctggcctcagatgaaatatcctgcatttactccatactagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcc

SEQ ID NO: 65710 - DNA, 601 bp, Human
ttttttttttttttgaaacaaggtttcactctgtcacccaggctggaatacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcgctatgttgcccaagctggtcttgaactcctggcttcaagcgatcctcccaccttggcctcccaaaatgcttggattacagaagcgtgccaccacacctggcstcagatgaaatatcctgcatttactccatactagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaag

SEQ ID NO: 65711 - DNA, 601 bp, Human
tgtcacccaggctggaatacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcgctatgttgcccaagctggtcttgaactcctggcttcaagcgatcctcccaccttggcctcccaaaatgcttggattacagaagcgtgccaccacacctggcctcagatgaaatatcctgcatttactccatastagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaagcagtgatggggtatgtgattaaaccatgtta

SEQ ID NO: 65712 - DNA, 601 bp, Human
tacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcgctatgttgcccaagctggtcttgaactcctggcttcaagcgatcctcccaccttggcctcccaaaatgcttggattacagaagcgtgccaccacacctggcctcagatgaaatatcctgcatttactccatactagagaaaaatagagaygtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaagcagtgatggggtatgtgattaaaccatgttagacaatatgattaggcc

SEQ ID NO: 65713 - DNA, 601 bp, Human
tgattaaaccatgttagacaatatgattaggccatgccattattctttcacagttgcaaaggtaagctatatttctcaggctgtcatccccacagctaatgctttgtgtaagtcttcagggagcagctcacatgtgctgatgacaagttcagttcacagtgtgacttgtccaacacaggatgtctgccgtgtctttgaacgctatagattatttgctttgctggtttttgtgttttaaatacgtggaaccgtacaatgtgtactcttctgtgtttgtaagatgcatccttagtgttgtgcrtagctgtcctttgttcattctcattgccgtgtggtattccattgtgtaaagacatcacaatttatttacccagactaccactgatgggcagttgggtgtctcaatatttatagcaactgtgtgaggtaggtgctattattccatccattttgctgacggggagattgaagctacgagtggctttagaattgattacctcaagtcacacaggtcatttcgtggttgagccagaccttgagccaaggtagcccaggctccctaccctcacccttttatgcctcaatgtctgactgagctatt

SEQ ID NO: 65714 - DNA, 601 bp, Human
catccttagtgttgtgcgtagctgtcctttgttcattctcattgccgtgtggtattccattgtgtaaagacatcacaatttatttacccagactaccactgatgggcagttgggtgtctcaatatttatagcaactgtgtgaggtaggtgctattattccatccattttgctgacggggagattgaagctacgagtggctttagaattgattacctcaagtcacacaggtcatttcgtggttgagccagaccttgagccaaggtagcccaggctccctaccctcacccttttatgcctcartgtctgactgagctatttagtgaagcacttctttgatctgtctctgtctttcttttctccctctaaaggactgcctctgaaggaaaaatccaggtcaccaggctacacagggactcatctctacccctgggactaaagcttggctctcagatccagttttctgagcttagggtagggctatccccagtgaccccattcattcacctgccatgtctgaatccatgggaaatcctttgtaggctcaagctgagccccccacttcaaaagcatatttaaaagccaaattaaccccagagagga

SEQ ID NO: 65715 - DNA, 601 bp, Human
gacgacacttactgttgtcccgtgatttaattgtttttaccaactaacaatttggaaccaaggcttttaaaccatcccttctgattaacgtcagagaagaggggcattcctttgaaaagaattcctaaacagaatttttataaatggagtacaaaatagcacgaggaacagtgagaaacatcttcaggattcccatggcctaggcatggaataaatgcaaggttagggcttattttctgagaaataaacccttagtaggatgctagataaaacacaggacatccagctaaatttgaacttyagacaaacaagaaatacttttttgatataagtatgtctcaaatattgcatggggcatcctatgtttttatttgttaaatctggtcattttaactaggtttgcaatatattttcagcacaatttcaacagttcatatttgctgagtactttgggcatgatggttagagtcagaggtgactttaggagctgcaggccttgtgtgtgtccctttcaccactatccccacagccccaagtacaatctttggcatatagttgagctcaataaatatattttgaaaaaattaatcaaaatgataaa

SEQ ID NO: 65716 - DNA, 601 bp, Human
ctgaaactcccatccatcgctggtaggagtatagattggtgtaatattctataatggacaatttagttatatctattgatatgacagatgttcatactgattgacctagtaatccacgtctagcaattaatcccacagatatattttcacatgcaaaaaattaagtataaggttattaattattgcaatgtttgtaataataaaagactggaaatcatccaagtattcatcaaaaaagagctagttaaatatatattcatacaccggaacattatgcaagggtaaaatgaatgagaaaacyctctgtactgatgtggaaagatttgccaagacagatctgaaaaaggtgtgtaatagtgtggaaaggaggattaagcaaataaatgcctattttaaaatttatgcataaaaaactgacagagcatgtaaggaacgaatagaaatgaccatctacttttagaagtgaggaggagggaggctagagagatgggggcggaggcagaagtggcagcatggcttctgcatacctgcttgtgtatatatcttttcagtttttgagccatgtggatgtgacttatgcaataattaaataattaagaag

SEQ ID NO: 65717 - DNA, 601 bp, Human
gcagggaaatgatgtgatggctgctttacaaccttgaggaaactcagaaggagtagggttcatgggggactgtgttcaggaacaggtccaaaaagttaggccaggccaagggggatatttacgcacagcaatggagggcagggtagctagaaggaaagcatagtcacaaagagaggcaaaggccagggctggagaatcagttcatagcatcaggagggtctaaggagtgaaatgcaacgatgtcttagtccatgcaggctgctatcacaaaataccataccctggtggcttataaaaaacgaagttatttcttgcaggtctggaggctgagaagtccaagagcaaggaacttacagattcagtgtctggtgagggctgccttcttgctataagctcacatggaggaaaaacggccaggtggctctgtggggcctcttcataagagcactaattccattcatcagggctcctccctcatgatctaattacctgccaaaggcccaacccaatcctatcacattaggcattatgtttttcacaagcgaatataaagggcaaagggaacaaaaaataattagaccatagcagcctgtacataaaa

SEQ ID NO: 65718 - DNA, 601 bp, Human
ttctcagcctttccttggttttgatgaccttgacagttttgaggagtacaggtcagacactttgtagaatgcccttcttggagtttgtgtggtgttttctggtgattagaataggcaaaaaacgaacatggttatggcaaataggaagatcaggcaggctcagggctccagtcaccctagtgtgcgtcctggccgattggcaactcctagcaactgtctcagagcaaggggcaacgaggggtcggggcttccaccctggcacctgggttcactcgatcctgcattgtacccactgcggaarggtgaagttccaactcagccagacacagacccctgacctggagggcaccaaggagggtgccaaggagaggtggctcacctgtgctctgggagtgaggagctgtcgtcagggtgtgtccaaggttgattacatagaattgtaccagctggagactggagccagaggaagagctgcctcaagcaatttcactaagaggcggcagtccaaggaaaataaggcagattccagagcatatgaggagaaccaagatggaaagcacagaacatatgattatgattccaagtgaaagatgcagccaaa

SEQ ID NO: 65719 - DNA, 601 bp, Human
ttctaaaaaataatcaaaaacaacaataaaacccctatgttatgaaattttaatttagtgacacttattcagttaagactttcctatctaccaataaccatagtattggaattgaaccttaaatgtccagtgggtggtgactgcatcaaagttgaatgaaacagccttcttgctgttcagctgtttagataacttatgaatattgttagggcagctttctctgagaggttgccatttgtcatatcaatttccaaaagctgttataccttcatggacatttattctccgaatgatatttaartgccaacacaaattaccacatgatcaagtgaaatggactatactttaaagattatcagtgtagagctcactgcatttcattatatattttaaagggattcattgccttaaatatttgctctcaagatgtcaaggttaacatatatatttttttgcagtcaaagtttccctctgttacccaggccggagtgcaatggtgcattcatggctcactgcagcctcctgggctcgaggggtccttttacctcagcctctccagttgctgggattataggcatgagttgccatccctggctaatag

SEQ ID NO: 65720 - DNA, 601 bp, Human
gcatcaaagttgaatgaaacagccttcttgctgttcagctgtttagataacttatgaatattgttagggcagctttctctgagaggttgccatttgtcatatcaatttccaaaagctgttataccttcatggacatttattctccgaatgatatttaagtgccaacacaaattaccacatgatcaagtgaaatggactatactttaaagattatcagtgtagagctcactgcatttcattatatattttaaagggattcattgccttaaatatttgctctcaagatgtcaaggttaacatrtatatttttttgcagtcaaagtttccctctgttacccaggccggagtgcaatggtgcattcatggctcactgcagcctcctgggctcgaggggtccttttacctcagcctctccagttgctgggattataggcatgagttgccatccctggctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctg

SEQ ID NO: 65721 - DNA, 601 bp, Human
cttgctgttcagctgtttagataacttatgaatattgttagggcagctttctctgagaggttgccatttgtcatatcaatttccaaaagctgttataccttcatggacatttattctccgaatgatatttaagtgccaacacaaattaccacatgatcaagtgaaatggactatactttaaagattatcagtgtagagctcactgcatttcattatatattttaaagggattcattgccttaaatatttgctctcaagatgtcaaggttaacatatatatttttttgcagtcaaagtttcmctctgttacccaggccggagtgcaatggtgcattcatggctcactgcagcctcctgggctcgaggggtccttttacctcagcctctccagttgctgggattataggcatgagttgccatccctggctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctgtaatcctagcactttgggaggctgag

SEQ ID NO: 65722 - DNA, 601 bp, Human
tgccatttgtcatatcaatttccaaaagctgttataccttcatggacatttattctccgaatgatatttaagtgccaacacaaattaccacatgatcaagtgaaatggactatactttaaagattatcagtgtagagctcactgcatttcattatatattttaaagggattcattgccttaaatatttgctctcaagatgtcaaggttaacatatatatttttttgcagtcaaagtttccctctgttacccaggccggagtgcaatggtgcattcatggctcactgcagcctcctgggctygaggggtccttttacctcagcctctccagttgctgggattataggcatgagttgccatccctggctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctgtaatcctagcactttgggaggctgaggcgggccaatcacgaggtcaagagagtgagaccatcctggccaacatggtgaaaccccacc

SEQ ID NO: 65723 - DNA, 601 bp, Human
gtaacttgttttacaggactcacttgtgtccacacatctgtgatccctttgaaccttaagaatcaaaccattgtctgggagcggtggctcacgcctgtaatcctagcactttgggaggctgaggcgggccaatcacgaggtcaagagagtgagaccatcctggccaacatggtgaaaccccacctctactaaaaatacaaaaattagctgggcgtggtggtgtgcgcctgtaatcccagatactcgggaggctgaggcgggagaatcacttgaacccgggacgcagaggtttcagtgagtygagatcatgccactaaaaaaaaaaaaaaaagaatcaaactattttggcctctccattttctggttgagaaattctttatattttaaatatatatttatttccaaatttaatattgaaaactagaatatagagaagagaaggaaaatagttacctaaaatgacctaaccttcaagatgattattatcactattagcatttttccatgattttcagacttttttctatatagccttatacatataaatacatatattttaacgagattaatgttaactcactctgtaagctgttttcttacc

SEQ ID NO: 65724 - DNA, 601 bp, Human
tgagttctaggagccactttggcagtcctctttctgtgccaccaatgggagtgaggggtgagcctggcagagacacacatgccaccctgggctttgtgacaaggcctggactctaatgggtcaaacccagggcaaaggccatcctccatctaggtaacgaagtgttcatgactctgtgacagccaggacaagggcagtaagtttgcagtagaatgacactgcaaattggtgaaccttagtgtagggtacgtcccagccgggctttaatacagagcagcaataatgacaacaacattgcgtttgtgtgtgtgtgtgtgtgtgtgtgtgtgtgtgtgtgtgtaaaactggtgcagtcctatccattgtctgattcgatcatgagtgccacatcctccccagacttgggttagagtagacccagatccccagaacccttttaaacctgggtgatttagaattcaaactaccatcacttctccagactagattaaatgccacctggactgatcagatccaacatcctaccatgagtctggtattttctttgctattttatctagataattcttatttaatcctttcagcaatcctaggaaaaaaa

SEQ ID NO: 65725 - DNA, 601 bp, Human
gcagttcaagtataattcaaaatatctgcttctatttgtttgccttttgcaaaacctcaagggtgattttgaaataaataggaataaaatatttgactgaaccaaaagagcccagtacctggccatccgaaagtatttatttatttgtttaaacattgctggagtaatagaaaatttaaatgcagttatcaaagaccaaaagttcagagattaaatactatgttagagtcattccttctaattaattttgaactgttttcgaaaaacgaagaacttgctggggagacaatgatcaagatcrtaacaaagttcccctagaagattaacagagcttggagtttactgtggatctctgcctgtgtggagaagaaacagtcaaactagaggaaacaaaactgtctctatagacaaattaaattttagtggatgttcatgtgcacaggtgggcagcagcaccttagtctagtatgttgggattgggatcagagtctttttccataaatgcagcagcattgagcaatataattccatctaaaatcttattgtatattttctcatctgcttacttttttttgtttgtttgtttgtttttgagacaaag

SEQ ID NO: 65726 - DNA, 601 bp, Human
acacagcctcgtttgcttacttttcaaaacagctctgtgtttgtgtgcgtgtacatggtaaaatttacaacgaaatacacatttagaatacattcagtgagttctaataaatgtatacacgtgagtgcctcaaacccttatcaagacataaagcattgccatcaccccagaagcaacggctgttctgaattagtgcattagttttctgtattttgggacttcatacaaatagaatcatatataatgtgtagtttttttggataaggcttctttgactcagcctaatgttttccattcattrtcatccatattccgtgtattaatagtccattccttttgattattgaatagtataaccattatataagtattctacactttgagttgggttattttctattttcctattgatggacacttggctgtttccagttttgagtcaaataaagttgctaagaacattctagtgcaagtctttttgtggacacattttatttctcttgaatagatatctatcaatggaattgctgagtcatggggaaggtaaatgtaaatgtcagggttttttttcccaggatgattgccccacttcatacctcca

SEQ ID NO: 65727 - DNA, 601 bp, Human
atcctcctgttaactgaataagaaaggacttccctggggccagatgcctggaaaacagaacttatgaaaatgttcaactactttttgtgttttgcagctggatctccagtgggtccaggttttgagcgaaggctgggccactcccctcaaaggtttcatgcgggagaaggagtacttacaggttatgcactttgacaccctgctagatggtatgtttttgttgttgtttcttactctttgttgttaaggaaaaaaaaaaatctttcccagaagttttgcaggaacaggaagttagtctttrgtttgcaaatcttattgcaaaactgtttggatcatttacagtgtgctccattctattatgtttaagcttccatttttaggattttttggttgttctcaaaggttgttcctttaaaactaaggaactgaaaaatggtgtaaagccaagagaaagacaggtctgtttcatctccacttgctctttgctggtgctgatattcagaaggtagcacgcagaagtaccattgccacctgctagggacattcctagggcagccaagatgaggtcagcacatgttgctgacctccatggcaccctcca

SEQ ID NO: 65728 - DNA, 601 bp, Human
ggacttccctggggccagatgcctggaaaacagaacttatgaaaatgttcaactactttttgtgttttgcagctggatctccagtgggtccaggttttgagcgaaggctgggccactcccctcaaaggtttcatgcgggagaaggagtacttacaggttatgcactttgacaccctgctagatggtatgtttttgttgttgtttcttactctttgttgttaaggaaaaaaaaaaatctttcccagaagttttgcaggaacaggaagttagtctttagtttgcaaatcttattgcaaaactrtttggatcatttacagtgtgctccattctattatgtttaagcttccatttttaggattttttggttgttctcaaaggttgttcctttaaaactaaggaactgaaaaatggtgtaaagccaagagaaagacaggtctgtttcatctccacttgctctttgctggtgctgatattcagaaggtagcacgcagaagtaccattgccacctgctagggacattcctagggcagccaagatgaggtcagcacatgttgctgacctccatggcaccctccaccctccaggttgctcatgtcaagca

SEQ ID NO: 65729 - DNA, 601 bp, Human
ttcagaaggtagcacgcagaagtaccattgccacctgctagggacattcctagggcagccaagatgaggtcagcacatgttgctgacctccatggcaccctccaccctccaggttgctcatgtcaagcattattgcaacaactgctttctttggtgcatgctaaagtgtcaatgttcatgcccacacatgaaatatattaaaatggtttcatccactacactctaacaaaagagcattaaggcagctttctggccacgagctgaatggcttttagaaaaccaatctggtcaagctcagaarcatgtgttattgtgaagacttccggacccttctgtgatcatttccttcctagaactgcctgaacttatcaaataaacttatctatttcaagaccttcggggaatggctgctaagtggggaaggagtaggggtagagtcacgctgaatttgtaatgctgagcagggctccaagccttttaggaagaaaaatcaaataagatgctcttttttgggagaggtgttcatgtcctgtgtttgtgcctttgcctggggaatggggcatgaactcagaatcagaactcaaagactgatcagcatggg

SEQ ID NO: 65730 - DNA, 601 bp, Human
acagtgttgcccaggctgatcttgaattcctttcctccagtcatcctcctgccttggccttgcaaagtgctattatagacaacaaattcttaaaagagtctgtgatccaaaaagatgaagaacagctaatgcagataatccatctggatgatttaggcaaaatctctagcctttcttttacactgtctcaatttcattttatgggggtttttcaacttgcaaaacctgttgattttcttttttcttttcttttttttcttttttcttttttttgagacagagtcttgctctgtcacccagrctggagtgcagtggcatgatctcagctcactgcaacctctgcctcccgggttcaagcgattctcctgagtagctaggactacaggtgcatgccaccatgcatggctaagttttgtatttttagtagagacagggtttcactatgttggccaggctggtcttgagctccttgacttcagataatctgcccgcctcagcctcccaaagtgctgagattacaggtgtgagccacggtaccctgccaacccattgattttctatttcttatttgatgctcactaccgtgaggtggatgaagcac

SEQ ID NO: 65731 - DNA, 601 bp, Human
caacccattgattttctatttcttatttgatgctcactaccgtgaggtggatgaagcacttattattgctcccactttccatgtaatccagatgtctgtccccgcaaacccaccagcctggggatatgaatgaggttaccttcccattaatacttgaagcctactagttccaagcccctacctgctcatgcagaaagcccagttctttcaaaagcctacccaagtgtttttgggagtccccaaggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcc

SEQ ID NO: 65732 - DNA, 601 bp, Human
acccattgattttctatttcttatttgatgctcactaccgtgaggtggatgaagcacttattattgctcccactttccatgtaatccagatgtctgtccccgcaaacccaccagcctggggatatgaatgaggttaccttcccattaatacttgaagcctactagttccaagcccctacctgctcatgcagaaagcccagttctttcaaaagcctacccaagtgtttttgggagtccccaaggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcctt

SEQ ID NO: 65733 - DNA, 601 bp, Human
atgaggttaccttcccattaatacttgaagcctactagttccaagcccctacctgctcatgcagaaagcccagttctttcaaaagcctacccaagtgtttttgggagtccccaaggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcytctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcctttccccttccaagctgcaggacctgtgtctgaaactttctgtaagattcttcttttccctgtgggaattatctgctggttccaccatctacctctgcaaacagagtccactggacatacttatacaac

SEQ ID NO: 65734 - DNA, 601 bp, Human
aggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtgrctccagtgtggctctgtcaggagggttcaagatcagatgttttgctatttccatatcctttccccttccaagctgcaggacctgtgtctgaaactttctgtaagattcttcttttccctgtgggaattatctgctggttccaccatctacctctgcaaacagagtccactggacatacttatacaaccccagttatgatcaggattctgagctctgcacagcccacagaagcatcctaaatgcctgtgtaaattgataataaaaatagataatcagggatatgatgtgctgcccacccct

SEQ ID NO: 65735 - DNA, 601 bp, Human
tcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcctttccccttccaagctgcaggrcctgtgtctgaaactttctgtaagattcttcttttccctgtgggaattatctgctggttccaccatctacctctgcaaacagagtccactggacatacttatacaaccccagttatgatcaggattctgagctctgcacagcccacagaagcatcctaaatgcctgtgtaaattgataataaaaatagataatcagggatatgatgtgctgcccacccctaccactcgccgtatgttaagttactttgggtctaagtagaggcagaatatcacagtggatgagagtgtgagctgcgaagt

SEQ ID NO: 65736 - DNA, 601 bp, Human
cctctgcaaacagagtccactggacatacttatacaaccccagttatgatcaggattctgagctctgcacagcccacagaagcatcctaaatgcctgtgtaaattgataataaaaatagataatcagggatatgatgtgctgcccacccctaccactcgccgtatgttaagttactttgggtctaagtagaggcagaatatcacagtggatgagagtgtgagctgcgaagtcacactgtctaggtttgtatgtcagtgattagctatgaacctgggccaaattacttaaactctctgggcyttgttccttcatctgtataatggggatgttaataactgtacctacctacctcattggatgttgaaagtttaaaagaatgcctgattcaatagtcagtatttcatacatattagctattatgaacaaaccactctgcatacagttaaaagaatttgtcaggcatggtggctcatgaccgtagtcccagctactcagagcctaaggcgggaggatcacttgagcccaggagctagagtcccacctgggcaacatagggaaactttgtctctaaaaataaatacataaataaaagaacctgga

SEQ ID NO: 65737 - DNA, 601 bp, Human
ttactttgggtctaagtagaggcagaatatcacagtggatgagagtgtgagctgcgaagtcacactgtctaggtttgtatgtcagtgattagctatgaacctgggccaaattacttaaactctctgggctttgttccttcatctgtataatggggatgttaataactgtacctacctacctcattggatgttgaaagtttaaaagaatgcctgattcaatagtcagtatttcatacatattagctattatgaacaaaccactctgcatacagttaaaagaatttgtcaggcatggtggctyatgaccgtagtcccagctactcagagcctaaggcgggaggatcacttgagcccaggagctagagtcccacctgggcaacatagggaaactttgtctctaaaaataaatacataaataaaagaacctggagtcttgaagagactaagtgactttatccctagtcacatcaatttggaagtagcacagatacgatgttcgtcagctagccaacagatatacactgagtgccccccatgtgccagggtttttctagcgtctggagatagaatggtaatgaaggcaggtgagcttgctgagaaa

SEQ ID NO: 65738 - DNA, 601 bp, Human
gggctttgttccttcatctgtataatggggatgttaataactgtacctacctacctcattggatgttgaaagtttaaaagaatgcctgattcaatagtcagtatttcatacatattagctattatgaacaaaccactctgcatacagttaaaagaatttgtcaggcatggtggctcatgaccgtagtcccagctactcagagcctaaggcgggaggatcacttgagcccaggagctagagtcccacctgggcaacatagggaaactttgtctctaaaaataaatacataaataaaagaacytggagtcttgaagagactaagtgactttatccctagtcacatcaatttggaagtagcacagatacgatgttcgtcagctagccaacagatatacactgagtgccccccatgtgccagggtttttctagcgtctggagatagaatggtaatgaaggcaggtgagcttgctgagaaatacagtacagtcattttctgagacctagtccagtaagtccttcccgccccccatcagtggttgtgaaactttcttttttattttctttttcttattttattttattttttgagacagagtctcgc

SEQ ID NO: 65739 - DNA, 601 bp, Human
ctttatccctagtcacatcaatttggaagtagcacagatacgatgttcgtcagctagccaacagatatacactgagtgccccccatgtgccagggtttttctagcgtctggagatagaatggtaatgaaggcaggtgagcttgctgagaaatacagtacagtcattttctgagacctagtccagtaagtccttcccgccccccatcagtggttgtgaaactttcttttttattttctttttcttattttattttattttttgagacagagtctcgctctgttgcccaggctggagtgcagkggcgcgatctctgctcactgcaacctctgcctcctgggttcaagcaattcttctgcctcagcctaccaagtagctgagactacaggcgcttgccacgaagcccaggaaatttttgtatttttagtagagatggggtttcaccatattggccaggctggtcttgaactcctgacctcaagtgatccacctgcctcagcctcctaaagtgctaggattagagccatgagccgctgcacgcagccgaaactttcttttttaaaccagataattctttatttcatttcaaaaatcagaggcaat

SEQ ID NO: 65740 - DNA, 601 bp, Human
tgtcagaatgttgggcaagatatcatttatatagatatcatttaattgtaaccaattcatgaaggtttgagtcactgccattgaaaatttgaaatgatctccacagccacagacatgtgcccacttttgtcttccttcaaaccattgcaaatttcttgattacctacaatctgaaagcaacattgtttttattctgaccatgtctcctaaaaatattttgttggttttaattttctcaaaggtttatattttcccctaaatttaaaaataaaatagttctgtctactcagtccaaaagccaaaaaaaaaccccaaaacaaaaaccaaatcacttgttagagtatatgataattgtgtagtatgagtcactccatattattactcaagaatctacttttatatcagtgtatcatatcactttatttctcactagaagtatagttccagggttgtcacagaccctttgatcataaatgtcacatttaaatttaaaaatgcaacctcaagcttgtgttgactgatggcatccaagtaggatcaagacaggggagccttgtgagactccatcatttaatggctattcttccgcagctctgacttt

SEQ ID NO: 65741 - DNA, 601 bp, Human
aaaatgtttcttaattgtgtttatatttccctaggcatggcccttcctggtatgtactttaactttccaagtagctaaattattataattatatatgttaaattaactggaaatggttaagaacataactaaaagaaaatctacattaaccagttggaatcgctattagttcatgatccaaccagctatagtagaataacactgtatttttctttagactggagtccaaacaacaggaaatttcccaaccagatgtagctattgtgtatgatgtagcatttggctgacaaaagtaaacttrtttctaaattatcattgtacattttgttcctgagtcttttacatttatgatcctcttccaatgactgttggtcctcatttagtttcacaaagctggaaattttttttcctacagtgtttataaaagattttaagttgatgaagaataaatcgatttaaactgaatgtacctggttggattgtgtatgattgtacttcatttgtttgcaatgtatgattatgcatgaacttaatttcaagccattatggttgcttgttatggaactgggagtaaatatacatttgctgtgactgtaaactt

SEQ ID NO: 65742 - DNA, 601 bp, Human
atatgttaaattaactggaaatggttaagaacataactaaaagaaaatctacattaaccagttggaatcgctattagttcatgatccaaccagctatagtagaataacactgtatttttctttagactggagtccaaacaacaggaaatttcccaaccagatgtagctattgtgtatgatgtagcatttggctgacaaaagtaaacttgtttctaaattatcattgtacattttgttcctgagtcttttacatttatgatcctcttccaatgactgttggtcctcatttagtttcacaaakctggaaattttttttcctacagtgtttataaaagattttaagttgatgaagaataaatcgatttaaactgaatgtacctggttggattgtgtatgattgtacttcatttgtttgcaatgtatgattatgcatgaacttaatttcaagccattatggttgcttgttatggaactgggagtaaatatacatttgctgtgactgtaaacttctgcattgtacaagaatgaaaaggtagaattctgaatatgtcatctatctttggtgttgctttcatcattgttgtttttcctttaaaaagcc

SEQ ID NO: 65743 - DNA, 601 bp, Human
ggaggtggctgcaacagtgaaacatcccttggatttcaagtcagaatacttgatggaaggcaacgttacagacgtgttgcaggcagcgctaggttctttcagcaccctgctccacattttgctttgcattttgctttatttcggccaagtcattctttataagcagaggcaaatatcatggtcttcctttcagcaatgtggtcagtaagcaatccacagaaagcatgatttctagtgacaacgacagcatttctgaaggggttattctttgttagcctctctcccttttcctcaactagastatgcagtggatttaatcatcttccatcagcaacctccattaacatagtgctttacagtttgccccctgcagcaacccatggagatacatgtcatttattagcccatttttccagtgaggaaactgagtttagaaaagttgaatgacacacatagtaaaagggagaactgctgcctttgaatttagtgttctctgcaaaggacttagctgctctaattgcccgagaacgttgaaacaaagagttatttgaatgacacaccattactttctgtatgtacacagtatctagtttgtggttta

SEQ ID NO: 65744 - DNA, 601 bp, Human
gcattttgctttatttcggccaagtcattctttataagcagaggcaaatatcatggtcttcctttcagcaatgtggtcagtaagcaatccacagaaagcatgatttctagtgacaacgacagcatttctgaaggggttattctttgttagcctctctcccttttcctcaactagactatgcagtggatttaatcatcttccatcagcaacctccattaacatagtgctttacagtttgccccctgcagcaacccatggagatacatgtcatttattagcccatttttccagtgaggaaactgagtttagaaaagttgaatgacacacatagtaaaagggagaactgctgcctttgaatttagtgttctctgcaaaggacttagctgctctaattgcccgagaacgttgaaacaaagagttatttgaatgacacaccattactttctgtatgtacacagtatctagtttgtggtttataaagggtctcaaagtatattgcaggattttatgatagaccggatttgtttattgccggcagttgctgtctatttccggtgacattctttaggttctagtaacctttggagagtgtttaaaaggt

SEQ ID NO: 65745 - DNA, 601 bp, Human
aacggctgggcacggtggcttacgcctcttatcccagcattttgggaggctgaggttggcagatcatgaggtcaagagatcgagaccatcctggccaacatggtgaaaccccgtctctactaaaaatacaaaaattagctgggagtggtggcacatgcctgtaatcccagctactccggaggctgaggcaggacaatagcttgaacctgggaggcagaggttgcagtgagccaagatcgtgccagtgaactccagcctggcggcagagcaagactctgtctaaaaataaagtaaaataaartaaattaacagtgcatttaaaaataactaagaggataattggatttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagaaaaaggtgaatgaggtattacccagattgtggctgattagtattaaaaaagacaaacacacagctgtcataagtaacttattatacaaaaaatgcatattct

SEQ ID NO: 65746 - DNA, 601 bp, Human
taaaaataaagtaaaataaaataaattaacagtgcatttaaaaataactaagaggataattggatttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagaaaaaggtgaatgaggtattacccagattgtggctgattagtattaaaaaagacaaacacacagctgtcataagtaacttatyatacaaaaaatgcatattctcattcccatagattcatatcaattatctgatttttttctttgttttcaattcagtgtattggtatgcagatagagcctaaacaggtaatgaaataagagacttgcttaacgttcttacaagtttcatttccaagaaagactagagagttttgttttggtttgttttgctagcttaattttatttaattgggttttggaaaattttaaactccctactgcattgaggtcaggacttagatatgaaaagggaacccacaaagaggcgtttccaaagttagat

SEQ ID NO: 65747 - DNA, 601 bp, Human
aattaacagtgcatttaaaaataactaagaggataattggatttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagaaaaaggtgaatgaggtattacccagattgtggctgattagtattaaaaaagacaaacacacagctgtcataagtaacttattatacaaaaaatgcatattctcawtcccatagattcatatcaattatctgatttttttctttgttttcaattcagtgtattggtatgcagatagagcctaaacaggtaatgaaataagagacttgcttaacgttcttacaagtttcatttccaagaaagactagagagttttgttttggtttgttttgctagcttaattttatttaattgggttttggaaaattttaaactccctactgcattgaggtcaggacttagatatgaaaagggaacccacaaagaggcgtttccaaagttagatcacttatggaggccacctccatg

SEQ ID NO: 65748 - DNA, 601 bp, Human
aaaataactctttttaattcctttgcaaaggacttagaaaaactgggattaggtggaagaatgtatttctaaggtagtgtttgcaggctttgcctcaggagatgtttttagaaaggtgcaaagaaatgtctttctgtttgaggtctggtctcaatgatctcttgagtcctcagattctgcagtggctggcatcctcagctaaatgggaccagataagaaatttagtctgacaacatgagtagagaaacaaaatcatagctgtagctatgcacaaaaccataatcagagcttgcagccctgyccatcttgaaaatgcgcaaggaacataagtatcttcataaagaatggacccaaccaaatgctggaacaagaactcagagttcatgctctgtggctagtgagggggtcaatgatactctcttagtaaatgatactctcttagtaaacaaaaatcagcacagatagtggcagagtttccagaggaaagatattttttcagtggatatttttaagattgaaaaaaatgtgttcatctgataggatcaggtagggtctatcatgcctaaagggaaaatagactaactcctcagattccttcaca

SEQ ID NO: 65749 - DNA, 581 bp, Human
cactggccattcccgcatctctctccctctccttgggcctccctatttcctgagatccaacaatatttgaattaggccaattaataaccctgcaatggcctctaagtgttcaggtgaaaggaagactcacacatctctcactttaaatcaaaatgattgagcttagtgaggaaggcatgtagaaagctgaaattggacccaggtgcagtggctcacacttgtaatcccagcactttgggaggccagggtgggcggatcacttgaagtcaggagtccgagaccagcctgaccaacatggagraaccccatctctactaaaaatacaaaattagccgggcatggtggtgcatgcctgtaatcccagctacttgggagcttgaggcaggagaatcgcttgaacccaggaagtggaggttgcactgagccgaggtagcgccattgcactccagcctgcaacaagagcgatactccgtctcaaaaaaaataagaaaaagaaatttgaattaggcctcctgggccagttagccaagttgtaaatgcaaaggaaaagttcttgaaggaaattacacacagtgagctaa

SEQ ID NO: 65750 - DNA, 462 bp, Human
ggaagactcacacatctctcactttaaatcaaaatgattgagcttagtgaggaaggcatgtagaaagctgaaattggacccaggtgcagtggctcacacttgtaatcccagcactttgggaggccagggtgggcggatcacttgaagtcaggagtccgagaccagcctgaccaacatggaggaaccccatctctactaaaaatacaaaattagccgggcatggtggtgcatgcctgtaatcccagctacttgggagcttgaggcaggagaatcgcttgaacccaggaagtggaggttgcaytgagccgaggtagcgccattgcactccagcctgcaacaagagcgatactccgtctcaaaaaaaataagaaaaagaaatttgaattaggcctcctgggccagttagccaagttgtaaatgcaaaggaaaagttcttgaaggaaattacacacagtgagctaa

SEQ ID NO: 65751 - DNA, 456 bp, Human
ctcacacatctctcactttaaatcaaaatgattgagcttagtgaggaaggcatgtagaaagctgaaattggacccaggtgcagtggctcacacttgtaatcccagcactttgggaggccagggtgggcggatcacttgaagtcaggagtccgagaccagcctgaccaacatggaggaaccccatctctactaaaaatacaaaattagccgggcatggtggtgcatgcctgtaatcccagctacttgggagcttgaggcaggagaatcgcttgaacccaggaagtggaggttgcactgagcygaggtagcgccattgcactccagcctgcaacaagagcgatactccgtctcaaaaaaaataagaaaaagaaatttgaattaggcctcctgggccagttagccaagttgtaaatgcaaaggaaaagttcttgaaggaaattacacacagtgagctaa

SEQ ID NO: 65752 - DNA, 601 bp, Human
agtttggaagaagttgatttcatccttcatggatgactttgaggggttcaagacttcagtagaggaagtaactgcagacgtggtggaaatagcaagagaactagaattagaagtggagcctgaagaagtaactgaattgttgcaatctcatgatagaatttgaaaggatgaggagttgcttcctatgaatgagcaaataaatcgtttttttgagatagaatctactcctggtgaagattctcttgaaatggcaacaaagtattcagaatattatgtaagcttagttgataaagcagtggcrgcctgtgagaggattgactccaattttgaaggaagttctaccatgcgtaaaatgctatcaaacagcatctcatgctacagagaaatctttcatgaaagaaagagtcaattgatatgaccaacttcattgttgtcttattttaataaattgccacagccaccccagactttagcaaccatcaccctgatttgtcagcagctattaacacaagactctccaccaggagaatgattacaactctctgaaggctcagaggatcattaacatttttagcaaaaaggtatttttaaattaagatag

SEQ ID NO: 65753 - DNA, 601 bp, Human
ttctttagggccccacctgcatatatcctgcaagtacctcaaactcaacatgtttaacctccccccaagcctgttccccctactatgtctcctatcttagtgacagcttcaccatccaaatggtggcctgtgaccaaaacctggatgccattcttgcttctctcttctccccttgtccattcagtcaccacgtcctgccaaatgtagctttcagttattgcttgaattcattcactcctcttctattccatcttgggtcaggacatttcaattctttcctctctcttgtcttactcccccmtaatctcccactctttagctagagtgaattattcaacttttctttggaaacccctttattaagatacaatttaccgcaaagcctcttgccaccaccagccaacacactccctcgtccagtccttccagagctggtcattcgatcatgcgctctctgacttttgcacatactcatccttcaacctggcacactgtttcttccacctctgcctccggaccttattacctcctttcagaagtcagcactgactcctatgacacatgagcataactgagtgccccttctttgtcctcccagagt

SEQ ID NO: 65754 - DNA, 601 bp, Human
cccactctttagctagagtgaattattcaacttttctttggaaacccctttattaagatacaatttaccgcaaagcctcttgccaccaccagccaacacactccctcgtccagtccttccagagctggtcattcgatcatgcgctctctgacttttgcacatactcatccttcaacctggcacactgtttcttccacctctgcctccggaccttattacctcctttcagaagtcagcactgactcctatgacacatgagcataactgagtgccccttctttgtcctcccagagtaatttgkacttgcccctttcatacctgtgacaggtgaagctgaaatgtcaatatgggggccactgatgagaggcagtgggtgcagtgatgagaagaatctggtttgcaggagtctgagatttgggtcttggctttggtaagaaagctctgtgcacttgaactctgccacttcccctctgtaaaactgccttctcttctgaaaatgaggacattaaatctacattacctccaggttccttaaagccccagattctgtgactatgactgatagcacagaaatgaatgtgtgtgtatatatatatatata

SEQ ID NO: 65755 - DNA, 601 bp, Human
tcctcttgtaggcattagtttttcttctctttgattctgttctctgcaccctttcatcatgaccttatcttgctgaatccaccatttccttccttctttctggtttctttcccttctctctgctccctttttgcattctttttcaccttcccaccctcagctgctcctccctttccaattagtgcattccctcatctccagattgtttcttttgagtcttcctctccttggcctctttgagcctatttatcatagctttcttagtctttacgctagtggttgagcttatcctctcctttaygcattcttgtgtgtaattttgagcccaattccctatttgctacttcactgggctcctgaagcctgctccccattccttttggcgcatctagttctgcaaatcctctagctgtggcccccctgctgtctttggcaggaagcttggaagggggtggggacttctaggccacaaagccctgggaaattaagcagagcctctggatctcccttcctgacagctggacacagttctggcgataattggaccaccttagggatagagatgccccttgtccctccccatcccagaaatgccaaacac

SEQ ID NO: 65756 - DNA, 601 bp, Human
atgccaaacacatagttttaacatctctcttcaaacagacaggtttttaggctggatggtggatgaattcggtttgatgcccccttcaccaatagatagagcaatatacggtggacccctagtgtccagaataaattactgcatcctcaggggtttggaggtcagttctcaaaattgtgctgtgtccaactctaagcaatgaggagaaagtagatgtataggtatggatatttgaaaatgttcttgttgaattatctgactgagcacagagtttagaaaagaggccatgaaaacacaaccraaaaccttgcataattgccttctgtctaccgcagggtttctcagcctcagcactgttgacatattggactagataattcttcactgagagggcagttctgtgcaatgtaggatatttagtagcatccctagcctctgttcaccagatgccaatagcacttcagtcatcacaatcaaaattatcttcagatattgtcaaatgtcaccaggagtgactaaatcagcctctgtttagagccactgctctatcccaatcccccactccctgaacctctctggaatgcaggtcatggtaaacccc

SEQ ID NO: 65757 - DNA, 601 bp, Human
tcagctttctctcactcactcttgcctccctcttctctgctaacatttcaggtaaccaagttgtatttggaaagtggtgaaaggtacttggggtttgattagggggaggattgtaaaaccattacatgtttgactgaggaatgagattggctgtaagtatttgtgtcagtgactaggagagacacagctctgtaattgattatacttcaataccagatggaaaatatttaaacttatagaaaaaaaacaaaggttgccatgtttttcttttctttctttctttttttttttttttttttttgagacagagtcttactctgttgcccaggctggagtgcagtggcgagaccccggctcactgcaacctccgcctcccaggttcaagtgattctcctgcctcaacctcctgagtagctgggattacaggtgcccgccaccaggcctggctattttttatatttttagtagagacagggtttcaccatattggccaggctggtcttgaactcctgacttcatgatccacccacctcagcctctcaaagtactgggattacaggagtgagccaccatgcccgaccatgtttttctttttcattag

SEQ ID NO: 65758 - DNA, 601 bp, Human
aaacaaaggttgccatgtttttcttttctttctttctttttttttttttttttttttgagacagagtcttactctgttgcccaggctggagtgcagtggcgagaccccggctcactgcaacctccgcctcccaggttcaagtgattctcctgcctcaacctcctgagtagctgggattacaggtgcccgccaccaggcctggctattttttatatttttagtagagacagggtttcaccatattggccaggctggtcttgaactcctgacttcatgatccacccacctcagcctctcaaartactgggattacaggagtgagccaccatgcccgaccatgtttttctttttcattagtttcaccattcttcaaccctggcttacccctaacatttgtggggcccagagcaagaatacaaatggagagccatacatcatatttaaaagttacatgtgtaactaacaaactgctaaataaaatgtgtttgatccttctactttgacaactatgccttaatcacaaactggaaagccaggttcaaatatagacttctgggttctgcatcagaatatggtagtgtgtggagagttggcccttggc

SEQ ID NO: 65759 - DNA, 601 bp, Human
ttttagtagagacagggtttcaccatattggccaggctggtcttgaactcctgacttcatgatccacccacctcagcctctcaaagtactgggattacaggagtgagccaccatgcccgaccatgtttttctttttcattagtttcaccattcttcaaccctggcttacccctaacatttgtggggcccagagcaagaatacaaatggagagccatacatcatatttaaaagttacatgtgtaactaacaaactgctaaataaaatgtgtttgatccttctactttgacaactatgccttratcacaaactggaaagccaggttcaaatatagacttctgggttctgcatcagaatatggtagtgtgtggagagttggcccttggcctttcaccaactctcccttctccttctatgcttggcctcttcctatgctatgtgggtcctctggattgatttgtgggcaccccaggctgcatggctgagctctctccacaacctctgcagaccctccctgcttggcccgccctcagaagtagggctgctctgagtgtgtggtccaccctggaaagacaggttgggagatgaagctctcccaggcc

SEQ ID NO: 65760 - DNA, 601 bp, Human
gagttctgggtaccctgattatgatcaaaagagtaggtgatgactctgggtgggtcttcccaccaagggtctccttgcctttatgagatagacacaaccaaagggggccagagttgggccatctaatgtgtgggacactatgaagatggttcttctgcaggtctccaggtgctcttcacacccaccctttcctgaagtcacattttcagctgagactgggaatagaaaagtgattgcttctaacctcagtgaaataaatcctcagtgagttaaaaaacggtggttcctctaaaaaaaaaaattaaggtaaaaaacagaacataaaaattatcatcttaaccttcttgtaagtgtgcaactcagtaatgttaagcatattcacattgttgtgaaccaaatctccagaactttgtcatcttgcaaaatggaaactctacacccattaaacaactcccgcggtcaggcatggtggctcacgcttgtaatcccaacactttggaaggccgaagttggaggattgcttgagcccaggagttgagacctatctggttatcatagtgagaacctgtctctacaaaaaaaaaattttaaaattagccag

SEQ ID NO: 65761 - DNA, 601 bp, Human
tctgggtaccctgattatgatcaaaagagtaggtgatgactctgggtgggtcttcccaccaagggtctccttgcctttatgagatagacacaaccaaagggggccagagttgggccatctaatgtgtgggacactatgaagatggttcttctgcaggtctccaggtgctcttcacacccaccctttcctgaagtcacattttcagctgagactgggaatagaaaagtgattgcttctaacctcagtgaaataaatcctcagtgagttaaaaaacggtggttcctctaaaaaaaaaaattarggtaaaaaacagaacataaaaattatcatcttaaccttcttgtaagtgtgcaactcagtaatgttaagcatattcacattgttgtgaaccaaatctccagaactttgtcatcttgcaaaatggaaactctacacccattaaacaactcccgcggtcaggcatggtggctcacgcttgtaatcccaacactttggaaggccgaagttggaggattgcttgagcccaggagttgagacctatctggttatcatagtgagaacctgtctctacaaaaaaaaaattttaaaattagccaggtgt

SEQ ID NO: 65762 - DNA, 601 bp, Human
attattaaatcttggcccttgagtccccgtctttttagtattccattacaaaagaggaagtacacattaaagtacttctgctacatataccaatgtacaatggttgtcttaaggaaaagtacttgcacagtggtttgtgctacaagcaatactagccactattttttttcatggatcaccatgtctacttgaaagcatgagtgataaactatggttattcagatatgactattcggcagatatttttcaaaatggacaaagggaacctgataattcaaggaaaacagctgaaagtattcaytgccaatgataaatctaaggtttcaagcaaaatatttttggaaaatttttattcaccaccataagcttggcagattcccagtacttagaaaactttttgatgagactagtagtgatattaacacatgtgtgatgagactagtagtgatattaacacatgtgtgtgtttaaaaatcctgtaatgaaatatgtcaacacttggaagacttacaaactcagtgaactagtagtttctaattggccaatatacaatattgcaaaatcattcatgggtaaatgattcatccaaagcacagtgaac

SEQ ID NO: 65763 - DNA, 601 bp, Human
ttaacacatgtgtgatgagactagtagtgatattaacacatgtgtgtgtttaaaaatcctgtaatgaaatatgtcaacacttggaagacttacaaactcagtgaactagtagtttctaattggccaatatacaatattgcaaaatcattcatgggtaaatgattcatccaaagcacagtgaactaatagtttctaattggccaatatgtaatattgcaaaatcattcatgggtaaatgattcatccaaagcacaatggatttttaatgtaacagagtatgagaagtgcattaatatggctkcccattccacagtccaacttaaacctttaagaaactgacacttgttgagttttggtgtagtatcagataagaatatccataattgtgcaaaaaggctatccaaatcctcttctcttttccagctacctacctatagttggacttcctttttatacttcagccaaaacaatgtattactacagattaaatgtagacatagatatgagaatccagctgtcttctattaagtcagatattaaaaagattgcaaatatgtaaaacaataccatacttccctacatttggggaggaaaatgctta

SEQ ID NO: 65764 - DNA, 601 bp, Human
ttaggaaaggatatctttaaaagataaatgtcacccttttatcataacacagtgagcttatcaaacagagattttctttgtcccactgcaccaccagtgtagtggatttgaacgagctggctgcaagtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgyatgtgaaaggtaattagctcattaatggcagtcagataatgagatactggagttggtaatttcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattc

SEQ ID NO: 65765 - DNA, 601 bp, Human
taggaaaggatatctttaaaagataaatgtcacccttttatcataacacagtgagcttatcaaacagagattttctttgtcccactgcaccaccagtgtagtggatttgaacgagctggctgcaagtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgcrtgtgaaaggtaattagctcattaatggcagtcagataatgagatactggagttggtaatttcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattct

SEQ ID NO: 65766 - DNA, 601 bp, Human
cagtgagcttatcaaacagagattttctttgtcccactgcaccaccagtgtagtggatttgaacgagctggctgcaagtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgcatgtgaaaggtaattagctcattaatggcagtcagataatgagatactrgagttggtaatttcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtc

SEQ ID NO: 65767 - DNA, 601 bp, Human
gtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgcatgtgaaaggtaattagctcattaatggcagtcagataatgagatactggagttggtaatttcctttaaactgcaatttattgtgaatagggaggcactggaaagtaaaatccacatagttctgtrgaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtctccataaaccatgacctacagatttgacccacaatgaccagcatgtcccttatggacattttctaggtccagtggca

SEQ ID NO: 65768 - DNA, 601 bp, Human
tatagacaatagttttgcctattatgtacatctggtcttttgagggagtctgctgaattagatttgtagttttgtagaaacagaacaatgcctttgtttttgtttaaagactagcaataattagatagtaacaaggataaaatacccagatgcacttgggaaattatattttagtgtacacagaaaaaaggtgacaaagttcgcttattttcctagtcaagatattttcttaagaattgcaatccagttgacaaagtgggcagaattatccatttcaagagaaacaaacatacatactgattttttttgcatacacatccaaagcccagataaaactatattcaattttctcatattttatgtacaaaaatgatatacttggtgttcttttcgtggtaaattgttggagaaatgattgaaaaatgtgtgttttgaatatgactgaaaaaaacgtaaagggcacaccagtagttgaagcatgattatgaatgcttctccaatacatatttgttgcccaattgggggcataatgtaatttattaaattttatatagaaagttatctggggcttcagttaaaagataaaccaattcacaggccc

SEQ ID NO: 65769 - DNA, 601 bp, Human
aaagtacctgttaatgtgtaagaggggtaagttttagaaagtgaaaagcaaagtactatgatgttttttgagttatatgtagcaatgctgagaagatgagcagtcatgtctatcataagttattgcagtggatgggctgactatgcaacttaccatccaaactggtgggacactttcgaaagtgaaagggaacactattaataattttgccaggaaagcaggtgggaaaccatggcacatggtcacctagcaatgggagattaagaaaataagatttttttctgttttctaggaatttatrttccatagggtagatgttgacaaagatacatgcaaagattgtagattacattatactctgaattaatttccaaaagactggaagtagatgttggggaaaaaatagattagaatttatcagtcacagggcctggatgctttataaggatcaaaaagaagatgcctagactagcatttgaaattgaattttttctctctctccaaactggcagtacattggcatcgcctgtggagctttaaaaattatttactttattgggaaataattcaaacacgaagataacaaaaaaggctaatgtgg

SEQ ID NO: 65770 - DNA, 601 bp, Human
gtaccaacatttctctctttagtgtgtgatttttccctttttgtgcttctcctccttggctgtctctcctttctccttccccctcacttaccttgcacttccttccctctccatctctgtagtcttctctctccttttatatcttttctgtacttactgctgcttcttagttataaaatgaattgtataatttaaactgtttaataaatgtactttgttatttgtaattttcaagtcgggtactaaaacctttataaccttagcccccctccttgaaccctctaaaattaacaaaatcatrttaagttttatatagcaagtccttgggttatactttttgttgatattgctaggcaaatatgctcttaacaagtaattgcctgaggcaggaggattgcttgagcccaggaatccgagtttgcagtgagctgtgatcaccactgcactctagcctggacaacagagcaagaccctgtccaaaaaaaaaaggcagaaaaaagttaccaattacagaaaatttcttagttttattgggctgaaatttatacttcctcatggtttcttcctgatagttcagttctgcacccttaaattacacaga

SEQ ID NO: 65771 - DNA, 601 bp, Human
tttgttttataagattcaggatctaataagggatcattcattgcatttggttgcatttcttttagtctcgtttaacctgaaagagtgctccagcctttcttttgtccttcgtacattggcgttttggaagagtctaggccaggttttttgcagaatgtttttggatgtgtctgatattttttactcaggattagattcagattaaacatttttgacaagagcactacgtaagtgatatatccttctcagtgcatcatatcagaaggactgatgtctgcttgtcatgtcattgattattatyactatttttttgagacagtgtctctctctgttgcccaggctggagtgcagtggcgcaatctcagctaactgaaacctctgcctcccggattcaagtgattttcctgcctcagcctctccagtagctgggattacaggcgtgtgctaccatgcccaggtaatttttttatttttagtagagatggggtttcaccatgttagccaggctgatcttgaactcctgaccttaggtgatctgcccgcctgggccccccaaagtgctggtattacaggcatcagccaccactcctggccagtgatg

SEQ ID NO: 65772 - DNA, 601 bp, Human
gtgtctgatattttttactcaggattagattcagattaaacatttttgacaagagcactacgtaagtgatatatccttctcagtgcatcatatcagaaggactgatgtctgcttgtcatgtcattgattattattactatttttttgagacagtgtctctctctgttgcccaggctggagtgcagtggcgcaatctcagctaactgaaacctctgcctcccggattcaagtgattttcctgcctcagcctctccagtagctgggattacaggcgtgtgctaccatgcccaggtaatttttktatttttagtagagatggggtttcaccatgttagccaggctgatcttgaactcctgaccttaggtgatctgcccgcctgggccccccaaagtgctggtattacaggcatcagccaccactcctggccagtgatgtttgatcattagattacaatggtgcctgcctgatttctttattgtagaggtactttttttccttgtaaataaagaacttcttggccgggcgtggtggttcatgcctgtaatcccagcactttgggcggccaaggcgggtggatcacctgaggttaggagttcgaga

SEQ ID NO: 65773 - DNA, 601 bp, Human
gaccacaggcatccgccaccacacctggctaatttttgtatttttagtagagacggggttttgccatgttggccaggctggtcttgaactcttgacctcaagggagccacttgcctcagcctcccaaactgttgggattacaggtgtgagccactgcacctggccttttttttttttttttgagacagagtcttgctctgtcacccaggctggagtacagaggcgtgatctcggctcactgcaagctccacctcccgggttcaagccattctgctgcctcagcctcccgagcagctgggaytacaggcacccgccaccacacccggctaattttttgtgtttttagtagagacggggtttcaccctgttagccaggatggtctcgatctcctgacctcgcaatccgcctgtctcagcctcccaaagtgctgggattacaggcgtgagccaccgcacccggcccttttttttttttaaatataaagttttagtggtaagcatgtgagaattttttaaatctccagttgcctcctttttatttctaatagtagattttattatttgaatagattgaacagactattatctaattcctttttaa

SEQ ID NO: 65774 - DNA, 601 bp, Human
aggagagagattctgtttcctgaggcctgccctggaggcctaacacacccagcattataccaaaagactacaacaagggatatgggagttacaaaccaggaagtgtggacgaaagccaatatatacatatcataataccacaggtcagcccctggttttcgaagagggataccttacatcaaaagaatatatacaatcattaataatccagtccatcatctgtatgaatgtcttccagggcaaggccactcaggtttgccagcttcctttcaatcctgtcaggttccaaaaccaggagtgktcttggcaaatttatggcttcaccctttcatgcatctgtcatacttgagctaagagacagcgtcaccttttgctctgagccccgttcaaggcgttcatgtaatatgtcatttccttcaatttataacccgtttattcatcctttttccctcagctgttctccttttcttcattaataaatatctacactgctacctttggaagggacacaagttgccattgtgctgtgctagtctagattgtaggcagcaatgctagtgtagcaagtagctcctcctcacccctttaatgtattttttgt

SEQ ID NO: 65775 - DNA, 601 bp, Human
agagagattctgtttcctgaggcctgccctggaggcctaacacacccagcattataccaaaagactacaacaagggatatgggagttacaaaccaggaagtgtggacgaaagccaatatatacatatcataataccacaggtcagcccctggttttcgaagagggataccttacatcaaaagaatatatacaatcattaataatccagtccatcatctgtatgaatgtcttccagggcaaggccactcaggtttgccagcttcctttcaatcctgtcaggttccaaaaccaggagtggtcktggcaaatttatggcttcaccctttcatgcatctgtcatacttgagctaagagacagcgtcaccttttgctctgagccccgttcaaggcgttcatgtaatatgtcatttccttcaatttataacccgtttattcatcctttttccctcagctgttctccttttcttcattaataaatatctacactgctacctttggaagggacacaagttgccattgtgctgtgctagtctagattgtaggcagcaatgctagtgtagcaagtagctcctcctcacccctttaatgtattttttgtttt

SEQ ID NO: 65776 - DNA, 601 bp, Human
ttcctccagaaactattctttggaattttgtattggtcattccttcgcctctttaaaacagtttatattatgaatgtattggtgcccaaagaatatatttagtttttcttggaatcatactgcttattgtcttttgggacttgctttgtttcccccctcaactttatgtttttaatattcaacatattattgcatatagctgtagttcattttcactgtagtacaatattcaataatgtgaatataccatctactcttgtcagtgggcatttagatagttcctatcttttgctgttataawtagtgtaattatgaactctatgtggctcctgctatgaatgtgcaaaatgtttttgttttgaaagagaaaaagcttttgttaacatttataatcttcaattaaaaataatttttcatgacttgaacctttgatagaacctcaattccaggcttgtttcaaacttctgggctcaaggaatcctctcccgttggtctcccaaagtgttgggattacaggcatgagccactgcacccagctgagcacagagaactttgtaggtggtagaagttttcccaaactggattgtggtgattacacaga

SEQ ID NO: 65777 - DNA, 601 bp, Human
atgaatttcatggtagttatgcttcagtaaaacttaatctgagtatttaacaaaagtgtaaaaaaaaacggaatgaaataattttttggtaaaagtggaaaaattttttttaaagaagactccatttttctgaattagtaaagtttttttttacaaggcaacaccaaaatgcttatgacataattactgaaaatgttttaaaattattagatcacttccctgcattgatgcgcaatatattggaaaataattgaatttttttaattaaggattttacagtgtcatagggtcattatttttwaaaacagtttgagaaataattcatatgtaggcatgtctcaaagatagtgcaagttcaattccagaccactgcaaaaaagtgaatatcacaatgaagggagtcacacaatttttttggtttcccggtgcatataaaagttatgtttatactataataagtgtgcaatagcattttgtcttaaaaaacaatacatacataccttaatttaaaaatgctttattactaggaaatgcccatgatcatctgagccttcagagagttgtaatctttttgcaggtgaagggttttgcctcaggtgtt

SEQ ID NO: 65778 - DNA, 601 bp, Human
gtaaaacttaatctgagtatttaacaaaagtgtaaaaaaaaacggaatgaaataattttttggtaaaagtggaaaaattttttttaaagaagactccatttttctgaattagtaaagtttttttttacaaggcaacaccaaaatgcttatgacataattactgaaaatgttttaaaattattagatcacttccctgcattgatgcgcaatatattggaaaataattgaatttttttaattaaggattttacagtgtcatagggtcattattttttaaaacagtttgagaaataattcataygtaggcatgtctcaaagatagtgcaagttcaattccagaccactgcaaaaaagtgaatatcacaatgaagggagtcacacaatttttttggtttcccggtgcatataaaagttatgtttatactataataagtgtgcaatagcattttgtcttaaaaaacaatacatacataccttaatttaaaaatgctttattactaggaaatgcccatgatcatctgagccttcagagagttgtaatctttttgcaggtgaagggttttgcctcaggtgttgaggctgctgactgatgagagtggtg

SEQ ID NO: 65779 - DNA, 601 bp, Human
agtcacatctttgggcaccacttgtaattttcttgctatttccaccacatctgcagctacttcctatcatccatgagggttggaatcagcctcttccaaactcctggtaatgttgatattttgacctcctcccatgaattacaaatattcttaatggcatctagagtggtgaaacctttctgggaggtttccagtttacattcctcagatccattaaaggcatcactgtctatgacagctatagccttatgacatttatttcttaaataaataatatttctctgtcatatgaaatttctgttttttttttttgagacagagtctcgttctgtcacccaggctggagtgcagtggcgtgatctcggctcattgcaagctccgcctcctgggttcacgccattctcctgcctcagcctcccgagtagctgggactacaggcacctgccaccacacccagctaattttttttttttttgtatttttagtagagatggggtttcaccttgttagccaggatggtctcgatctcctgaccttggatccgcctgcctcggcctcccaagaaatttatttcttaaataatttatttcttaaatatttc

SEQ ID NO: 65780 - DNA, 601 bp, Human
ctggagtttgctggaggtccactccagaccctgtttgcctgggtatcaccagcggaggctgcagaacagcaaatattgcagaatggcaaatgttgctgcctgatccttcctctggaagcttcgtctcagaggggatgggttgtcagtcggcccctactgggaggtgcccccccagttaggctacttgggggtcaaggaccctcttgaggaggcagtctgtccgttctcagatctcagactccgtgctgggagaaccagtactctcttcaaagctgtcagacagggacgtttaagtctgcasaagtttctgctgcattttgttcagctacgccctgcccccagaggtggagtctacagaggcaggcaggcctccttgagttgcagtgggctccacacagttcaagcttcctggcggctttgtttacctacccaagcctcagcaatggtggacgcccttcccctagcctcactgctgccttgcaattcgatttcaggctgctgtgctagcagtgagcgaggctctgtgggcatgggaccctccgagccaggcgcaggatataatctcctggtgtgccgtttgctaagaccattggaaaagtgc

SEQ ID NO: 65781 - DNA, 601 bp, Human
tctctgtactaaaagactgatgaggattttaaaagatgcttattttgctgaattaagattaaaccttaaaataggaaaggagaataaagtacggtttgagacttctgtcaggtttctctcctaaaaacagattgactagtgctgtgagaagcacttctaaagaaaatcaatatatgctcagcaaggagcaagtaagttgttttttgtttgtttgtttttaactaatggacttttaaaagtaattttaggttcacagcaaaattgagtagaaagtacagagagttcctacttactgcttttytccacacattgacagtcaggcaccagtgtggtagaataataagcttttaatagaatgtttatctttgtgtttttcctgatctcttctatcaaaacattagccttttttttttttgtacatgacttaaaatcctttttttaaatttggaattagagtttataagtgagtattttgacatccatattttctgacaaaatgactttcactttcccaagttcccaggctatttttgctttctccatcccacccctaccccttgttagaatgttagtatgtatacagattggttttttttaatat

SEQ ID NO: 65782 - DNA, 601 bp, Human
tacggtttgagacttctgtcaggtttctctcctaaaaacagattgactagtgctgtgagaagcacttctaaagaaaatcaatatatgctcagcaaggagcaagtaagttgttttttgtttgtttgtttttaactaatggacttttaaaagtaattttaggttcacagcaaaattgagtagaaagtacagagagttcctacttactgcttttctccacacattgacagtcaggcaccagtgtggtagaataataagcttttaatagaatgtttatctttgtgtttttcctgatctcttctaycaaaacattagccttttttttttttgtacatgacttaaaatcctttttttaaatttggaattagagtttataagtgagtattttgacatccatattttctgacaaaatgactttcactttcccaagttcccaggctatttttgctttctccatcccacccctaccccttgttagaatgttagtatgtatacagattggttttttttaatattaacattaaatcagggacattcttcagtgccactgaatttttttttcaacataattttgatagcatggttttacttcatggaaaaaatg

SEQ ID NO: 65783 - DNA, 601 bp, Human
tctgtcaggtttctctcctaaaaacagattgactagtgctgtgagaagcacttctaaagaaaatcaatatatgctcagcaaggagcaagtaagttgttttttgtttgtttgtttttaactaatggacttttaaaagtaattttaggttcacagcaaaattgagtagaaagtacagagagttcctacttactgcttttctccacacattgacagtcaggcaccagtgtggtagaataataagcttttaatagaatgtttatctttgtgtttttcctgatctcttctatcaaaacattagccttttttttttttgtacatgacttaaaatcctttttttaaatttggaattagagtttataagtgagtattttgacatccatattttctgacaaaatgactttcactttcccaagttcccaggctatttttgctttctccatcccacccctaccccttgttagaatgttagtatgtatacagattggttttttttaatattaacattaaatcagggacattcttcagtgccactgaatttttttttcaacataattttgatagcatggttttacttcatggaaaaaatggaagattgcaaatt

SEQ ID NO: 65784 - DNA, 601 bp, Human
tttttttctacctttttgttgggtttcaaatcattgatattttcagatttcatagtctataaggtatggctttttaaagctgtgtagtcccatattttaacgtaagatggcagcattgagataaatgtgtagtgacaccaagtgattttagttatttggtcaattagcccattgtaacaggggaaacttgctgctttaaagttcttagaaatgtacgccaattctaggtgtttttgccaactttttgaagtcacagttccatggagtttagccaggggtatcaggaatcttttcagtgctrggaatctctgtagtgttgaaagatactggctaaatattttttttttttttttttttttttttggagacagagtctcgctctatcccccaggctggagtgcagtgacatcgtctcggctcactgcaacctctacctcccaggttcaagtgattctcatgcctcagcctcccaagtagctgggattacaggcacctgccaccatgcccagctaatttttatatttttagtagagagacagggtttcgccatgttggccaggctggtcttgaactcctaacctcaggtggtctgcctgccttg

SEQ ID NO: 65785 - DNA, 601 bp, Human
ttttcaggtaacactgatacactttctgtcactatacattaagttgtattttctaggattttatataatggaatcatagtgaatttttttttgttgggcttctttcactcaacatagtgattgtaagattcatctgtgttgctgatgaatctaatagttcattcctttttaagaccaagtagtattctgttacatagatccaccaccatttgttcaccttttgatgaacatttggttattcacagttttaaggctattgcaaataatgcttctgaatatttgtgatctttgtatgttatgwtttgatttcttgggaacctacctaattagatggaatggttgagtcttaagtaggtgtatttttcacttttttttttttgagacagagtcttactctgttggccaggctagagtgcagcggcacgatcttggctcacttcagcctctgtctcgtgggctcaagcagttctcctggctcagcctcccaagaagctgggattacaggcatgtgccaccacgcccagataatttttgtatttttagtagagatggggtttcatcatgttggccagactggtctcgaactcctgacctcagataa

SEQ ID NO: 65786 - DNA, 601 bp, Human
ttgtattttctaggattttatataatggaatcatagtgaatttttttttgttgggcttctttcactcaacatagtgattgtaagattcatctgtgttgctgatgaatctaatagttcattcctttttaagaccaagtagtattctgttacatagatccaccaccatttgttcaccttttgatgaacatttggttattcacagttttaaggctattgcaaataatgcttctgaatatttgtgatctttgtatgttatgatttgatttcttgggaacctacctaattagatggaatggttgartcttaagtaggtgtatttttcacttttttttttttgagacagagtcttactctgttggccaggctagagtgcagcggcacgatcttggctcacttcagcctctgtctcgtgggctcaagcagttctcctggctcagcctcccaagaagctgggattacaggcatgtgccaccacgcccagataatttttgtatttttagtagagatggggtttcatcatgttggccagactggtctcgaactcctgacctcagataatccacccacctcagcctcccaaagtgctgggattacaggcatg

SEQ ID NO: 65787 - DNA, 601 bp, Human
tatctagtttggtgaagtctttattttgtgtgctttttaattgggttatctttattactgtttgtgtgtgtgtgtgtgtgtgtgtgtgtgtgtgtgtgtgttgtctaggtacaagtcctttgtcagatttatgctctataggaatatattctcttagtctatggtttgcctttcttaaaaaatatatatatattaatggactgattttgccccattattgaggcatttcaccctgagtatttatatgtaccctgtgtattttgaggttttcccactctggcttatgtgaaaactattctgwttttttgtgttagctttgggaattttttttctttttttagacggggtctcactctgttacccaggccagagaacagtggtgcgatcatagctcactacagcctcaacctcccaggctcaggcaatcctcccacctcagcttcccaagtagctgcgactacatgcatataccaccatgcctggctaatccttaaaaaatttttaatacatggaacttatttttatttatttatttatttttatttttttctcactgtgttgcccaggctggtctcctggtgggctcaagcagtccttcccc

SEQ ID NO: 65788 - DNA, 601 bp, Human
acccaggccagagaacagtggtgcgatcatagctcactacagcctcaacctcccaggctcaggcaatcctcccacctcagcttcccaagtagctgcgactacatgcatataccaccatgcctggctaatccttaaaaaatttttaatacatggaacttatttttatttatttatttatttttatttttttctcactgtgttgcccaggctggtctcctggtgggctcaagcagtccttcccctctgcttctggagtcactgggattatagataggagtaatctgtaattagctctgctaattttttttttttttttacctattccttttcaatgttttttctccgggatttggatagttttctcatacgcatgtgctgttcagtgccagctgaaaatttgagggagcccctgctggtctgcagcactctcttctcaggtactcctgctgtgaattcagccagtgtggcctccctaaattctcactcccatctcagctgctcagggcgacttcccgagctgtttgggcatcccctccctgtgccatagtctggaaactcggcagtaagctggggcagttgttggagtcacctcctttgcctt

SEQ ID NO: 65789 - DNA, 601 bp, Human
ctcctggtgggctcaagcagtccttcccctctgcttctggagtcactgggattatagataggagtaatctgtaattagctctgctaattttttttttttttttacctattccttttcaatgttttttctccgggatttggatagttttctcatacgcatgtgctgttcagtgccagctgaaaatttgagggagcccctgctggtctgcagcactctcttctcaggtactcctgctgtgaattcagccagtgtggcctccctaaattctcactcccatctcagctgctcagggcgacttccygagctgtttgggcatcccctccctgtgccatagtctggaaactcggcagtaagctggggcagttgttggagtcacctcctttgccttccttttcttataactattgttgagtgtctgaaactttgtatgttttgttcagctttctggtactttaaggtaggacagtaaatctggtccctattactccgtcttgactggaagtggaaactgtttcagtgtatttttgcttgaggaagaaaaatgtcatacttgagtcattttagttcttgatttatgttaagctgttggattggtgcttct

SEQ ID NO: 65790 - DNA, 601 bp, Human
cctattccttttcaatgttttttctccgggatttggatagttttctcatacgcatgtgctgttcagtgccagctgaaaatttgagggagcccctgctggtctgcagcactctcttctcaggtactcctgctgtgaattcagccagtgtggcctccctaaattctcactcccatctcagctgctcagggcgacttcccgagctgtttgggcatcccctccctgtgccatagtctggaaactcggcagtaagctggggcagttgttggagtcacctcctttgccttccttttcttataactaytgttgagtgtctgaaactttgtatgttttgttcagctttctggtactttaaggtaggacagtaaatctggtccctattactccgtcttgactggaagtggaaactgtttcagtgtatttttgcttgaggaagaaaaatgtcatacttgagtcattttagttcttgatttatgttaagctgttggattggtgcttctccaaatactcactggaactgatgtttcaattagatgtggaagacttaacaacaaatttttttctggtaattttcttcccaaagcatctggcagttcatgttgct

SEQ ID NO: 65791 - DNA, 601 bp, Human
tatagcacggggattcttggggtatagagtctgaaatcccaaaactatatttaagtttttatggaccacatgcctttctttagtacgaagttccattttcttagattctcagatggtttcatgtcctttgtgaaagttaagaaccacagatgcagtgaggattgagtgattgctttggcagccctcctttaaaaaacatttacctcttcctgtattttttgcttgtttgtttgttttgagacaaggtcttactctgacaccctggagtgcagtggcgtaatcatggcttattgcatcctcracttcctgggctcaagtgatcctcatacctcagcctcccaagtagctgggactacaggcatgcgccacagcgcctggctaattttgtggggagttttcgtagacacaaggtctctccatgtttcccaggctagtctcaaactcctgggctcaagcagttctcccatctgagcctcccaaagtgctgggattacaggcgtgagccaccatgcccagcttattcttctgttaaaggaaaaacttggtcctttctgtcatggtatcctgaacctcaccactctgtttattgaatggtagtgac

SEQ ID NO: 65792 - DNA, 601 bp, Human
cagtcatgccttcacaatagttccccaagtcttaactcattccagcattaactcaaaagtcccaagtctgaagtctacaaagtctcatctggagatgagtttcttccacctgtgatcctgtgagatcagaaatgagttatttactcccaagatacagtggtagtacagacatttggtatacctcctattccaaaagggagaaatcagccaaaagaaaggggcagtaggctctgtgcaaatctgaaaccagcagggcagttgttaaatctttttttctttttctttttctctctctctctctttttttttttaaacagagtctcactctcttggcccaggctgcatgatcacagctcactgcagccttgacctctctggcacaagccatcctcccacctcaccctcccaggtagctaggacctcaggagtgcaccaccatgcctggctaatttttgtatttttagtagagaccggattccgccatgttggccaggttggtcttaacctcctgagctcaagtgatctgcccacctcagcctcccaaagtgctaggattacaggtgtgacccactctgccaagccagtctttaaatcttaaagc

SEQ ID NO: 65793 - DNA, 601 bp, Human
agaagcagatgctagagccacgcttcctgtacagcctgcagaaccgtaagccaaaatacacttgttttctttataaattacccagtctcaggtatttctttatagcattgcagaaacggactaacacaaaattggtaccaaggcatggggcactgctataaagatacctgaagatgtggaagtagctttggaactgggtaaaaggcaaaggctggaagagtttggagggcaaagaagacaggaagatgaagaaaaatttggaacttctgagagactggttaaatggttgtgaacaaaatgytgatagcgatatgaacagtgaagtctaggctgatgaggttccagatggaagtgaggatgttattgggaactagagcaaatgttacccctgtcacatcctagcaaagaacctggctgtactgtgtgccctagggataccctcatcagtttttcctcattcaagatgtggcctggctgcttctaacagcctatgatctaatatgggagcaaagaaatgacttaaagttagaacttatatacaaaagggaagcagagtgtaaaagtttggaaaattttcagtcaagccatgtggtagagaaag

SEQ ID NO: 65794 - DNA, 601 bp, Human
gtataaattgtttccatacaatttaatttatggtatacctgtggttttgcttttgcatttggatctttagcacttttggatatctgatgaattttaacatatgctattcaatgaaatgagtttgttacttgataccgtgtttacctttagaataaagtgttaggtactaatattttaggagaactgacttgaactcatctcctggattctaaactcagcacaccactaatttgtgtgctgggtcacttcactgctagaactgctgtggcttttgctgccactgtggctgtttgctatcacrgattgattgatggctctgtggcaaacactaccatagagccatcgatcaatatgtgatagcaaatatgtgagtatttttctgtagctcaaatccaacagctttgcaagggaagtagcttatcttcatttggcaggaatgaagcctgagagagattgagtcatttgccctaaaatttgctcataaccaagttatgccctgtagttttcaagcttcttagtttttccctctctaaaagggtatgacagaacctgtatcatagagtaagcaattactttgctaaggctacacagagcagcattt

SEQ ID NO: 65795 - DNA, 601 bp, Human
atttaaaaatacttatgctggtcaaactaaatatggctgtgttctgaatgctaccgcttggtaacttcagacctaagagattgcttcttggaaataaatacaggttttaggtattttagatgacctaattaaagtataccagttatgaagagaggcttggtaagcgcctgttgatgaatggcttttaagttttacaccttttagagaatattaatctgaaagtagtgaataattgtcttttagtttgttttgaaatactgttaacagtttcagtgtactttttgagtatatatttctagcrtactcttatatatggaagttattctgctccttattttttcttacacgcttttctgtagttattttgatatgaattgttttcctgaacatttagaaaaaggtttgtgtcagattgcttgtctcatctcacagagcccccccgttctggtgtgtgtactgttcagaagtatgatgggttgttttctgagatttcctggctctgttcccctccccccactttcatctagacttactttttcctttatctcttctgtccctctcctgcttggctgaaattccactcccagcagtttctctagtg

SEQ ID NO: 65796 - DNA, 601 bp, Human
cctgaacatttagaaaaaggtttgtgtcagattgcttgtctcatctcacagagcccccccgttctggtgtgtgtactgttcagaagtatgatgggttgttttctgagatttcctggctctgttcccctccccccactttcatctagacttactttttcctttatctcttctgtccctctcctgcttggctgaaattccactcccagcagtttctctagtgtgagccctgtgtttggagagttcacaggagctccaggattctctagccccgggcctcactgtaggcctgccttgcactcaycaagtcctggagaggactaaatacttcccaatttcagctgctatatccagttcacacacagcgcttccagtgaatacctgtgggctgtttgggattctcttgttctcagattgctcagatgctctgtggcttctctctgctttcttcaacagatactgataatatctagtgcttgaggttggatgctacttggagtggttcatagagaatacttttccacctagttatgttgtaaatgtttcccatgggtttttggatttgctatctgcttgctgtgtttgtgtgtgttgggggcagagg

SEQ ID NO: 65797 - DNA, 601 bp, Human
tgtgtgtgtgtgtgtgtgtgtgtgtgtgtgtgtgtgtgtgtgtgtgtgtgtgtgtgtggagatggtgggtatatcagtccttgcccttcctttccttccctagagggggccaaaactctccctcctccttccctctctctcttcctgaggatgagtgggaggagatgttctcttgccctctgtcctttaagtctgtcccccaatcatcctccaccccaccccaatacggtcctttccagctctggaggcccttcgtctccaagctgggccgcggcatccctccgctccattcccttccttyccagccccacaggcgtcgggtccaggtccccagttcctccatccccacagcctcagcatccccacgccatcaccccgcaccaggccacatctgcatcccgaccctccctccacgcccggatcccaggacccagacccatccctgccccccacccccccacaactcggccaggctctcacctcgggggctccgcggccgcagcacaaaaggcggcgctgctgcagctccgctccggatgctgctcccgcctcctcctccttctcctcctccttccctcctccccccgctgccctccaccgg

SEQ ID NO: 65798 - DNA, 601 bp, Human
catggcttgcaacagcacctggcacgcagaaggtgctcggtaaggtggaaccactgctctactcaccccggaggatcgccttaagccccgcacactctctctgcgcgcgcgcgcgcgcgcaaacacacacacaaaactagctccctgaatcctcagaagagccaggtgaaggaggtactactggtcccattatattcttgagagaactgaggcccagaaagcacaaatcacactaaagttcagcttccaaatccccaacatatcccacgcgttatttgtggcttcaagaggtaaggtgtargttgcaatgcaaattacagacaaacacagaccaagcaaagtgccaacatatgggagaatttcgtctggaggacccaagggattttgcctgccccccaacctccctccccgcccccaccacctcccactccgccgcaaccccgggcttcgcttctggaccacccagaaacaaggcccaagactctgggacgctctcgcctggcaggccaggagggagggatggcgggattggagccctcggggaggagccggggccgtgccctggacagcttggtcaccagcaatggaaggacgaagccca

SEQ ID NO: 65799 - DNA, 601 bp, Human
acaagagcgaaactctgtctaaaaaaatatataaataaataaaaagcaaccattaaaaaacctgaatctggcacggtgtgttggctcatgcctgtaatctcaacactttgggaggctgaggcaggtggatcacttgagctcaagagtttgagaccttggctgggcgcagtggctcacgcctgtaatcctagcactttgggaggctgaggtgggtggatcgcttgaggtcaggagtttgagaccagcctggccaacatggcgaaaccctgtctctacttaaaaagaaaaaattagctgggcrtggtggtggatgcctgtaatcccagctactcgggaggctgaggcaggagaatcacttgaaccccagaggtgaggttgcagtaagccaagatcacaccactgcactccagccttgggcgacagagtgaaactctgtctcaaaaaaaaaaaaaaaaaaaaaagtttgagaccagcctgggcaacatggcaaaaccctgtctctaccaaaaatagaaacaaacaaacaaacaaaaaacaacaaagctgggcatggtgatcctgtgactgtggtcccagctcctctggaggctgaggtgagatg

SEQ ID NO: 65800 - DNA, 601 bp, Human
ccctgcttgcttactcacttgggtgacttgagatccctgtggataatcttgtgcaggtgcaggtagttcatgccaccagcgatgcccatggaccagtcaaccagtaaggagggggtgacagggcggccagcccgcagtacctcatacagctggccctgggcgcagaactccatgaggatgcagtagcagggagcctgggtgcacacacccctgggagccaaacaatggtatgaaggcctcagctggctcagcattcacctgattcatacctggaacccccattcccacccattccacctayggatctcctctggggaaggatggggtaggtcccactgcccaggagggtaccaggccttagcatagtatccccaacacccagcccctgccctggacctcacttgaaagtgatgatgttggggtgcttcagctttcgcaagtgcttgatgtcggtttctttgaggtctcgcaccttcttcacagccacctcctccccgtggaagcgccccaggaagacagcaccctgggcccctgagcccacccactgcaggtccaggatttcctcaaaggggacctcccaaaggtctgtgggcaggaggca

SEQ ID NO: 65801 - DNA, 601 bp, Human
cttgccacggcgactccgtcctggtgagggggggcccttaggacacccaggaagccccaccccactcagggctgcatctagtttagggagcaaagactccgtcttgaggatatctggcctggaagaagaggaaaagtaaaaggttaagactgccaaatctatgtactcaaagcactccctaaccttggacactaaagtacacatctccctgctaatatacctgttgccacttcagtatccctcttgccatattggaaccacagtactcatgtcccaccttttgctatggggtgacagcttatgtggcacattcctcttcttgataagcttctccattgtgtttccatgcaggaggccccgggaagggtgtggcttcagcaggcctgggcacctccgctctaaagcttgctctcgcctaaagatccaggcaccttctcagctgggcaaatgaccaggaaggggcaccccagtctcagtaggacctctaaggcaggcacagctccagggcttggtgcataaggacaggtagggttacctgagcagctccctctccttgagttccagctgcaacatgagggcattaagttccatatacaggttg

SEQ ID NO: 65802 - DNA, 601 bp, Human
aggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctcygtccggtagctcgcctccgcctccccttgcaggctccagcctcccgccgggctcttggcccctaaacctgcttccggcaagggatgggggcggggtgggcctatagtgccttggaatccaggacaaaacccccaacccaccgaataactggggagggcggagaataagaacccccactttctttgacagaattcgcaggatcgttcaggcactagacagtattttttaaataggggactaatttgctggggtctacagaaatgtgagatttatttttttcctttcctgacttattttaaa

SEQ ID NO: 65803 - DNA, 601 bp, Human
gagaatcctcatctgtggtagtctgggctggtgtgggagatggaggcaattgttcagcaagatccagataattagggccaagatgtgtcgtggcttcttccttctcccaattatacagactcttgctttattgctctggttttttttttttctccctacggtgagtgtagactttttttttttttttttttttttttttgagagagagagagaagcagaaattccaggagagaatcagaaagggagaaaaagagagatggggtttaggagagagaaagagggagaaagaaacagtgggctmtttggaccacactagaagtctttactgacaagcctttggatttgggttgggaagagtagcaagctggatttctagctggacaaggcactcttcagagcccagagcttgcctgtgggggggcgggtggtcaagggtgggtgggctgtggggagctgaacagaggggccccgaagcccaaaaagaaagccatggctgagcattgagatgatttttatttactcctcaaaggtgtctattaggtttccaggcatgaagtcattcgtgtatgtgatctggagggagactagggaaggggtgatt

SEQ ID NO: 65804 - DNA, 601 bp, Human
ccctttccacgaagtcccttttcctgtccctatgcatttgcaccctgaccctaaggctcttgtctgttccagccctgctacagcgaaagaactacagagtgcgaggtgagccagtgccagagccaaggccagactcaggcagggactggagtgtggagctgcaggagctgcctgagctgtgtttctcccaggtgccccagggagggagagaagggctcctctgggcactcctggaggttgtgctggggaggaatcctggccctgttatagctcagaggcccacactcagcacagtgtcccyagcaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaaggtgagcaccaaggagtgtatatgtgtgtgtgtgtgcctgtgtgtatgtatagaggtgggggcta

SEQ ID NO: 65805 - DNA, 601 bp, Human
tgcctgtgtgtatgtatagaggtgggggctacatggcagctgggccctgttgattgcttctgctttcgattttctcttttctaaaacattaaaaatggccaggcgaggtggcccacacctgtaatcccaggactttgggaggccaaggtgggtggatcgcttaagcccaggagctcaagaccagcctaggcaatatgaggaaaccccatcactgcaaaattacaaaaattagctcagcatggcagtgcacacctgtagtcccagctactcaggaggctgaggtggaaagatcgcttgagcytaggaggttgaggctgcagtgagccgtgagcatcccactgcactccagcctgggagacagagcgagaccatgtgaaaaaatagtaacaggctgggcacggtggcagacgcctgtaatcccagcactttgggaggccaaggtgtgaggatcacttgaacccaggaattcaagaacagcctgggcaacaccgtgaaaccccacctctacaaaaaacaaaaaattggctgggtgtgatggcacatgcctgtggtcccagctacttgggaggctgaagtggaaggagcacctgagcctggggag

SEQ ID NO: 65806 - DNA, 601 bp, Human
gtggatcgcttaagcccaggagctcaagaccagcctaggcaatatgaggaaaccccatcactgcaaaattacaaaaattagctcagcatggcagtgcacacctgtagtcccagctactcaggaggctgaggtggaaagatcgcttgagcttaggaggttgaggctgcagtgagccgtgagcatcccactgcactccagcctgggagacagagcgagaccatgtgaaaaaatagtaacaggctgggcacggtggcagacgcctgtaatcccagcactttgggaggccaaggtgtgaggatcrcttgaacccaggaattcaagaacagcctgggcaacaccgtgaaaccccacctctacaaaaaacaaaaaattggctgggtgtgatggcacatgcctgtggtcccagctacttgggaggctgaagtggaaggagcacctgagcctggggaggtcaaggctggcagtgagccaagattgtgccactgcactccagcctaggtgacagagtaagaccctgtctcaaaataataatttttatttatcttttttattacataaacaatacatgtttatatatttttattttattttggtgggagga

SEQ ID NO: 65807 - DNA, 601 bp, Human
ctgttgcccaggctggagtgcagtggcacaagcttggctcactgcaacctcagcatcccaggttcaagcgattctcctccctcagcctccccagtagctgggattacaggcgcttgccaccacgcctggctaatttttgcatttttagtagagacggggtttcaccatgttggccaggctggtttcaaaatcctgacctcaagtgatccacccatcttagccccccaaagtgctgggattacaggtgtgagacaccgtgcccagccaaaaaaaaaaaaaaaaaaattgttaaagaaatatyttcaggcacagccctccaaactcattcgtattcattcaacaaataagtatgaactatatgtcaggcactatgctagaggccacaaaaaacacacagtccctcttttacagattttatagactagcaggggagacagaaatggatcaagtaaacacgagtgtcaaatgtcaagtgtgctaagtgctaggagagagggccaatgaactataagaataataagatgtgacttgaaggggagagcaatgagcaacaagaagaggaaaaggtaggcagaggccagccacaccaggccctgtgggc

SEQ ID NO: 65808 - DNA, 601 bp, Human
tgcagtggcacaatcttggctcactgcagcctctacctcctggtttcaagcaattctgcctcagccacctgagtagctgggattaaggcgtgccgccactactcctggctaatttttgtatttttagtagagacgggatttcaccctgttggccaggctggtctcaaattcctgacctcaagtgatctgcctgcctcggcctcccaaagtgctggaattacaggcgtgagccaccccgcccggccatgctacacgctttaaacacatttccaaacttacccttcacaaacacattatgagrtaggaatgattatccacatggggctcagaaaaggaaagtcatttgcccagaatctatgtgactctagagctggctcctcatcatcgtgtctattgcctcctgtttacccctccatcaggactgtgtgtgtctctgtccacgtggaagagctccccacaactcactttgccctattgtaagtagttcaacctccaccacctgtttcagagcccaaatgcagtggctcttccctgaactttttcagcacctacagcttctgtacttctgaaatcttgaatgatggaaagtcccttctttgac

SEQ ID NO: 65809 - DNA, 601 bp, Human
acagcttctgtacttctgaaatcttgaatgatggaaagtcccttctttgaccatatacctcctggcccagctcaaaaatcactgtttttttgtttgtttaatttctctgacttctccaggcagggttagtcattcttgctttatgccccttggcactcggttaattttcctatcttggggtttactgcattctttatctcttaccttccctgagccatcttggtgcctgaacacagttcgtggccaccgaaggtgctcgatgacacttgttgaatgaggggttctattgctcccttccctycaattcccacttgccctccacctgctactctgttatctactggctctgcccgtctatgtgtacacatgcctgacacctcagacaaggtgactcatgaaggatgcccctgactagcttgccctgcctcctctgttactgtctttgccgcatgtcttctgagtcagtataaggtggtggttattagtaagtgatcctgagtcagactgcttggattcaagctccactcctgcctcaccgactgacttcaagagagtttccttagttctgtaaggaaaagctcttcatctgttaaatgggggt

SEQ ID NO: 65810 - DNA, 601 bp, Human
ctcttcatctgttaaatgggggtgtgacaggagcacctaccttctagggttttcacaaggattacaggaggccacatccactgggtctggaccacagtaagtgcccagtacccttgatctagagttactatttttcatgtcaattgatgcacagtcttactcctctacctattgtcttggccagcatccatcagtgtgtctgtctgctggggagatgcagggagaagactgtcaattgatctctgctccctgggatggatcagccgtctccagctttgtgtaccatccttttctctctgcrtttccccagggctccctgtgccactacttgacccagtacaccagtgactggggaagttccctgcggatggcactgtccctggcccagggcctggcatttctccatgaggagcgctggcagaatggtgggtgagctgggcataggaagtcaagggagccacagtgctatgtttgtgattctgccttagtttggaggggaaagattgggtcaaaagagggaggaagagccgggcacggtggctcacgcctataatcccagcactttgggaggccgaggtgggcggatcacaaggtcaggaga

SEQ ID NO: 65811 - DNA, 601 bp, Human
cactacttgacccagtacaccagtgactggggaagttccctgcggatggcactgtccctggcccagggcctggcatttctccatgaggagcgctggcagaatggtgggtgagctgggcataggaagtcaagggagccacagtgctatgtttgtgattctgccttagtttggaggggaaagattgggtcaaaagagggaggaagagccgggcacggtggctcacgcctataatcccagcactttgggaggccgaggtgggcggatcacaaggtcaggagatcgaggccatcctggctaacayggtgaaaccctgtctctattaaaaatacaaaatattagccgggcgtggtggcatgtgcctgtagtcccagctactcgggaggctgaggcaggagaatcacttgaacccgggaggcggaggttgcagtgagccgagatcgcgacactgcactccagcctgggcgacagagcgagacgccgactcaaaaaaaaaaaaagagggaggaagaaaatccatgttccttcaaccttggattcccccacaggccaatataaaccaggtattgcccaccgagatctgagcagccagaatgtgctcatt

SEQ ID NO: 65812 - DNA, 601 bp, Human
aattcaataagtccccattctgtcatacattgatgatgtttctgctgtgacccaataaaaggcagttctaggtataaaaggtgaaagcagtggcgtcacagtgaaagttcagggctttgcacaaatacttttttaacaaaatgtcccttctgtacctgatctgaaatttccacggcacaagtcttaggttggctgacagaaactgggcattacttgcagaagactctggctctctgagaggaaagagagtaatttcccattagcatattaagctgtcaacctacattagctcctcagaggraacagtgggctatacagaaggcccccagagagcctgtttcatagggagcaagactcagagggctggaattcagcaagagggagaggagggaggctccaggaaagatcagaagtggatgttgaaagcaggagagtgatggacactgaagatggcttttaaccctggggcccactcaagatcctagggtcaacccttcctccctgtcattccccccaggaccctgatgggctgagggagctcctagaagactgttgggatgcagacccagaagcacggctgacagctgagtgtgtacagcag

SEQ ID NO: 65813 - DNA, 601 bp, Human
cggcacgcggaagagccaactctaaggctaagggatagcggaagcaagaaagggcgagaggaccagggtgggagcacgcaaggtaagcgcctcaaagcatccgcgcaaggtgaggtgtcccgcgcgcgtgcgcagcgcacagagggctctaggtcccaaggccttacctgctcccactgcagagaagacagagaggggcggagcagcgggaagagcgaaaggaaggctcagcgcatgcgtgacccgggccaacgagtcgctcagccacggatagagtgattgcaacatacaggatcagctmaggcatcacagcgccgcctgccagggctgtggcggtatccggccggttgctccacctggcgttcgagaggagaaactacagggagcgccgactgtgcagaaatgaggccaactccgcggagtaagccgatccgtaacgtggactgcggtttggtctgtaccgcgtttgggatctcggacttgcgtcccctttccgagcatgcgcagtcgtcacactgccaaaacaaaactcctactcagaattcagtgttaacatacggtcgggattggggttcagtgcctaaaatgcagcaggaggaag

SEQ ID NO: 65814 - DNA, 601 bp, Human
gggttgtcacaatctgaaagggccagagggcgagaaaagagtgtttgcagggactgggtggaacaggtgaaaagcagcactccaggatctaactttggccagctccaaggtatcctccccctgcgagacatccaagatggcgccaggcccgcgcggttggaggtcaccggcacgcggaagagccaactctaaggctaagggatagcggaagcaagaaagggcgagaggaccagggtgggagcacgcaaggtaagcgcctcaaagcatccgcgcaaggtgaggtgtcccgcgcgcgtgcgcrgcgcacagagggctctaggtcccaaggccttacctgctcccactgcagagaagacagagaggggcggagcagcgggaagagcgaaaggaaggctcagcgcatgcgtgacccgggccaacgagtcgctcagccacggatagagtgattgcaacatacaggatcagctcaggcatcacagcgccgcctgccagggctgtggcggtatccggccggttgctccacctggcgttcgagaggagaaactacagggagcgccgactgtgcagaaatgaggccaactccgcggagtaagccgatccg

SEQ ID NO: 65815 - DNA, 601 bp, Human
tggttcacacctgtaatcccagcactttgggaggccgaggcgggcggatcacgaggtcaggagttcgagaccagcctgaccaacatggtgaaaccccacctctactaaaaatacaaaaattagccaggtgtggtagcacgcgcctgtaatcccagctactcaggaggctgaggcaggagaattgcttgaacccaggaggcggaggttgcagtgagacgagaccacgccactgcactccagcctgggtgacagagcgagaccccatctcaaaacaaacaaacaaacaaacaaacaaacaaamagttgccctttagagtctttgtagttttgggagatatttgttgaaggccaagacactggaaggtctccaacaatctctttgctgatccctggaagtatctgattcctgaaaatacttcaatttcctgtattaataagatgaggaagatcaaggaggaactctgttattagtctatccaaaaggtattagtggctgggcgcagtggctcacgcctgtaatcctagcactttaggaggctgaggcgggtagatcacgaggtcaggagttcgagaccaggctgaccaacatggagaaaccccg

SEQ ID NO: 65816 - DNA, 601 bp, Human
ttaaaagttgccgtttaggctgggcacgtggttcacacctgtaatcccagcactttgggaggccgaggcgggcggatcacgaggtcaggagttcgagaccagcctgaccaacatggtgaaaccccacctctactaaaaatacaaaaattagccaggtgtggtagcacgcgcctgtaatcccagctactcaggaggctgaggcaggagaattgcttgaacccaggaggcggaggttgcagtgagacgagaccacgccactgcactccagcctgggtgacagagcgagaccccatctcaaaaaaaacaaacaaacaaacaaacaaacaaaaagttgccctttagagtctttgtagttttgggagatatttgttgaaggccaagacactggaaggtctccaacaatctctttgctgatccctggaagtatctgattcctgaaaatacttcaatttcctgtattaataagatgaggaagatcaaggaggaactctgttattagtctatccaaaaggtattagtggctgggcgcagtggctcacgcctgtaatcctagcactttaggaggctgaggcgggtagatcacgaggtcaggagttcgaga

SEQ ID NO: 65817 - DNA, 601 bp, Human
agcagtattgtaaacgctccttattcactaaactatatccttattagcagaaaaggggccctagaaagcttaactggcccagaaaacagtgactgaccttaagtcattggcagaaatagaattaaaaccctgaagtcatgacttcttccagaaaccccacacagctcccaagatttccttataatgaagtgacttcccctggtctgaacaagtgaacacttgggttcaggtaagacctgttacccatttccatagcctcatgatttgcagttgccacaggaattttcccagagtgtctttygcctaagttttccttagtttttattcaaaaggaacgcttctcaagacttcatcatctggacctttaaaagttgccgtttaggctgggcacgtggttcacacctgtaatcccagcactttgggaggccgaggcgggcggatcacgaggtcaggagttcgagaccagcctgaccaacatggtgaaaccccacctctactaaaaatacaaaaattagccaggtgtggtagcacgcgcctgtaatcccagctactcaggaggctgaggcaggagaattgcttgaacccaggaggcggaggttgc

SEQ ID NO: 65818 - DNA, 601 bp, Human
tcagaaaccaggggctggctgcagtgccagttttcccaggagtgacagagggaaattcccagagatgggaaaaaatagcagtaaagccactatgttcactgagtctctagaacagggaaggtaaactttttctgtaaagggccacattgtaaataattttaggttttgtgggccgcatatagtctcttttgctttaaaacaaaaatgaagccttttaaaaatgcgaaactatttttttttttgagatggagtttcactcttttgcccaggctggagtgcagtggcgtgatctctactcacygcaacctccgccttcagggttcaagtgattttcctgcctcagcctcctgagtagctgggattacaggcatctgccaccatgcctggctaatttctgtatttttagtagagaaggggtttcaccatgttggccaggctagtctcgaactcctgacctcgtgatccgcccgcctcggcctcccaaagtgctgggattataggcgtaaggcaccacacccggccataaaattatttttagctcaatcatacaaaacctggctatggcccagatttggcccttaggccttagtttgccaacaca

SEQ ID NO: 65819 - DNA, 601 bp, Human
ggtctctagaggattaatttggttttaactgagttatccagagctgggagtactaaacagtcccaggtgtcagaaaccaggggctggctgcagtgccagttttcccaggagtgacagagggaaattcccagagatgggaaaaaatagcagtaaagccactatgttcactgagtctctagaacagggaaggtaaactttttctgtaaagggccacattgtaaataattttaggttttgtgggccgcatatagtctcttttgctttaaaacaaaaatgaagccttttaaaaatgcgaaactatttttttttttgagatggagtttcactcttttgcccaggctggagtgcagtggcgtgatctctactcactgcaacctccgccttcagggttcaagtgattttcctgcctcagcctcctgagtagctgggattacaggcatctgccaccatgcctggctaatttctgtatttttagtagagaaggggtttcaccatgttggccaggctagtctcgaactcctgacctcgtgatccgcccgcctcggcctcccaaagtgctgggattataggcgtaaggcaccacacccggccataaaattat

SEQ ID NO: 65820 - DNA, 601 bp, Human
cactaatggttcacccatctcattaccacaaattaagacctcttggcccagacacttaatatccagggcccaaataggatggaagaggcatccagagtggaagggtctatctagagcagtgttttcaaactttaagcagaactccaatatagtaaacatctaaaagccaaactgcaatggtacaaaagtagtggggaaattttaacggcttggtctcccctttattctctaagacagtctctggggcataacctcagaatcctaaggatttatggaacaccgctcttctagaagacaagastaagagggacagattatgttctctcatttcaaatagtcagaagatctggggctttaagaaactacaaatgggctgggtgcggtggctcacacctgtaatcccagcactttgggaggccaaagcaggcggatcacttgaagccagaagttggagaccagcctggccaacatggtgaaaccccgtctctactaaaaatacaaaaattaggccaggcgcggtggctcacgcctgtaatcccagcactttgggaggccgagatgagtagattgcttgaggtcaggagttcgagaccagcctggc

SEQ ID NO: 65821 - DNA, 601 bp, Human
tttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggtagaaggagaagagaaaagactgaatttctagttcacacaaagaaaaggataaatatctaagatrggctcagggagaatccccctcttcaagattatctcacataataaagaagcttttagggtaacaccatcatgcccaaattcttgccctgattccccaaaggctctacaggaactgaatgaagggggagcaggcaatctaaaatcctgtaacatggcccaggtataatcatgaccttcactaatggttcacccatctcattaccacaaattaagacctcttggcccagacacttaatatccagggcccaaataggatggaagaggcatccagagtggaagggtctatctagagcagtgtttt

SEQ ID NO: 65822 - DNA, 601 bp, Human
tgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagaccccyagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagct

SEQ ID NO: 65823 - DNA, 601 bp, Human
gggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagctggggaaggtaagcggcgacgtggaggtgtcggccctgccccggccrtgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcg

SEQ ID NO: 65824 - DNA, 601 bp, Human
acatcagctaatatgcttacaatgtgccagctctggactaggtgcctcacattaactaatcaagccattatgacaatcctacaagataggtattgttatcactgcatttatttttattttattgagacagggtcttgctctgtgacccaggctggagtgcaatatcaccatcacggctcgctgcagcctcaatctcctgagctcaggtattcttgcctcggcctcccgaggagctgagactacgggtgcacaccatcatccccagctaatttttaaattttttgtagagatggggtttcattgtgtgtgtgtgtgtgtgtgtgtgtgtgcgtgtgtgtgtgtgtgtgtgtgtgtgtgttaagacggagtctcactctgtcacccaggctggagtgcagtggtgtgaactcggctcactgcaacctctacctcctgggtgcaagcaattcttgcacctcagcctcctgagtaattaggattacacacggagtttcaccacattggccaggctggtctcgaactcctgacctcaagtgatacacccgccttggcctcccaaagtgctgggattacaggcatgagcttccgcgcccagactatc

SEQ ID NO: 65825 - DNA, 601 bp, Human
tcacgcctgtaatcccagcactctgggatgctgaggcgggcggatcacgaagtcaagaggagaatcacttgaacccgggaggcagaggttgcagtgagccgagattgcaccactgcactccatccagcctgggcaacaaaagtggaactccatctcaaaaaaaaaaaatctcattattttcttctacaatccactttggtaacttatattttgctagaaaatcaaacatttccacagggcacggtggctcacttctataatcccagcactttgggaagccaaggcgggcggatcacaaggwcaggagttcaagaccagcctggccaatatggtgaaaccctatctctactaaaaatacaaaaattagctagtgcgtgcctgtagtcccagctacttgggaggctgaggcagaagaatcacttgaacccgggaggctgaggttgcagtgagtcgagatcgtgccactgcactccagcctgggcaacaagagtgaaactccttctcaaaaaaaaaaaaagaaatcaaacatttccttcagattttcaaatctgttggcctaaacaagtccacaatattcttttataattcttctattttctcc

SEQ ID NO: 65826 - DNA, 601 bp, Human
cagttatctaacactcctcagaacacatcctgtgctcccaaacagccctcctgccttgccttatcaaagtacctcccaactctgcagctcccgcgtttgctccttatcataaagatgctgcaggctgggcgcagtggctcacgcctgtaatcccagcactttgggaggccgaggtgggcggatcacgaggtcaagagatcgagaccattctggccaacatggtgaaaccccgtctctactaaaagtacaaaaaaattagctgggcgtggtggtgttcgcctgtagtcccagctacttgggtggctgaggcaggagaattgcttgaacccgggaggcggaggttgcagtgagccgagattgcaccactgcactccagcctggcgacagagcgagactccgtctcaaaaaaaaaaaaaaaaaagatgcagcatgtggctcggcctccatcaccagcagggaactacctgagggcacctgccatgtgtctgcagctgtgtatttccagagccatgtgcctggcctgacagacgaaggctactacctgaattaatgccacctctctttccacctaactataaccaccttcagctccagtgaagtc

SEQ ID NO: 65827 - DNA, 601 bp, Human
ccttagattctgatattttattttatttttatttttatttttattttattttattttattttgtttttttgagacagagtctcactctgttgcccaggctggagtgcagtggcatgatctcagctcactgcaaccttcacctcctggattcaagcgattctcttgccttagcctcctgagtaactgggattacaggctcctgccaccatgcctggctaatttttttatttttagtagagataggattttgccatgttggccagggtggtctcgaactcctgacctcaggtgatctgcccayctcggcctcccaaagtgctgggattacaggcgtgagccaccgtgcctggctgattctgatatttattaaagggggtgggattccactcctttatagtctgcaggctagtcactttgctccctgggtttcagtttccctttctgtgaaatgagtaggggagataagtctaaagtctctacgggtcttccagcgcctattactatagcctcgggacctagtttgggacttagtctaccccctactctcactccacgtgaggggataggatggagcaagatgaaggctgagtatgacgggccc

SEQ ID NO: 65828 - DNA, 601 bp, Human
tgcattaactcattcaatccttacaatctcatgagggaaatattatctttgttttgcaggagtttagggagctgaacagacttgaccaaagtcacaaagctgggaagtggccgagctgggatttgaacttaggttcaactccaaagcccagacctaactaagagtgggagcctccaccccacgggtactgaggtgcccacattgctcagcccttacctgtggaactgtttgacccctgctggagcaaagctctgagctctgggatcttgaggctggggaactggggaacaagctgtgctgyctctgttgggtggcccctggggccagcatagagagaaaggggcagagggagcaacctccaggtcagccagggcccactaggggtttccccagaggggcagccccacgcagctactgcccaggtgcaagactgggcactgaaaggcaaccttgggtatgtggccaactttggacctcagttgcctcatctgtaaagcatggacttaaatgagtgtagacactccttgacccctgggttagtggctgaggtcagcaataggataaagggttagaggagagcttggagtgacagtgactgagt

SEQ ID NO: 65829 - DNA, 601 bp, Human
ataggcacccaccaccatgccaggctaattttgtatttttggagagacggagtttcaccatgttggccaggctggtctcaaactcctggcttcaagtgatttgcctgcctcggcctcccaaagtgctgggattacaagtgtcaggttcttttattctgagatagggtctcactctgtcgcccaggttagagtacaatggggtgatcacggctcacttcagccttgacctcctgggctcaagggagcctcctacctaagcctcctgagtaggtgggactccaccacacacacctaattttcrtattttttgtagagatggggtttccccatgttgcctaggctggtcttgaactcctgagctcaagcaaaactcccacctcagcctcccaaagtgctgggattataggtgtgaggcaccgtgcccggctggcccaggttcttaaagtctcctccttgacacaatcatcacagttgtaattcagtagttatttacatgattgtctcctcactgcattgtaagctccataagtacaggggccatgtctgtcttcttcaggctgtatccccaacacctggcacacagcaggtgctcagttaatgt

SEQ ID NO: 65830 - DNA, 601 bp, Human
tctgcctcggttgccttacctgtaaagtagggttattaaaagacacctcccttgaagaattgtttaattagaaaataggtggattaggcattattatccataatgctatttggctctggctgaggtgactctagggagggccctgaagaattacatcccactgtggcccagggagcctgggactcactagtcatcatgtgtattattgccatttattggctatttcttatgggctgggctggttatatgctattttagacacattatctcatgcattcctcctagtgacctaggagacccyctgaagcaggcattattatccccgcttcatggcactgggtaagtcaagtgagtcacccagaatcccacagttctttaggggtacagctggggctcagacccaagcctgctcactccagggcccaaattattattattatttttttttggatggagtctcactctgtcacccaggctggagtgcagtggtgccatctcggctcactgcaacctccacctcctgggttcaagcaattctcctgtctcaacctcccaagtagctgggactacaggcgtgcaccaccattcttggctaatattt

SEQ ID NO: 65831 - DNA, 601 bp, Human
taggtgttcttatgcaaagggcaggaaaaaagacattcctagtggaaggaacagcatgtgccaaggtacacaactgcctgcacttgggggaatgcagctgaagagacaggctcaagacaatgagtgaggacttgacctatggcaatggagagtcactggatagtaagcagggaggggcagggacaggggcaggaggaactgtccaggtgagagatgccgagatcttgggctggggactgtgccatgggataaggagcagtgagcgatgtgaagtctgtttaggaggcagagccagcagggygtgataatgaactgcagtggccagagaggagaggagagggccagagggagatcttggggcctggggccaatggggcccactggggtctctggctgagggacatatctgggaggaggaggcagagctgggttgagggtaaaagccattcagctgctctcactacctttcccctcagtttcccaggcagcagctatgtctgagctggacactggggcaaggcctgtggccaccagggcccagggtacccactcctatctcaggggtcccttgtggtgaccctggtaggtctggtagggatga

SEQ ID NO: 65832 - DNA, 601 bp, Human
gggaggaggaggcagagctgggttgagggtaaaagccattcagctgctctcactacctttcccctcagtttcccaggcagcagctatgtctgagctggacactggggcaaggcctgtggccaccagggcccagggtacccactcctatctcaggggtcccttgtggtgaccctggtaggtctggtagggatgagacctctttggggtgggggccaggcaggagctgtgtggtgcagaaaagccctgggttctagacctaccagtgttactgagtgtctgtgccacctcaggaatcaccagkcctggtggctcacacccgtaatcccaacattttaggaggctgaggcaggaggatcacttgtgcccaggagttcaacacaagcctagggaacatggagcaaccccatctctacaaaaaaatacaaaaatcagctgggcgttgtgcatgtgcctgtcattccagctacttgggaggctgaggtgggaggatcccttgagcccaggaggttgaggctgcagtgagctgtgattgcaccattatgctccagcctgggtgacaaagtgaaacccctgtaggtaggtaggtaggaaggtaggaagg

SEQ ID NO: 65833 - DNA, 601 bp, Human
cagaacactctacccccaaacacttttgtagcttgttctctcatctctttaaattttttgtttaaatgtcaccttctcaataagacctttcctatctttttatttatttatttattttgagacggaatctcactctgttacccaggctggagtgcagtggcgagatctcagctcactgcaaactccgcctcccgggttcatgccattctcctgcctcagcctcctgagtagctgggattataggtgcctgccaccaagcccggctaattttttgtatttttagtagagatggggtttcacygtgttagccaggatagtctcgatctgctgaccttgtgatccgcccgccttggcctcccaaagtgctgggattacaggcgtgagccactgcacccggctatttatttactttttgagacagagtcttgctctgtcgccaggctggagtgcagtggcatgatctcggctcactacaacctccacctcctgggttcaagtgattctcctgcctcagcctcctgagtagctgggactacaggcgtgcgccaccatgtccagctaatttttgtatttttagtagagacagcgtttcaccatgttg

SEQ ID NO: 65834 - DNA, 601 bp, Human
actctacccccaaacacttttgtagcttgttctctcatctctttaaattttttgtttaaatgtcaccttctcaataagacctttcctatctttttatttatttatttattttgagacggaatctcactctgttacccaggctggagtgcagtggcgagatctcagctcactgcaaactccgcctcccgggttcatgccattctcctgcctcagcctcctgagtagctgggattataggtgcctgccaccaagcccggctaattttttgtatttttagtagagatggggtttcactgtgttrgccaggatagtctcgatctgctgaccttgtgatccgcccgccttggcctcccaaagtgctgggattacaggcgtgagccactgcacccggctatttatttactttttgagacagagtcttgctctgtcgccaggctggagtgcagtggcatgatctcggctcactacaacctccacctcctgggttcaagtgattctcctgcctcagcctcctgagtagctgggactacaggcgtgcgccaccatgtccagctaatttttgtatttttagtagagacagcgtttcaccatgttggccagg

SEQ ID NO: 65835 - DNA, 601 bp, Human
tatatcccttgtacctagaacagtgcgtggtgcataggaagtgctcagtaaatatttggggtgtaaactgatgactatatgaagcctgttctctctggatctaggaatattttgagcacacagtagaatctcaataaatgtgtgaatgagagaaaaagtgagcggtcatcatcctttccatttgtcagatcatactttagctgggtcaaccctgaggctcttttgcttctgattgcttctgatattttctgccagggcatcagtttcaattggagtgcccaaatcttttgttctggagccygagctttgcagaatttctagttggggctgtttggctgttgggtccgcaatggttattatgtcattattggtaattagcacttaggcctagaggattgagctttttgtttttcagcagaaatcatagcagagagctgtgctagacactgggagccaggcttggagcagcttcctctggaactttccccttcccagctcggggtccatgatttagggagaccaagacagaggtgcccaaagctaggggcacataggtcaccagctcaactgctattttccccagacagtatcctgcaatgtt

SEQ ID NO: 65836 - DNA, 601 bp, Human
gtttcactggccaggctggtcttgaactcctgatcttcaggtgatctgcccacctcagcctcccaaagtgctgggattacaggcatgagccaccatgcctggcctgagactctatttcttcatctgtacaatggaaattatagtcatatcttcctcaagggggtgttgtgaaggttcagtgacatattgtatataaaacacttggtgtaatggttggcacatattagctccactttatagaaaaggaagggaggggaagtgaattgcctggactcgcatagcatctcagtggtgaagttcygatttgaaccaaggtcggcctgcctcaaaagtgcagttttttttttgttgttgtttgtttgttttttgagacagagtctcactctgttgcccaggctggagtgcagtggtgtgatcttggctcactgcaacctccacctcccgggttcaagcgattctcctgcctcagcctcccgagtagctgggattacaggcacccaccactgcacccggctgatttttgtattttcagtagagacagggtttcaccatcttggccaggctggtctcgaactcctgaccttgtgatccatctgcctca

SEQ ID NO: 65837 - DNA, 601 bp, Human
tctgcccacctcagcctcccaaagtgctgggattacaggcatgagccaccatgcctggcctgagactctatttcttcatctgtacaatggaaattatagtcatatcttcctcaagggggtgttgtgaaggttcagtgacatattgtatataaaacacttggtgtaatggttggcacatattagctccactttatagaaaaggaagggaggggaagtgaattgcctggactcgcatagcatctcagtggtgaagttctgatttgaaccaaggtcggcctgcctcaaaagtgcagtttttttkttgttgttgtttgtttgttttttgagacagagtctcactctgttgcccaggctggagtgcagtggtgtgatcttggctcactgcaacctccacctcccgggttcaagcgattctcctgcctcagcctcccgagtagctgggattacaggcacccaccactgcacccggctgatttttgtattttcagtagagacagggtttcaccatcttggccaggctggtctcgaactcctgaccttgtgatccatctgcctcaccctcccaaagtgttgagattacaggcatgagtcaccttgcccg

SEQ ID NO: 65838 - DNA, 601 bp, Human
tgctggatcagggtcattaggctcattccagctggtaagagaatagggttggagagggtcatgggaggccagatcagtgggtctctccctgaatgtcccagggctattatcagaagtagtcaggacagcctttccctgaggtcttgggacagatattaatattactcattcacatcatttccaaagtgctttcctgagagtgctttcctgaaagcagtacatagtagaggacagtggcatcagacagacctagtttaagctgcgatgttaggcaaatcacctaacttttctttttttttctttttttttttttgagacggagtctcgctctgttgcccaggctggagtgcagtagtgcgatctcagctcactgcaagctctgcctcacgggttcacgccattctcctgcctcagcctcctgagtaggtagctgggactacaggcacccgccaccaagcccagctaatttttttgtagagacggggtttcaccatgtcagccaggatggtctcaatctcctgacctcatgatctgcctgcctctgcctcccaaagtgctgggattacaggcgtgagccaccatgcctggccttttttttttt

SEQ ID NO: 65839 - DNA, 601 bp, Human
ttcctgagagtgctttcctgaaagcagtacatagtagaggacagtggcatcagacagacctagtttaagctgcgatgttaggcaaatcacctaacttttctttttttttctttttttttttttgagacggagtctcgctctgttgcccaggctggagtgcagtagtgcgatctcagctcactgcaagctctgcctcacgggttcacgccattctcctgcctcagcctcctgagtaggtagctgggactacaggcacccgccaccaagcccagctaatttttttgtagagacggggtttcamcatgtcagccaggatggtctcaatctcctgacctcatgatctgcctgcctctgcctcccaaagtgctgggattacaggcgtgagccaccatgcctggccttttttttttttgagatggagtctcactcttgtcacccaggcaggagtacagtgtgcgatcttggctcactgcaacgtccgcctcctgggttcaagcgattcttgttactcagcctcccaagtagctgggattacaggtgcccgcgaccacacccggctgatatttgtatttttagtagagacatggtttccccatgttgg

SEQ ID NO: 65840 - DNA, 601 bp, Human
gaaattgtaaaagtggacctggtggatggttgttaaggcattccttgacaacaagtgagccactgtgcctggccttttttttcttttttgagacagggtcttgctctgtcacaaagtgatgaagtgtggtagtgcgatcatggctcactgcaacctagacctcccaggctccagtgatcctcccacctcagtctctcgagtagctgggaccacaggcaggtgccaccatgcttggctattgtttttttttcctagactccaaagctagtgccagattggctgattttttaaaaattttaattttttttttgtagagatgaggtctcactatgttgcctagactgatctcgaactcctggcctcaagcagtcctccaaccctggcctcccaaagtgttgggattataggtgtgagcccctgcacagcccctaattcatctaagctgtagtttcttcaactgtacttgaggctaataatattgcctaagtattactgttaagaagttaaatgcaataatgattaaaaagtacttactgtgtgcctggcacatagtaaatacctcataaatctagttgttatggctgggcacggtggctcacgc

SEQ ID NO: 65841 - DNA, 601 bp, Human
atcccagcactttgggaggccgaggcaggcggatcaccagaggtcaggagttcaatactagcctatcccacatgtctctactaaaaatacaaaaaaaaaaaattagctgggcgtggtggcgggcacctgtaatcccagctactttggaggctgaggcaggagaatctcttgattctggaaggcagaggttgcagtgagccaagactgggccattgcactcatcctgggctatggagtaagactccgtctcaaaaaaaaaaaaaaaaaagtcagtcctaaaataatatggtataaatttttraaaagcgttaggttgagacatatgaaattgttcacatttgatcatttttaacctataaaatcagcaatttcatatgacttaatatatgtacactgaaaagtacacaaataagaagctaggtacagtggcctgtgcttgtaatcccagctacttgggaggatgaggtgggtggtttgcttgagcccatgagttcaaagctacagtgagttataattgcacagctgcactccagcctgggcaacagagtgagaccctatatcttgaaaaaataaataaataataaaataaataaaaaaataa

SEQ ID NO: 65842 - DNA, 601 bp, Human
tactgttcagaacactttgttggtgggcccagcttttcaaagccctcttcaatctcttgccaccctccacaacagacacagggcttcaggccagctgtgtccctaatccgcccacgtcccagatttgggtatggtttccccgcccctccccgctttcttccagtctcatctctaccaggtcatctgaggcctcatctacactccctggccttccccactggtcaccacctaatttcaccatctaatttcaccctcttatgtgcagctggtgtttgcttttgcttgggctcagtttgctgtrgggaaggattaagaccctttcacactgtctttttttttctttttctcttttgcttactgcccttgactgctccaggggctaacaggcagctagcggggcctgtattccctaggaaggaacacaaggggtagggggtggggaggtaatggtgggctcagctggcaggcgagatagagatggtccttagggaccccatcctggggcttggggcatagcacagctgccacccagatgtgagcatggagcagagctgtttctgccttggaaattagcctcagagacggtgcttgggacctttac

SEQ ID NO: 65843 - DNA, 601 bp, Human
aaatgctacatattctttgcatccaattagatgtgccattggctagcacttcatggcatagagaatactgggctttcatgaatctgaatttgctggataacttggtggtggtggagatggtaaaccactggtaattggtcttctatactcatccttcaaggtaccagattttcctgtctgattggtgaaggaagcctgaggcacagaggtggtaggactagaactctgaataaaaagcacagctgaacctgaggacttgaggcaggagaccagagtatttaagaacaggtgtggccaggcrtggtggctcatgcctgtaatcccagcactttgggatgctgaggtgggtggatcacctgaggctgggggttcgagaccagcctgaccaacatggagaaaccccatctctattaacaatacaaaattagccaggcgtggtggcacatgcctgtaatcccagctactcacgaggctgaggcaggagaatcgcttgaacctgggaggcagaggttgcagtgaggtgaggcgagatcgtgccattgcactccagcctgggcaaaaagagcgaaaccccttctcaaaaaaaaacaggtgcttcacc

SEQ ID NO: 65844 - DNA, 601 bp, Human
gagaatactgggctttcatgaatctgaatttgctggataacttggtggtggtggagatggtaaaccactggtaattggtcttctatactcatccttcaaggtaccagattttcctgtctgattggtgaaggaagcctgaggcacagaggtggtaggactagaactctgaataaaaagcacagctgaacctgaggacttgaggcaggagaccagagtatttaagaacaggtgtggccaggcatggtggctcatgcctgtaatcccagcactttgggatgctgaggtgggtggatcacctgargctgggggttcgagaccagcctgaccaacatggagaaaccccatctctattaacaatacaaaattagccaggcgtggtggcacatgcctgtaatcccagctactcacgaggctgaggcaggagaatcgcttgaacctgggaggcagaggttgcagtgaggtgaggcgagatcgtgccattgcactccagcctgggcaaaaagagcgaaaccccttctcaaaaaaaaacaggtgcttcacccctcatacacagaatgaccctggccaagtcacctgacctcactaagactcagtttcctta

SEQ ID NO: 65845 - DNA, 601 bp, Human
gcttggctaatgtctttttattttttgtagagacagtctcactatgttgcctagggtggtcttgaattcctggactcaagagatcctcctccctgggcctcccaaagtgctgggattacagatgtgagccacctcacccggcctctcccaacatttattaagtgttttataccaaatgtcttgtaagttcttatgcaatatggctacaatctacctttccacctttattctccttattttttgtattgtgcaaccaaatagaactactctgtaataacccttgctttgccatctctctctstgtgtgtgtgtgtgtgtgtatgtgtgtgtgtgtatttatttatttattttgagatggagtcttactctgtcacacaggctggagtgcagtggcatgatctcagctcactgcaacctccacctcctggatttaagcaattctcctggctcaggctcccaagtagctgggattacaggcgcttgccatcatgcccacctaacttttgtatttttagtagagttggggtttcaccatgttggtcagtatggtctcgatttcttgacctcgtgatccacccgcctcggccttccaaagtgctgg

SEQ ID NO: 65846 - DNA, 601 bp, Human
ccaacatttattaagtgttttataccaaatgtcttgtaagttcttatgcaatatggctacaatctacctttccacctttattctccttattttttgtattgtgcaaccaaatagaactactctgtaataacccttgctttgccatctctctctctgtgtgtgtgtgtgtgtgtatgtgtgtgtgtgtatttatttatttattttgagatggagtcttactctgtcacacaggctggagtgcagtggcatgatctcagctcactgcaacctccacctcctggatttaagcaattctcctggstcaggctcccaagtagctgggattacaggcgcttgccatcatgcccacctaacttttgtatttttagtagagttggggtttcaccatgttggtcagtatggtctcgatttcttgacctcgtgatccacccgcctcggccttccaaagtgctgggattacaggcatgagccaccgtgcctggccctgtatacatatgtttttagagacagggatcttaccttgttgcccaagctggagggcagtggcatgatcctggctcactgccgccttgaactcctgggttcaagtgattctcccacc

SEQ ID NO: 65847 - DNA, 601 bp, Human
gtcttgtaagttcttatgcaatatggctacaatctacctttccacctttattctccttattttttgtattgtgcaaccaaatagaactactctgtaataacccttgctttgccatctctctctctgtgtgtgtgtgtgtgtgtatgtgtgtgtgtgtatttatttatttattttgagatggagtcttactctgtcacacaggctggagtgcagtggcatgatctcagctcactgcaacctccacctcctggatttaagcaattctcctggctcaggctcccaagtagctgggattacaggygcttgccatcatgcccacctaacttttgtatttttagtagagttggggtttcaccatgttggtcagtatggtctcgatttcttgacctcgtgatccacccgcctcggccttccaaagtgctgggattacaggcatgagccaccgtgcctggccctgtatacatatgtttttagagacagggatcttaccttgttgcccaagctggagggcagtggcatgatcctggctcactgccgccttgaactcctgggttcaagtgattctcccacctgagcctcctgagcagctgggactacagac

SEQ ID NO: 65848 - DNA, 601 bp, Human
ggcatgatcctggctcactgccgccttgaactcctgggttcaagtgattctcccacctgagcctcctgagcagctgggactacagacgtgcaccaccatgcccagcttttttttttcgtttttaaaacacggggtcctgctattgtttcccaggctggtctcaaactgctggtctcaaactcctgagctcaaatgatcgtctcacctctgcttccaaaagtgctgggattacagacatgagtcactgtgcccagcttagtctgtattacagacatgagccaccatgcctggtgtgtaattkttggtgtgaatgatagagtttgcttacttttttttaatgtagtaatccagtttcatattgctaatctgatttcataactttagaatatcagtggccatgagaggctgagtttggttctgaaatcaagaggagcatagatgtagaccacagtctgtttccttgttatctaagaggcaggacagcataagtgttgccagtgtatttttgtttttcttgtcttttctgtctcagcctcctgagtagctgggactacaggcacacaccaccacacccagctaaatttttgtatttttagtagag

SEQ ID NO: 65849 - DNA, 601 bp, Human
atgtgaaggatccaaaattattgaaaagtaattgctagctaggtgcagtggtttatgcttgtaatcccagcactttgggaggccgaggcccacggatcacttgagcctttgagtttgagaccactgcattccagcctgggcaacagagtgaaattctgtctcaaagagaaaaaagaaaaagtaattgcttgattgcatttatcatagcatttagttagaggagaggagaggcagatgccaaatgtatgttattttttgttgttcatttaagtttcttggtatgtcactggtggcttttacygtgcgtcctttttaagagtgggttcatggtgtgtttagtcaaatgcaatataacttactctggagtgcacactgggttagattagtattttgatttactctgctgctatttaatgaatacatagaaagataaagaagaatgctgtagcagtgaggagtattcagaacttggaggtgttagaaaggagaactttgatattttatattgagtgctgatctcatttagaactacccaccttactgacactttgcttcaaatattggttttgggaaaatccgattatgatgaaagtctgtttat

SEQ ID NO: 65850 - DNA, 601 bp, Human
ctgaggttggtgttgaacccctgggctcaagtgatcctcctgtctcagccacctaaatagctgggactacaggtgtgtgccatcacatctagctaatagagttgttttgaattggttaaatttaagcctgtaacccatacgtgtaatagaaatgtatatttttggtgatttatgaatacatagtattaggccaaggtttagttgtgattgatatacagctattagtacttacatatactcttaagtaatcctattaaaatcattttaacacaatgggatcttaatggcatatctttaaacmtatcttataaagaaatgctgctttaacttagatgccaagcacatattttaatttaccaattagaagttctatatgtattcaagtgaagagtgtttcaccttaataatacatttcatacagattgttgaaattcatcccattcccccttccctccccagtttttggccatatggacacaggcaggactctcaggagtgccaaggatttaagccctcaaattttacctgcctaccatttcagcatgcgatagggacacatggaaggcagcttaaagtaaaggctttaaaaaattttttttgc

SEQ ID NO: 65851 - DNA, 601 bp, Human
agagtcggggtttcaccatattggccaggctggtctcaaactcctgacctcatgatccgcctgcctcggcctcccaaagtgctggaattacaggtgtgagccattgtgcccaggctgagatgatcttatgatattgcccagcctggtctcaagagatcctcctgacttggcctcccaaagtgttgggattataggtgtgagccaacacactcagccgtgatgcactgtttgattctgataatcaggtatgtgtaattagccttaaacctttttcttccttctttcctttcttttcttttcttttttttttttttttttgagatggagtctcactctgtcacccaggctggagtgcagtgatgggatctcagctcccggattcaagcgattctcctgcctcagcctcccaagtagctgggattacaggcgtgtgccaccacacctggctaatttttgtattttagtagagacagggtttcactatgttggtcaggctggtctcgaactcctgacctcaggtaatctacccgcctcggcctcccaaagtgctgggattagaggtgtgagccactgcgcttggcaacctttttatttcttaaca

SEQ ID NO: 65852 - DNA, 601 bp, Human
ttttttttttttttttttgagatggagtctcactctgtcacccaggctggagtgcagtgatgggatctcagctcccggattcaagcgattctcctgcctcagcctcccaagtagctgggattacaggcgtgtgccaccacacctggctaatttttgtattttagtagagacagggtttcactatgttggtcaggctggtctcgaactcctgacctcaggtaatctacccgcctcggcctcccaaagtgctgggattagaggtgtgagccactgcgcttggcaacctttttatttcttaacrgtagattgatatatcctctagcttactaagtaacctttgaatttttattatttctttaattgtaatataaaaagctgatcttttattaagtgccattccgtctcctaaagatgatgcctataatgattaaatagtaaaggtcagtgtcatctacttagcaagatttacccagtaagtctttttttctccagatgctatttttgttgacttatccttgctagttgtattatctctaatatgaccattaatggacactggttaacaagatatgttcaatatttaatgtattctctttggtat

SEQ ID NO: 65853 - DNA, 601 bp, Human
ttaatggacactggttaacaagatatgttcaatatttaatgtattctctttggtattttgtaagatggaaaagactagcattgggatgaataattgcataatgatcatagaatcatatttaaataaatataccaaagaatatataactaaagggcaagtttttttgttttatgtttttaaatttttatcatgcgtactgtggtaggcagcctttattatggcccccaattatccctccctcctggtatgcatacccttagtgtaatttcctccccttgagtgggggctattgaatagaatwcagcaaaagtgatgggatgtcacttctaagattaggttataaaatactgtggcttctctcttgggattctggctttctccctctccctgggaccactagctaccatatcctgagaacactcaggcagtctgtagtgatgtccatgtggttaaaaacgaggtctgtcagtaaacttggatgcagatcttcggtgtgagtgatcttggaagcagattctccaggcagagttgagcctagaggtgaatgcaaatgcagtagacagctttactacaacttcatgaaagcccctggccgggtgcg

SEQ ID NO: 65854 - DNA, 601 bp, Human
agtaatagataactaaaacatctaccacttattcatgtaataaatacttattgattgttcactatttacaaggcactatcataagtacattgggacatagcagtgaataaaatagaggtatctgttcttgtgcagcttatttctttttctgggacagggtcttgcactgtcacccaggctggagtgcagtggtgtggtcacagctcactgcagcctcaacctcctgggctcaagcagtcctcccacctcagcctcctgaggagctgagactacaggcacacaccactatgcctggctaacwttttttttttttttttttgagatggagtctcgctctgtcacccaggctggagtgcagtagcgcgatctcggctcactgcaacctccgtctcccaggttcaagcttttcccccgcctcagcctcctgagtagctgggactacaagcacccaccaccatgcccggctaattttttatttttagtagaggcagggtttcaccatattggccaggctggtcccgaactcctgaccttgtgatccgcccacctcggcctctcaaaatgctgggattacaggcgtgagccaccgcgcctggccatt

SEQ ID NO: 65855 - DNA, 601 bp, Human
tagaggtatctgttcttgtgcagcttatttctttttctgggacagggtcttgcactgtcacccaggctggagtgcagtggtgtggtcacagctcactgcagcctcaacctcctgggctcaagcagtcctcccacctcagcctcctgaggagctgagactacaggcacacaccactatgcctggctaactttttttttttttttttttgagatggagtctcgctctgtcacccaggctggagtgcagtagcgcgatctcggctcactgcaacctccgtctcccaggttcaagcttttccccygcctcagcctcctgagtagctgggactacaagcacccaccaccatgcccggctaattttttatttttagtagaggcagggtttcaccatattggccaggctggtcccgaactcctgaccttgtgatccgcccacctcggcctctcaaaatgctgggattacaggcgtgagccaccgcgcctggccattctggctaatttttaaatgaaattttttgtagggatggggtctccatatgttgcccattttggtcttgaactcctgggctcaagtagtctcttgccttggcctcctaaagtgt

SEQ ID NO: 65856 - DNA, 601 bp, Human
tttgatagggaaaaactgctttctatctcaataaataaaagccagggtcccacagaactggctttagaaggagattctgcacatggggtggagtaattggagctcacagcaaggacttttgttcctgaagattcactttcccctggggaatcccttgctgacctcagaggtgctgctttcttttaattttctgccccagaggagagtcttctcttaatactcctgcagaacacagctgagaccaggctgtaacatctggtatgttactaaaggctcagagatgaaaaagggaaataagtayagagttactattatgcttctgtaatatctggctcacgagataaaacacacacctctgtaatttgtggtattctattgggatacctcccttacttgacccacaacacatatgttttctagtggcagaagccatctttatttctgctacttgggagtgcctccagcatatccagatttctctaaatacagaggagaaggtccagagggaaaaaaaaaattctttatcttaccagcctgtggttatatctgatacaggccccacttctttcatgtgatcaacaccaggtctatataaccctta

SEQ ID NO: 65857 - DNA, 601 bp, Human
aatacagaggagaaggtccagagggaaaaaaaaaattctttatcttaccagcctgtggttatatctgatacaggccccacttctttcatgtgatcaacaccaggtctatataacccttaggggagaccacagttacccacggaatatctaattaccattcacagaagagaaacacaaacagtacaggggtgttgggttagaggtagggaggccttccttttaccatttaccacagatcatataatctctgattatagctccacaacttggaacaaaatagctctcagtaaatattcccttscggttcttttaagcttaatgccatttgatacctgagaaaactacagtttagtttgttgcagttttatttctgagagttttgtttgaggagatctagtacttaatcaggtccaaagttaggctgaggaaagtggtgataagggtaggttggtgtgatcaagatagaacacctggtgcctagagcaggctgagtttaaatgttaaagggggtgtcctttgtaacatataacattaattatagaagaactaggttactgattcaaggtccttgggtttgtttctaaggaacagtgcaatacag

SEQ ID NO: 65858 - DNA, 601 bp, Human
aagctctgcctcccgggttcacgccattctcctgcctcagcctcccgagtagctggaactacgggtgcctgccaccgtgcccggctaattttttgtattttttttttagtagagacggggtttcaccgtgttagccaggatggtctcgatctcctgaccttgtgatccgcccgcctcggcctcccaaagtgctgggattacaggcgtgagccactgcgcccggccaatttttactattttttttgagacggagtttcactcttgttgccggggctggagtgcaatggcgcgatcttggctyaccgcaatctctgcctcccgggttcaagcgattctcctgcctcagcccgccgagtagctgggattagaggcatgcgccaccacgcctggctaattttgtatttttagtagagacggggtttatccatgttggtcaggcggctagtctcgaactcctgacctcagatgatctgcccgccttggcctcccaaagtgctgggattacaggcgtgagccaccgcgcctggcactgggccttctttttttttttttttttttttttaaagactttattgagatataattaacatatcatatgatt

SEQ ID NO: 65859 - DNA, 601 bp, Human
gtgggagggtcacttgagcttgggaagctaaggtggttctagccttggcaacagagtaagactctgtcattaaaaaaaaaaaaaaaaaaggctgaaaaatagcacaaatatcacaaaatttagaaaaatagcttaacattttaattaactgatatggtgtcatagttcatttttttctgtatttttggcttcatactcctctaaagagttttatattatgactttgtaattttttttttttttttgagacaaagtctcgctctgttgcccaggctggagtgcagtggtgcgatctcggctkactgcaacctccgcctcccgggttcaagcagttctcctgcctcagcctcccgagtagctgggattacaggcgcccgccaccacgtctggctgattttttttttttgtattgttggtagagacagggtttcactgtgttagccaggatggtctcgatctcctgacctcatgatccactcgcctcggcctcccaaagtgctaggattacaggcgtgagccaccgcgcccgaccaatgactttgtaatattttcaatagagacagcacaaagataattcagtcttccttttagcttggtggcc

SEQ ID NO: 65860 - DNA, 601 bp, Human
cccactttcttcattcttatcttagggtgctctagctttttgcatttattagacttgtatgttttttgtacttggtaattaatagtcaaaattagaagcacaatctaaaacttcagaagggacttcagaagtcatttggcctatttcttcagttagagataagaaaactgtggccccaagatgtggagtgacttgactaagtgatggcaaagacggagctggatctttggctttctctcactttgtacagtgttttcacatatgcagctgcttcatgccctatcccctaacttgtatcctaaaaaaaaattgagatataatttacatataaaatttaccattttcaaatgtacaattcagtggtcttttagtatattcatcattaccactatttcagtccagaacattttcattactccaagaaaccccttacatgttagcagttacatttccccatccccccagactctggcaatcaccattctttctgtttgtatggatttgcttattctgaacatttcacataaatggaatcacataatatgtggtcttttatgtctggcttcattcacttagcatgtttccaaggttcatccatgtg

SEQ ID NO: 65861 - DNA, 601 bp, Human
aatcgtacatcagggagaaagcttaaatcttgattttaaatgactgttttgggcattactttcagaataattattagaagtgccttgattaaacttagataactaacgttaaaatatacgaaatcagatagtaaagtgtttcttgggaaatggttgaagtaaccagttttgatattatgtttgataggtgcaaaaattagtatttcgccaggggcggtggctcacggctgtaatcccagcactttgggaggccgaggtgggcggatcacctgaggacgggagtttgagaccagcctggtcwgcatggtgaaaccccatctctactaaaaatacaaaaattagccgggcgtggtggcgggcgcctgtaatcctagctactctggaagctgaggcaggaaaatcacttgaacccgggaggcggaggttgcagtgagtcgagatcgcgccattgcactccagcctgggcgacagagcgagactctgtgtcaaaaagaaaaaaaaattaatatttcttggaaatcaagtctgttggggaaactgttctagactggttgcaattatatttaattttgaggtgagttatcctagtcctaagtaggga

SEQ ID NO: 65862 - DNA, 601 bp, Human
cttgtttaattatctggtggtgaaaattacatacagataatatgtgttcctgaagagaaatgcacctctgacataattctcctccttttatttggaggggtgggtgttatatcgataaagacggtgtatattctctttattgatgtccttgtcacataaaggagttcagttaatgtttgttaataataactacttggtatctgtagttgagaggttttaaatagataatttttaaaatgagctatatcaccaaccccaaatagtgttaaatgtaacttttatactgcaaccatagcatcamcctaagggaaaaaaaggagtttcataactctaaaggaaggaaggtattgtggagcagtgaatatattaagtataagtgtttaatattctgttttaaaattttctttaaattaggaaatgggccaaagttaatggattgatgtggattgtgaggctaacgtcagaatactgtatattagccactgaatatttatttctcttgtgtattttggtgggattccttacataggtttggcaacaaaactagaaaataaatttcctttcagtgatacaaaattctgttgggctagctgaattagat

SEQ ID NO: 65863 - DNA, 601 bp, Human
gagtagaagcaaatcagaaaagacttgaagtgagaggatatctactaagggaatttggcctaggcagacagaagttgtccaggaaaaaggtactatgcacattgtttgaaatcgagatcaggctgggcgtggtggctcatgcctgtaatccccccactttgggaggtagaggcaggaggattacttgagctcacaagtttgagaccagcctgggcaacatggcaaaaccctgtctctacaaaaaatacaaaaactagccaggtatggtagtacacacctgtggtcctagctacttgggagrctgagatgggaggatcacttgagcctgggaggttgaggctgcagtgagctgtgattgtgccattgtactgcagcctgattgtgccatcgtactgcagcctgggaatgacggagcaagaccctgtctcaaaataaataaataaataaaaatcaggagatcactatacttaagaaaactaagaattggcttgaaaattagtgttactgtttgatcttgatttcaatctatggagagtcaggggtgaccttgcctcctcacttgttaggggaactgagaaaaatatgtctaattcatattggg

SEQ ID NO: 65864 - DNA, 601 bp, Human
agcaagaccctgtctcaaaataaataaataaataaaaatcaggagatcactatacttaagaaaactaagaattggcttgaaaattagtgttactgtttgatcttgatttcaatctatggagagtcaggggtgaccttgcctcctcacttgttaggggaactgagaaaaatatgtctaattcatattggggatataagcaagggtagggttagaggaaaaacagaattatatagcctgtattaaactgggtcaaattgaattgtgtaatgagactttatgcttataatttactacctgatayagtaaaataaaattttatcccttcctggagtgaggagatacttttttttttttttctgtcagttatcaaagtggttcgtgcggccgggcacggtggctcacgcctgtaatcccagcactgtgggaggccaaggcaggcggatcactaggtcaggagttcaagaccagcctgaccaacatggtgaaaccctgtctctactaaaaatacaaaaattagccatgcatggtggcgcctgcctttaatcccagctactcaggaggctgaggtgggagaatcacttgaacccgggaggcggaggtt

SEQ ID NO: 65865 - DNA, 601 bp, Human
aatttagatgaagctagagatttaacttgtcttttcctggaaacaacgtgagagattaagcgctcaccaccacgcccagctaatttttgtattttagtagagatggggtttcaccatgttggccaagctggtctcgaactcctgacctcaagtgatgcgcctgcctcggcctcccaaagtgccgggattacaggcatgagccactgcgcccggcccaaatatctatttagtgttcaaatttctagttgtctcaaatggaattttttttttttggtaatttcatttgaattagaattgaaayaaggtctacatattgcaagtgattgatatgtctcttaagtttctttcagtccataggtatactcttatctctctctctctttttcttataatgtgtttgttgaagaaactggatcatttatcctgtagaatttctactcagtctggattttgttgatttcagttccatggtagagtttaataggtttcttggttttttttttgtatttcctgtaaattatttgaatttacacataattgaatcttaaaattgagaaggaaaaccatgcgggccttttgctgtctcaagggttgcagttaa

SEQ ID NO: 65866 - DNA, 601 bp, Human
tgcatacatgcatgcatgcctgatccaagaacctgatgaattgaaccgttttccaatgaaggtgacattagactaatttaatgataagacaaaactaaactttttttagtgagaaaaacatgctttcaatttatttgtattagttagatctcattttcatcttacgtagttaataaagaatggatggacaccagggtccgaagccaaggttctcaaagttaagcatttatcaaaatcacttggaaggcttgcagacagattgctggacatcatccccagagattctgattccatatgtcarggtcgagtctgagatttgcatttctagcaagttcccaggtgatatcagtgctcctggttaggggaccacactttgagaactattaggctgaagttcaaggatctgcattagaattacctttggagctttaaaaaactcttgaagatgccagtcagaggcctctgcatctatattttaacatgttccataacaattctaatgcgcaccccaggtgagaactgctgctgtaattatttatagtttattcctccatatttcccaagaaatgctcattcattattcatttcaaaatgttaaaag

SEQ ID NO: 65867 - DNA, 601 bp, Human
tagcagaacacatgataaagctattataaatcagtacatcttttattaataaatgtgctttgattttattaatcacaacagcatctacatatatttgaaaaatagtagctggagccattattcagtctacaagcagtattggtgcatgtgacttttgaacccctgtgataaacttgaaagcctccaagagtccatggcctctactttcagggaagtaggttgactattattgttactagcgttaccacttgctaataatgcaagtacacaggccagttacaatgggtatttgtacaagaaytaaggaattttccttcgtattgccctagtggggaagggacaagtcttatcttcctatttgaattatacttgtaaatgaaatgtttaacaagtaagttcttggtttttccttgacaatctgatgatctgtttttctttattctttttttttttgagacggaatcttactttgtcgccaggctggagggcagtggcgtgatctccactcgctgcaacctctgtctcccgggtccaagtgattcttctgcctcagcctcccgagtagctgggactacaggtgcacgccaacatgcccagctaa

SEQ ID NO: 65868 - DNA, 601 bp, Human
tgcatgtgacttttgaacccctgtgataaacttgaaagcctccaagagtccatggcctctactttcagggaagtaggttgactattattgttactagcgttaccacttgctaataatgcaagtacacaggccagttacaatgggtatttgtacaagaactaaggaattttccttcgtattgccctagtggggaagggacaagtcttatcttcctatttgaattatacttgtaaatgaaatgtttaacaagtaagttcttggtttttccttgacaatctgatgatctgtttttctttattctttttttttttgagacggaatcttactttgtcgccaggctggagggcagtggcgtgatctccactcgctgcaacctctgtctcccgggtccaagtgattcttctgcctcagcctcccgagtagctgggactacaggtgcacgccaacatgcccagctaatttttgtatattttttagtagagacggagtttcaccatgttggtcaggatggtcttgatctcttgacctcatgatccgctcaccttggcctcccaaagtgctgggattacagacgtgagcccaccacgcccagccctgatga

SEQ ID NO: 65869 - DNA, 601 bp, Human
ctgattaggtactgtgggagatacagatatttcaaatacagataaaccttaccttcaaagagcttgcagtctagcaatatacatgaaataatagaggacacagtagagtttaatgtaatgctggatgatataaagaagctgtctaaatttcaagaagaaatcactgagtgctagagtttaggaaaggcttcctacatgagctgcaacttgagcttagccttgaaatagtgaaaataattctataggcaagacatgaagaaaacattaaaaaagactagattgcatgtaatgtgaagagtgrataggattgtggttgaatctggagtaagtcagccctgttttgaagcttttgcattaaagcttaagttggcataggccatgtatcttgtaggtatggctaacatctgtcagatctggttttggcagaatagtaccacactacctagtaaaatcctttttcatgaggaatactctgcaggggaagtaagagaacattagaagtagtttttaggcatcttcatggggatgcccattgatttttgccaataatgattgcttctagataattcatttttcctccactatatgtagagactgtcaa

SEQ ID NO: 65870 - DNA, 601 bp, Human
tggttttggcagaatagtaccacactacctagtaaaatcctttttcatgaggaatactctgcaggggaagtaagagaacattagaagtagtttttaggcatcttcatggggatgcccattgatttttgccaataatgattgcttctagataattcatttttcctccactatatgtagagactgtcaaaataataaaaaaggaaaggaaaaagaatgttcaatctgcctgacagaaacattgctaaaactttttttttgaaacggagtctcactctgtcacccaggctgaagtgcagtgacrtagtcttggctcattgcaacctccgcctcctgggttgaagcaattcacctgtctcagtctccctagtagctgggactacagttgcatgccaccacacccagccaatttttatatttttagtagagacgaggtttcactatattggtcaggcctgtcccaaactcctgacctcaggcgatccacccgccttggcctcccaaagtgccaggattacagatgtgagccaccatgcccctccagctaaaatatttttatactgggccattgtttttaagaattggtctttaaaaatggcctatt

SEQ ID NO: 65871 - DNA, 601 bp, Human
ttagtagagacgaggtttcactatattggtcaggcctgtcccaaactcctgacctcaggcgatccacccgccttggcctcccaaagtgccaggattacagatgtgagccaccatgcccctccagctaaaatatttttatactgggccattgtttttaagaattggtctttaaaaatggcctattttgctgtggggaaaaaatcaatttcagtgaagtttacagttttatgaacctgtgcttctcctccaattccttataccgtcttcatactcctctagtttgattctctttactttctayttagttgaaattactgttataattccagcaaatacctttccatactgtttgaattttctaaccatggccatgtgttactttttaatttaatttaatttattattatttttttttagaaatggagtcttgctatgttaaccaggcaggtctcgaactcctggcctcaagcaatcctcctgccttggccttccaaagtgttgggattataggtgttgagccactgcaccctacttttatttatttaaaagaagcttcaacagatattacctggttagtaggattacaggattattttaatgt

SEQ ID NO: 65872 - DNA, 601 bp, Human
aaaataatggggctgggcacagtagctcacgtctgtaatcccagcactttgggaggccgaggcgggtggatcacttgaggtcaggagtttgaaaccaagcctgggcaacatggtgaaaccctgtctctacccaaaatacaaaaatttagctgagcacaggcatgtggcatgcacttgtggtttcagctactcgggaggctgaggtgggaggattgcttgagcctgggaggtgaaggctgcagtgagccataattgtgccactgcactccagcctgggtgacagagggataccctgtctccaaaaaaaaaaaaaaaaaaaaagaaagaaaaaagagaataatgaattggatatttaagcaaagatgtccaatatttaagtaaataaagatgtctaggtatagggattaattctgactgtaaggattacagaaataaaattcatggaaaacatggcgtgtgggcagggctttgaaggagggttagaatttcagcaggtggagatgcaggcttggggtattataaagaaggcagatgcagggaagtgcaggctgttttaggaagcagcaagtagttctaggtggggctggtgggagaagagact

SEQ ID NO: 65873 - DNA, 601 bp, Human
cgggtggatcacttgaggtcaggagtttgaaaccaagcctgggcaacatggtgaaaccctgtctctacccaaaatacaaaaatttagctgagcacaggcatgtggcatgcacttgtggtttcagctactcgggaggctgaggtgggaggattgcttgagcctgggaggtgaaggctgcagtgagccataattgtgccactgcactccagcctgggtgacagagggataccctgtctccaaaaaaaaaaaaaaaaaaaaagaaagaaaaaagagaataatgaattggatatttaagcaaagmtgtccaatatttaagtaaataaagatgtctaggtatagggattaattctgactgtaaggattacagaaataaaattcatggaaaacatggcgtgtgggcagggctttgaaggagggttagaatttcagcaggtggagatgcaggcttggggtattataaagaaggcagatgcagggaagtgcaggctgttttaggaagcagcaagtagttctaggtggggctggtgggagaagagactagtgagggcagatcacagccaagctggggtgctatgggaaaggagtttggattttataccat

SEQ ID NO: 65874 - DNA, 601 bp, Human
ctctgcctcctgcgttcaagcgattctcctgcctcagcctccaaagtagctgggattacgggcctgtgccactacgcctggctaatttttctatttttagtagagatgggttttcgccatgttggctaggctggtctcaaacttctgacctcaagtagtccacccgcctcggcctcctaaaatactgggattacaggcatgagtcaccgcacccagccaaaagtttgatctttcaataaatatttgttaactgatgaataaaagagtgataggattaaatctttgtttggaagagaaaacwtttatagcaggagggactggaaataggttatttatagtcgagtgaattagagcagaaacagtaaaaatagaaacatatagttaaatgcagaggtagaggtagacttgacaggatttggcaagtgattgggtttaactaatttttaacaaaaaggggaatagaagaatttaaggttttgaatttgggaaaatgggagctatgttcttccttgctctcttttttctttagttttcttttcttttttttttgtatttttagtggagacatggttttcaccacgtttgccaagctggtttttga

SEQ ID NO: 65875 - DNA, 601 bp, Human
gcctcccaaagtgttgggattacaggtgtgagtcactatatccagtccttccttgctttcttgaataaagcatttggaattgagtcatccttttattagggagactgcattattatgaataagaaccttgagctatataggatttattacccctacaataaatggtcaagtttgctataactggccaggcatagtggctcatgcctgtaatcccagcactttgggaggctgaggtgggaggatcacttgagcgcaggagtttgagaccagtcgggcaatgtagtgagacctcgtctctacaaaaaaaaaaaaaaaaaaacttaaaaaaaaaatcagcttagtgtggtgatttgctcctgtagaggctgtggtaggaggatcatttgagcctgagaggttgacgctgaagtgagctgagattgtgccaccgcactccagcctgggcgacagagatcctgtcgcaaaaaaatttaaaaaaagaaggccaggccaggcgcaatggctcacgcctgtaatcctaacactttgggaggccgaggcgggtggatcacctgaggtgaggagttcaagaccagcctggccaacatggtgaaactccatc

SEQ ID NO: 65876 - DNA, 601 bp, Human
gttttatagtgctttttaattcctatggcatttgcagttttaagaaaaatcaccttacatgaataaggtgttaagtgctctccgagagtgtcctggtttattacgttgtactttaataagaattaataagtggttgagtgatagagttgttgaataaaggataaagtagcacactaaagcttaagatcattgatgtaatgaaagtaaaccaggctgggaatctgaacacccggtttatagtcccagtcctgccactgtaggacattgaataggtgatgttactcatctgaaattgtatctrttttgataacatggggataatatctcttctctctacttgaacaatgaggtaacactgatgaccaagtcatgtccttccatgtgtgtgggaatatgtaatacatttctcaggaatacatatattaacactatgattctcataccttcacaaaaataaaaatgaaaaattcaactttatgccaatgcaaattactatcatcactcaagtttgattcttcctttccagatccaggagtggaataaatctttacagtacagtttaaatctttagaggaaactcccatcaattttctcttctttt

SEQ ID NO: 65877 - DNA, 601 bp, Human
cgtggcatctgggaggtaggtagtcttccaggcagaagaaaccacaaatcctaaggtcctggcaaatagcatgcttaccatgtttaataaacaacgaggagacccaggtggctggaacaggacaggcaattgcaaggactttgccctttattctgaatggcaggaaatgtctttggagggtttctggtcagtggatgatctaactgtacttttagtaggatcatgctacctcctttactgataactaacttcagttttcagttcagaagcaggttataaagatagattcatatgagaacctttttttttttttttttttttttgagacggagtctcactctgtcgcccaggctggagtgcagtggcatgatctctactcactgcaagctctgcctccagggttcaagcgattctcctgcctcagcctcctgagtagctgggactacaggtgcccgccaccacacccggctaagtttttgtatttttagtagagacggggtttcaccatgttaaccaggatggtctcgatttcctgacctcgtgatccacccgccttggcctcccaaagtgctgggattacaggcgtgagccaccacgctcg

SEQ ID NO: 65878 - DNA, 601 bp, Human
ctcctgcctcagcctcctgagtagctgggactacaggtgcccgccaccacacccggctaagtttttgtatttttagtagagacggggtttcaccatgttaaccaggatggtctcgatttcctgacctcgtgatccacccgccttggcctcccaaagtgctgggattacaggcgtgagccaccacgctcgggcccttttatgatttcagttcttcaggaaaatgtgtttggttccaggtacctcatttaaaagaaagttactgatactttggaatctgtttgggagaggatgtctagaatgrtgaggaactggtaaactatttaatgtgaggaacagtttaaggatctggggatatttaacctttggtaattttgcttctgacccatgttaacactattctgtttttctctcaagctgtagtatgaattcgaccttcctttctttctcccccttcattttcagcagttttctattttttaatttttaattttcatttcttgagacaaggttttactctgtttccgaggctggagtgcagtggcatgatcacagctgactgcaacctccacctcctgggcttaaatgatcctcccacctcagc

SEQ ID NO: 65879 - DNA, 601 bp, Human
tggtctcgatttcctgacctcgtgatccacccgccttggcctcccaaagtgctgggattacaggcgtgagccaccacgctcgggcccttttatgatttcagttcttcaggaaaatgtgtttggttccaggtacctcatttaaaagaaagttactgatactttggaatctgtttgggagaggatgtctagaatggtgaggaactggtaaactatttaatgtgaggaacagtttaaggatctggggatatttaacctttggtaattttgcttctgacccatgttaacactattctgtttttckctcaagctgtagtatgaattcgaccttcctttctttctcccccttcattttcagcagttttctattttttaatttttaattttcatttcttgagacaaggttttactctgtttccgaggctggagtgcagtggcatgatcacagctgactgcaacctccacctcctgggcttaaatgatcctcccacctcagccttctaagtagatgggattacaggtgtgagccactgaacccagccttttttttcttttaagctccattctttaatgggccttgtcttttttttttttttttttgagt

SEQ ID NO: 65880 - DNA, 601 bp, Human
tgtgccagtattatattttctggtggcctgtagtatatttttcatacttaacaatggtaagagacaactgctgcatctattccaatttccagagtatctgctaaaacaatccatgatccagttcatgtttgtgattcccacttgtattcttactagatgatatttgatagttaatttactgtagttttctggttaaagtgaaatttactaaaatagtcttatggtatttgagtttcaaaattttaaagtaaatattgttagattgagttggctctaagaaactaaaaataagagagtaagraaagttccatactcttaactaaaacccctttgtagctagaaatcttcaggctttgtttatatttaccttgaaatttttaaggctagtaagcattttatgtgtggttctccttcctttcagttacattttcaggctaaattattccattgttttatgttttccgggagagtttatatggatacaacaccttatataaataatggcattaaagacttttaatctcaacttggaaagaaagagaatagtcatggtgtgattgatctgaaggtcacttaccttatagcctcaactagacacaat

SEQ ID NO: 65881 - DNA, 601 bp, Human
ttggagatggagtcttgctctgtcgcccaggctgagtgcaaaggtgcgatctcggctcactgcagcctccacctcccaggttcagacgattctcctgtctcagcctcctgagtagctgggattacaggcgcgtgccactacgcccagctaatttttgtattttcagtagagagagggtttcaccatgttggccaggttggtcttgaactcttgacctcatgtgatctgcctgccttggcctcccaaagtgctggaattacaggcatgagccaccacacccggccgcatttaatcttttttytttctttctttctttctttttttttttttttttttttttgggacagtgtccctctgtcgcccaggctggagtgcagtggcgcgatcttggctcactgcaacctctgcctcccaggttcaagtgattcttctgcctcagcctcccaagtagctgggattacaagcgcctgccaccatgcctggctaatttttgtatttttagtagagactgggtttcaccatgttgaccaggctcatcttgaactcctgacctcaagtgatccacctggcttcggcttctcaaagtgctgggattacaggc

SEQ ID NO: 65882 - DNA, 601 bp, Human
tgactcttgagtttataatatagcccttctctggtgtccttggggatattgggggtgggggagaaataatatagcctttaaaaaataatccattgtataactattctaatgtcccttttgtttatttttatttttcagagacagggtcttgctctgtcaaccaggctggagtgcagtggtgcagtcatagctcactggagcctcaaattcctgggctcaagcaattcttctgcctcagcctcccagatagctatgactacaggcatgcaccaccatgcccggctactttttttatttttakttttttagaaacaggatcttgctgtgttgcccaggctggtttggaactcctagtctcaagtgatactcctgttttggtctcccagagtgttggaattatagctgtgagccactgtgcccaaccccatttgttttctttcttccttcctatttgtaaaatcttagcattggtaaggacctgagaattcagttaatgtaaggacccacgtactagaagaatcctctctctggcatctacaacagatgggcattcagcttgagtgaatatttttgatgataatctcactcttcccaagcagct

SEQ ID NO: 65883 - DNA, 601 bp, Human
agaaataatatagcctttaaaaaataatccattgtataactattctaatgtcccttttgtttatttttatttttcagagacagggtcttgctctgtcaaccaggctggagtgcagtggtgcagtcatagctcactggagcctcaaattcctgggctcaagcaattcttctgcctcagcctcccagatagctatgactacaggcatgcaccaccatgcccggctactttttttatttttagttttttagaaacaggatcttgctgtgttgcccaggctggtttggaactcctagtctcaagwgatactcctgttttggtctcccagagtgttggaattatagctgtgagccactgtgcccaaccccatttgttttctttcttccttcctatttgtaaaatcttagcattggtaaggacctgagaattcagttaatgtaaggacccacgtactagaagaatcctctctctggcatctacaacagatgggcattcagcttgagtgaatatttttgatgataatctcactcttcccaagcagctcatttaattattagcaatttcttccttttactttatttagatgaaaactatgtctttgtaa

SEQ ID NO: 65884 - DNA, 601 bp, Human
ttttttatttttagttttttagaaacaggatcttgctgtgttgcccaggctggtttggaactcctagtctcaagtgatactcctgttttggtctcccagagtgttggaattatagctgtgagccactgtgcccaaccccatttgttttctttcttccttcctatttgtaaaatcttagcattggtaaggacctgagaattcagttaatgtaaggacccacgtactagaagaatcctctctctggcatctacaacagatgggcattcagcttgagtgaatatttttgatgataatctcactmttcccaagcagctcatttaattattagcaatttcttccttttactttatttagatgaaaactatgtctttgtaatttctgtgggctaatgaattctgcccttaggagtcacatgaaattcagcagctcttgaaatttgttagagcagcaatcattttcctgctttgaattctctttttctaggctaaaggtcccaatatcattcagttatttgttttatgacgtggtttcaaattgcatcattatcttctagctctgacagattttttctctctaaaatagattgctcagaaccgaatgt

SEQ ID NO: 65885 - DNA, 601 bp, Human
gcattatttatttattttttgagatggagtcttactcttttgcccaggttggagtgcagtggtgggatcttggctcagtgcaacctctgcctcctgggttcaagccattctcctgcctcagcctcccaagtagctaggattataagtgtgcaccaccatgtgcagctaattgttgtatttttagtacagacagagtttcaccatgttggccaagctggtcacaaattcctgacctcagttgatctgcctgccttggcctcccaaagtgctgggattacaggtgtgagccactgtgcccagyggttttttattttttttcttctcagtgagctaatttgaagagtaatacctagaattaaatcatcaaacttcatccctaaatggtgattataaaggaaattttattaatgctgccaaactgcaatgtttttgtgaagttttcaactcaagaagcattaatggagcactgactcaatgttacagagatgtaaaaaaaaatgaaagataaccattcagtcttttcagtctgttcagtatgtttttctttttttttttttttttaaaggtttgatttgtctgaaattaacagatgcacactttt

SEQ ID NO: 65886 - DNA, 601 bp, Human
ggattaggattgagatggaacggtaactcgtcactttttcttcagtgttgtgtagattctttgtttgtttgtttgtttaaatcaaaagacctctttctgacattaagtaaatggatacctccttttggattttatatccagaatgaaaatagtgtcatttacataggaagagcttgtttgtagagcatttatcctgtttttgctgcttgacttctttatatcttttcctctgtacccgtcctatcatttgtaacacgaggaacatgactgcatggcatttgtctggaagaacatgactgcrtggcatttgtctagagaagtatatttgagcttttagtaagtgatccatagggtttttttttctttttgctatttatttatttgtttaattcatattaacctcagagctaactgaaagtatcagcgagctttatcagtttcattttatattctctttttttttttaagaacatagatgcaaactctccttaatcattcatttttatgttttttcttgtatagactgagttgtagcatctttgctggatactgcattgtttgaattcctgattgttttctagcatttaatgtatggtattaa

SEQ ID NO: 65887 - DNA, 601 bp, Human
agattctttgtttgtttgtttgtttaaatcaaaagacctctttctgacattaagtaaatggatacctccttttggattttatatccagaatgaaaatagtgtcatttacataggaagagcttgtttgtagagcatttatcctgtttttgctgcttgacttctttatatcttttcctctgtacccgtcctatcatttgtaacacgaggaacatgactgcatggcatttgtctggaagaacatgactgcgtggcatttgtctagagaagtatatttgagcttttagtaagtgatccatagggtttttttttctttttgctatttatttatttgtttaattcatattaacctcagagctaactgaaagtatcagcgagctttatcagtttcattttatattctctttttttttttaagaacatagatgcaaactctccttaatcattcatttttatgttttttcttgtatagactgagttgtagcatctttgctggatactgcattgtttgaattcctgattgttttctagcatttaatgtatggtattaactgaagttggtttcagtagaattcttttgcctttctacctctgtgcctgttcc

SEQ ID NO: 65888 - DNA, 601 bp, Human
gtttgtttgtttgtttaaatcaaaagacctctttctgacattaagtaaatggatacctccttttggattttatatccagaatgaaaatagtgtcatttacataggaagagcttgtttgtagagcatttatcctgtttttgctgcttgacttctttatatcttttcctctgtacccgtcctatcatttgtaacacgaggaacatgactgcatggcatttgtctggaagaacatgactgcgtggcatttgtctagagaagtatatttgagcttttagtaagtgatccatagggtttttttttctttttgctatttatttatttgtttaattcatattaacctcagagctaactgaaagtatcagcgagctttatcagtttcattttatattctctttttttttttaagaacatagatgcaaactctccttaatcattcatttttatgttttttcttgtatagactgagttgtagcatctttgctggatactgcattgtttgaattcctgattgttttctagcatttaatgtatggtattaactgaagttggtttcagtagaattcttttgcctttctacctctgtgcctgttccttaattatg

SEQ ID NO: 65889 - DNA, 601 bp, Human
ttggattttatatccagaatgaaaatagtgtcatttacataggaagagcttgtttgtagagcatttatcctgtttttgctgcttgacttctttatatcttttcctctgtacccgtcctatcatttgtaacacgaggaacatgactgcatggcatttgtctggaagaacatgactgcgtggcatttgtctagagaagtatatttgagcttttagtaagtgatccatagggtttttttttctttttgctatttatttatttgtttaattcatattaacctcagagctaactgaaagtatcagygagctttatcagtttcattttatattctctttttttttttaagaacatagatgcaaactctccttaatcattcatttttatgttttttcttgtatagactgagttgtagcatctttgctggatactgcattgtttgaattcctgattgttttctagcatttaatgtatggtattaactgaagttggtttcagtagaattcttttgcctttctacctctgtgcctgttccttaattatgttttcatttattcttatgttcggcttgttttttacatatgtcccattatgtggcaaaatgtc

SEQ ID NO: 65890 - DNA, 601 bp, Human
ttcaattgtgtacgactactgccccttcacacatgccccttcatacttgcctttaaaaaacacccttcattacagaataaaaagaatttgacaagctcggtgaccttctgaaccaaatacacttgtcgatattgaggttcctccactgttgcaaaacatgttaaatggtgaactattcttgattagggatttgactgtcaaagaggatagacttcttatatttaccactaaatctaatatagcaaaactagcacatgcttcactttggctaatggatggtacttttgaaactgtcctcacttttttttttttaatcacttgtatacaattcatgcccccattgaatctgaaaattctagaactaatctactagtttatgtattagtgactggaaaaagtgaaacaccttataaatgtttatttgaagatttggcagacttggcagaagaaaatggattttgattgaatccccgaaccataatgacagatttggaatgaggtgcaatcaaggcttctaaaagtgaatttcaaaatgttatgaataaactttgttccattcaaccccaatgcatttggcagaaaattcagatgaatggattgg

SEQ ID NO: 65891 - DNA, 428 bp, Human
gtttgagccggggagatggaggttgcagtgagctgagattatgccattgcactccagcctgggccacagagccagaacctgtctcaaaaaaataaaataataaaatacatttaaaaaatttaaaaagcacattatgatgtcactaggggagggttgagaaaaaaaataaagtgcattataggtatggtggctcacttctgtaatcccagcactttgggaggctgaggcaggaggatcatttgagcccaggagtttgaaaccagcctgggcaacatggtgaaactccatctttaaaaaaaawttttttttttttaattagctgggcatggttgtgtgtacctgtagttccagctacttgggaggctgaggtgggagaattgcctgagcccaggaagttgaggttgaagtgagccgagattgtgccactg

SEQ ID NO: 65892 - DNA, 411 bp, Human
tggtgcaatctcggctcactgcaacctcgactgcctggcctcccgagtagcggggattacagacgtccgccaccaggcccagctagtttttgtatttttagtagagacagsgttttaccactttggccaggctggcctcgaactcctgacctcaggtgatctgcccatctcagcctcccaaagtgcttggattacaggcgtgagccaccgtgcctgtcctccaggagcttttaataaattaaaactgcatctgtctgaagaaaccagtgaagttaccgactggttcaaaaataattacgtgcacagtaggataagaagacacacaatggtgtttctgtttgatcaccagtattgtttccaccaaatttatggtctgcatatgagtacttgtgaaacaaatttctgcatgcc

SEQ ID NO: 65893 - DNA, 601 bp, Human
ctgtatttcatcttcacatcatttccattactggaggtataaattgtgtcaagacttttagagagttcgaatgtgttttatgcatttttcgcatatttgcaaatttgactccacaaggtccattttcacaacattgacttcgtgtgtaagcattgtgcatgtatgtaaaatgctctttgggcaactgtaatatgtggtggcagcccatcatggtttttttttctttttaatttttatttttattatttttattttttattttctttaaattttattattattatactttaagttttagggyacatgtgcacaatgtgcaggtttgttacatatgtatacgtgtgccatgttggtgtgctgcacccattaactcgtcatttagcattaggtatatctcctaatgctatccctccccccttccccaccccacgacagtccccggtgtgtgatgttccccttcctgtgtccatgtgttctcgttgttcaattcccacctatgagtgagaacatgcggtgtttggatttttgtccttgcgatagtttgctgagaatgatggtttccagcttcatccatgtccctacaaaggacatgaactcatca

SEQ ID NO: 65894 - DNA, 601 bp, Human
gactatatctttcaggattatgattggctcctgtcctaatcattacttcctaaatgtggcacagagatattatcaatggagatacccagaacactgaatctgggcacttgtcacagctgggtaggaaacttggatttgccatactctatgtttaaagattacaaagtctgattaagtgccaaaaagagtttttaaaaatgttaatggttcacttttcacatttaatgtgttgcatcatttgtttcattcattaattaacaaggatttatttgttgagcacttattgtgtcaagtatttccygctcttcatattccacttgctaaaagcagctttttatagtctttgtttctaggcattttgcagtacgttctcaaagtgattgtaatggtggttttctgtgcttcctactcaaaatgtgctcagtgggccagcagcattggcaacatcttattagaattgtagaatctcaggcccctttccagacctattgaatcagaccccttatagtgaagcaggatatttgcctgacctcttcatgggaattgtgacaggcgtaccttgtttactgagcctgccactctcaactccttgtgggaagga

SEQ ID NO: 65895 - DNA, 601 bp, Human
agtctcactttgggctgcagtctcatgcttttctgtttgagggtagggtttcgtcagagacccgtccttttctgcctagaatttctctgcccctttgtctgtatcaatagtggttttaaacaaaatttattttgaatttttctttcattatactggttaaagttgaaacaagaatgtaaactccatgatgacatagaccttgactgttttgtttactgttgtatttctagcacgtagcatcagtcctgtgctaggtgcctgataagaatttgttgaatgaatcaattagtatcatgcattygaagtaaatttacttgaataaatttagagaatgcctttgcagtttgtatttatcagatatattcagtgaaatcaattcatttttttaaaaaacttaggtttttttttttttttgagacaaggtgttgctctgtcacctaggctggcatgcagtggcatgatcatggctcactgtagcgtcagcctcctggattcaagtgattcttctgcctcagcttcccaagtagctggaactataggcacatgccacccatacctggctaatttttaaattttttataaatacgatgttttgctatgt

SEQ ID NO: 65896 - DNA, 601 bp, Human
tccagtcttacaacaaactatcagaattttacttttgcaattttaatagagaagtctctgcatcctaagaaatgtaaagaaaaagaacaataaagactgggggaacttttaaatttcatcgtctcttggtgtgtggagaattttgcagggaataattcctgcaaatcctacaccttcagattgataccctcaaaggacactaaaccacagtccttttttaaggaaggataaaactgtatttactgtatacagttctaggcattggatttaatatgtgatgtatttcactaaggtggcctcmgtgggtactattttaagctactctctctgtgtgcatatctttagtgactcaaggcattaatattttattcaggatgtgtagataagatatttttgtaatttaatggaaagtctcatgtttaatgggtttgaattctgtttgttggcaattaaatacctaagtatattaattttttagggtttagggttttgccaacagtaatgtgttttgcttataagagccccccttttctatcttctttttaatagcaacatcatgacaacagagaagagtttagtgactgaggccgaaaattcacag

SEQ ID NO: 65897 - DNA, 601 bp, Human
aaagtgtaagtccttctagaactctgacagtgttggggggaaaaaagtaaaagtcctacatgtttctattataggtctgagatttggactccatagttttattagagtcttattagaatattacatgtatttctagaactattacttgtatattcaaagtgctgagggtaaaatttaggataaaattataattgcacacttgctgttagtgaaacaaggttgaaaacaagatttactatgttctgtaatagttaagatgcaagctatagaatccgactagagggttcaaatcgaagaaaastgacacttttcactttatcagtttcctcctctgtacaatggggataataatatccacctcatttgggattgaaaggattaaaagagtgaaaccggtaaaagctcttaaaacattgcctggcatttaataaatactcaatgaatgttagctagtaaataaacacaaacagtaaaggcaaagaaaccattcatatcttaataacattttattttaggaataccaaaagaattaaattacattatcggccgggcgcagtggctcacacctgtaatcctagcactctaggaggctgaggcaggc

SEQ ID NO: 65898 - DNA, 601 bp, Human
tgtataaatgtttggtattattattattataaaacagacatgatttctacccttgtggactttaatagagaagacaaaaaagtagcaaataaaaataattatttattgtaataagttataaagccaccagagtactgatatgaaagacagtagagcgggcatagatagataggatagccagtgaagagacttcctgaggttgcagtgagagggtcatgaaagatcggaaggagtcttttagattacttccagtatttaatgcaggagtcaaataattaatttctttttcctaattgtcaamcatgcattctttttttcttttaattgttttccagctgttacacaaggaagtaacatattcttttaaaagaaaataattagtcgggtttagataaaaatatgtcggtagttttgttgtgttgaaagtaaaagtaaaaatgtatgccggccaggcacggttgctcacgcctgtaatcccaacactttgggaggccgaggcgggcagatcatgaggtcaggagatcaaaaccatcctggctaacgtggtgaaaccccatctctactaaaagtacaaaaaaattagctgggcgtggtggcgggc

SEQ ID NO: 65899 - DNA, 601 bp, Human
cagaaggtaatagagctatacaggctctgggggctcatccccccattttatagatgaggaaactgaagcacagcgtgacagagtgagtaaaggcagagtgacatcctctagttgcacagtcagtttactcctgtagctccttgcctgctgccccttcctaagttattttcttctttagctttttactcctttccttgatttttacatttcatctgtagtttttttgtttcctctacagaattagtttatgttgtagaaaaaaaatgtgagccataatacaatgagagacaactgttttctsttctttccattctctggtgtcttctttttgtatatgtaaagatttgtcctttgtatatgtaacttctgtcattaagagctttgtgctttgtttgtagacaattgagtacatttagcagggaggaaagttttccctcatatggagtggcttgcttgttcccttttcctactgactgcgtgataatgggcctattgctagggtctggcaagacaagtggaaaagcggtaagaagcaaacttctttttctttcaggctggagtgcagtggtgccatcttagttcactgcaacctccacctccc

SEQ ID NO: 65900 - DNA, 601 bp, Human
ataatcagtctgaaaagatcatcagtcaaacagaagtcttttgctcaccttcacaggcaaagagcaaacaccaatggagtgactattaaataaagagtatgagtaatttagtttatagtcatctgaaaggattgattctcattgattcatgactggccttgaaggcaagtggcagtcatggttgtatctttattgtctggcaaattagaaagacgaaggggaattttgtaaatatacttgcagagtagggaggctgcatttgttatcttgtcttttgctacagagatttgggtcaacacckctaatgaatttaaatgtggttttttggggttttgtttcttattttttgtgttttaacttagtacttaaagaatgagacctagaattacctgtgctctagagtttctataacataacttggagcagtgatttgaagtcaacatcctaacagcagcataaataaggttattccttgagttaagacagatagacttctggagctgtacaaaagtcttttacctcaaaagacaaggatttgtataaatctcttatgtgtatgcgtgggggttttaggacctccatataagggtagctgatgact

SEQ ID NO: 65901 - DNA, 601 bp, Human
tcaggaatcttccagatgaagaaggagggagagagtattccaagtagaagaaaccacttgtaagaaggtgttttgaaagaagaacccataggagacgggtaatactttagccaaatgaatgaagatctatatcaggatattgctgctcttcatctctatattatttggaaagttgttttttaagccagagaaggaatataattctttttaatgcacaagcttaaattctgcttaaagtgttaatatatttaattctcaggatatgattgataaaatggactcttcaaaaagaatccatacyactgaaaatattcaaatagaactagattattcagaattactattttaggggacatctgaagatcctgcttttttcctctagctctaaccctttcttctatgctgtaaccatactctttgagaaattggtttgcatatattattctctattgccttactgcatattagcttaacataacacaagaaaggtgtaaatcgtacatatacatcccaaagaattttttttttttttttttttgagacggagtctcgctctgtcgcctaggctggagtgcagtggcttgatcttggctcactgcaa

SEQ ID NO: 65902 - DNA, 601 bp, Human
tataattctttttaatgcacaagcttaaattctgcttaaagtgttaatatatttaattctcaggatatgattgataaaatggactcttcaaaaagaatccataccactgaaaatattcaaatagaactagattattcagaattactattttaggggacatctgaagatcctgcttttttcctctagctctaaccctttcttctatgctgtaaccatactctttgagaaattggtttgcatatattattctctattgccttactgcatattagcttaacataacacaagaaaggtgtaaatygtacatatacatcccaaagaattttttttttttttttttttgagacggagtctcgctctgtcgcctaggctggagtgcagtggcttgatcttggctcactgcaagctccgcctcccgggttcacgccattctcctgcctcagcctcctgagtagctggtactacaggcgcccgccacccagcccgtctaatttttttgagtttttagtagagacagggtttcactgtgttagccaggatggtctcgatctcctgacctcatgatccacccgcctgggcctgccagagtgctgggattaca

SEQ ID NO: 65903 - DNA, 601 bp, Human
ctctagctctaaccctttcttctatgctgtaaccatactctttgagaaattggtttgcatatattattctctattgccttactgcatattagcttaacataacacaagaaaggtgtaaatcgtacatatacatcccaaagaattttttttttttttttttttgagacggagtctcgctctgtcgcctaggctggagtgcagtggcttgatcttggctcactgcaagctccgcctcccgggttcacgccattctcctgcctcagcctcctgagtagctggtactacaggcgcccgccacccwgcccgtctaatttttttgagtttttagtagagacagggtttcactgtgttagccaggatggtctcgatctcctgacctcatgatccacccgcctgggcctgccagagtgctgggattacaggtgtgagccactgcgcccggccaaagaattttttaaaagtgaacacatctgtataaacgcccccaagataagaaaaatgaacattatcagaactctaaaatcccctattgtgtcccttccagtcactacctccaaccccttatcagttgttactcctccccactccccatcaaaagtaa

SEQ ID NO: 65904 - DNA, 601 bp, Human
gttccttctttttgttgttgttttttgttttttgagacggagtctcgctcttgtcgcccagtctggagtgcaatggcacgatcctggctcactgcaacctcagcctcctgggttcgagcgattcttttgcctcagcctcccgagtagctgggattacagatgtgcaccaccacgccctgctaattttttttttttttttttgtatttttagtagaggcgggttttcgccatgttggccaggctggtcttgaactcctaacctcaggtgatctgcttgcctcggcctcccaaagtgctggtrttacaggcttgagccactgcacccggccccaccatcttccttcttataggtatcaaaaaagctgaaagcctaagtgttattatttcttcctatctcccttttaaaatgtttgatgaagtacttaatcccctgaactgaatcttccttggagcccacctaatttattaaatcctgcgctctttaaaaacagcctactgatgtcttttaagaaaatggcttttattggattctataaaaatattaactaaaaaagaaaatggaaaatcaatatattataaagtactactgtgcatatttata

SEQ ID NO: 65905 - DNA, 601 bp, Human
cctcggcctcccaaagtgctggtattacaggcttgagccactgcacccggccccaccatcttccttcttataggtatcaaaaaagctgaaagcctaagtgttattatttcttcctatctcccttttaaaatgtttgatgaagtacttaatcccctgaactgaatcttccttggagcccacctaatttattaaatcctgcgctctttaaaaacagcctactgatgtcttttaagaaaatggcttttattggattctataaaaatattaactaaaaaagaaaatggaaaatcaatatattataaagtactactgtgcatatttatattcatgacatcttgcatagggtcttatccacaggagatgcttgtcaaatgtttcttaaattaaactgttggttgttgagtaactgctttctatttctgattttgctgccaactatctgattccaggcagatttacagtctttaggcctagatagtttccatatctctcaaataagagaatagactaacctctttaaaaatctgattattaagttctatacaaagtcaatgccattttttcttattatttgtcatctagtcatcctcagtacattctt

SEQ ID NO: 65906 - DNA, 601 bp, Human
gaaaagtgtcagcgtggtaaggcactcatttggtttgttggactgaactgttttaactgcaaactgtgcagttcccaacagtttagcacacagatgggattagtcttacaaggtggctaatagtatgtagaaagctgcatgcgacttaactcatcttggagagaaaatacaccagaatatttatatcctagtgaaaatgtcagtaatgtcatctttgtatatgaaggactatatctgcacacttggcatagcaatgtgatagaaaagaaagggcctggttttggagccagtcttcattacwacctgacaccgagcacgctaagcttctgagctgcttcctcatctataatctggcaatgatacctacctcacaagttttttttatgtgtgtgtgtgaagattaggtgagataatttatatatctgtggtacttagtatacttaaaaaaatagtagtttcattacttcctttagacttttccaacctttcctctttctaaatgtgtccaatatagttacagtattttttttaagttttaatatgtaaaaatttcaaacacacagagagaaataatagcgcaatgaactaccatataccaact

SEQ ID NO: 65907 - DNA, 601 bp, Human
aaaagtgtcagcgtggtaaggcactcatttggtttgttggactgaactgttttaactgcaaactgtgcagttcccaacagtttagcacacagatgggattagtcttacaaggtggctaatagtatgtagaaagctgcatgcgacttaactcatcttggagagaaaatacaccagaatatttatatcctagtgaaaatgtcagtaatgtcatctttgtatatgaaggactatatctgcacacttggcatagcaatgtgatagaaaagaaagggcctggttttggagccagtcttcattactrcctgacaccgagcacgctaagcttctgagctgcttcctcatctataatctggcaatgatacctacctcacaagttttttttatgtgtgtgtgtgaagattaggtgagataatttatatatctgtggtacttagtatacttaaaaaaatagtagtttcattacttcctttagacttttccaacctttcctctttctaaatgtgtccaatatagttacagtattttttttaagttttaatatgtaaaaatttcaaacacacagagagaaataatagcgcaatgaactaccatataccaacta

SEQ ID NO: 65908 - DNA, 601 bp, Human
gctgtagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtgaatatgtctccagggtttgttcggtgtttgttttggcgattagtttaaacacttaacatggtattggttcaktgtttgcctaagagggatcatggtgccatagaaagagtcagtttcctccactgtttgactttgggcaggttacttaacctctcttaatctaagctttctcatcagagtaataggcattgcattgtagggtgaaaactaaatgaggtaatatatgtaaagcacttagcacagtggctggctcagtgctcagcaaatggcagctattattatttttgtttccttaccttttattttttatcagatttaaagctcattatgctgcattaggtaccttgagatccttagagcaggggtttttaa

SEQ ID NO: 65909 - DNA, 601 bp, Human
gtgtttgttttggcgattagtttaaacacttaacatggtattggttcagtgtttgcctaagagggatcatggtgccatagaaagagtcagtttcctccactgtttgactttgggcaggttacttaacctctcttaatctaagctttctcatcagagtaataggcattgcattgtagggtgaaaactaaatgaggtaatatatgtaaagcacttagcacagtggctggctcagtgctcagcaaatggcagctattattatttttgtttccttaccttttattttttatcagatttaaagctmattatgctgcattaggtaccttgagatccttagagcaggggtttttaatttgagatctttatacatggatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcaggtttcttat

SEQ ID NO: 65910 - DNA, 601 bp, Human
tttaaagctcattatgctgcattaggtaccttgagatccttagagcaggggtttttaatttgagatctttatacatggatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcargtttcttatatttctgatggagattatcacctcagagaaactagggggactgctaggtttagaaaaggtattgtgggctgaccacaatggctcgcacctgaaatcctagcactttgggaggccgaggcaggaggataacttgaacccgagtgtttgggaccagcctgggcaacatagcaagacctcatctctacaaataatttaaaaattagccaggcatgatggagcactcctgtggcaagtagctgaggtagaaggatagtctgggaggtcaaggctgccatgagctgagatcacacc

SEQ ID NO: 65911 - DNA, 601 bp, Human
gatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcaggtttcttatatttctgatggagattatcacctcagagaaactagggggactgctaggtttagaaaaggtattgtggrctgaccacaatggctcgcacctgaaatcctagcactttgggaggccgaggcaggaggataacttgaacccgagtgtttgggaccagcctgggcaacatagcaagacctcatctctacaaataatttaaaaattagccaggcatgatggagcactcctgtggcaagtagctgaggtagaaggatagtctgggaggtcaaggctgccatgagctgagatcacaccattgaaaggtgatgtgtgtaaaatactgaatacaatgtcacaatgtctttcatgtggtaaaaaattcagtaaatatt

SEQ ID NO: 65912 - DNA, 601 bp, Human
ctgaggcaggtggatcacgaggtcaggagttcaagaccagcctggtcaagatggtgaaaccctgtctctactaaaaatacaaaaaattagccgggcttggtggcacgcgcctgtaatcccagctactccggaggctgaggcagagaattgcttaaacctggaggggcggaggttgcagtgagccgagatcgcaccactgcaccccagctgggcgacagagcgagactccgtctcaaaaaataaataaataaaaaatataaataaatataaataaaaaaaaattcttatcctcacttcacargtgatgaatgtatgtgtcttggtttggagaactagttttaacctttatcagaatgtaaacccaattaggtgaaacaatctcaagggacaaatggatatagttcagctgatattctgttagagatgtggtagaaattgagcaataatggatcgccgtgaccagaacatttaggagtctgtcatcttggaatttacttgctcctttttggaaagatttgcaaccctcacaaacccaaaggaacaatttaattatgtccaacaacatggcattttaactaatccaaagaaacttccactgagg

SEQ ID NO: 65913 - DNA, 601 bp, Human
ccaaagaaacttccactgaggcatatgcattttactatgcattggaaagtgcagtacaagcacttctcagatagaagacagcctgcataaatggaatccttagtagtggccctttgcccagactgggattttaaagctataattaacactttaaatttacactagcaaatcaagctttaaaattaattgccctccatttattggtattaggaaggtatgtaaacttgtctattgtcccccacttaattctttgaaatcacaatccttaattaggagatataacaaacattattaaaagggrgtcacataacactggaacacaccgaatagctctatcctgattgcacttgcttgaaataaatgcagggaaactttattgtaacttctctttttaatgagctttaaccagtgccggagcttcctggtcaggtacttttgtaagctgcagtacttacaagtagtaaattattaggtggtactgaaaaaattcaagacagtacttttaatggtttagaggtatctaatctcttcccagctggtttgttatgacgctcaaaggtcttggaaattttagggaaaaccttgatcattaaaatttaag

SEQ ID NO: 65914 - DNA, 601 bp, Human
cgtgggttggagggcagcctggcatgaagagtcagagctcaagtggatgaggatggtagtcatgtgtgggcacctggtggtgggtttcagaagccaagcagagcaagaagggcatccatgtgggggaaaagcctacacaggatgtggagggcatccatacagggtggtgcttgatgcacagtgtcaaagcctaagcagggtgaagagatggtcccacaccagcagtcagaaccctggtgaggtaaggaggacatccacgtgtgctgagtagcccagaatggggaattcagggttcaagtasagtgaggaggacatccacatacagtaggggtttgtggctgcaatgagagattatatgattatacagagggattgatcaaattagtcaatgtattcagggtaatgggagccaggtttctcactgtcagtaaagtgagacacaaattatggaaagggagaaactaaaatgaaccctgttaggatattgcgttaaaactggaggcttcaatgtgaacttgtggtttccaatatatagataggtagatatagaaatatagatgtaaaaaggtagatacatacacagatacatactctaactcta

SEQ ID NO: 65915 - DNA, 601 bp, Human
cttcaaaatcctaaaattcagcgggagtggtggctcacgcttgtaatcctaccactttggaaggctgaggctggaggatggcttgagcctaggagttcaagatcagcctgggcaacatactgagaccccctctgtacgaaaaataagaaaactagctggacatggtggcatgcacctgtagacccagctactcaggagtctgaggtgggaagatcacttgagcctgggaagtggaggttgcagtgagctgtgtttgcaccattgcactgcaccctgggtgacagagtgagaccctgtctcaaaaaaaaaaaaaaaattctaaaattcatctcgtcaataacagtaacaacaacagaaacataaaataggagtaatgttaactagaaaaaaatgtaacttagatggaaaaaaattaaaaactacaaaactttcctgaaatgtttttaatgacttgaatatacagacttgcataaggggctaattttcccattctcctttttttaatcttcaatttcaggttcattaataaatagaattaggtgtgatgcttcagtgcttgtgaaaataagtttgttcatgaaggctaaatcagtagcaaatc

SEQ ID NO: 65916 - DNA, 601 bp, Human
ttttttaatcttcaatttcaggttcattaataaatagaattaggtgtgatgcttcagtgcttgtgaaaataagtttgttcatgaaggctaaatcagtagcaaatctgcaccctgtctcctgttgtatacatattttggtggttgttgttccaaggaatcctttgtccttttaattagggtaaagacagatggatttggaagagacttttccttgtgaaatgaagagacccctgcagctttctgtagcttgaggcagtcttatgggaaactggcgtttactgttttttccttggggatgtgsctgcattattgttactgttaagttatacttgattggtctgaattgtgcagcattaggagtgatatttttgtctttgaaagctctatataacagctcatgaacacttttcaaaagacgggaaatttatagaggagaagaaaagactgtcacagcgagtgtttagacagtgagactgactgttttcaaacaaatctaattcattatatgcctggtaatgaagacatattaataacagagaaaacagccccattatctatgtgcttccgtgaaccagtttattttgtttatatcagtgggcag

SEQ ID NO: 65917 - DNA, 601 bp, Human
taccagaaattttcttttcatcaagcctgccccgattaagagtcctcagttaagtaacatcagctgccctcttgtttaatttccataactcaattcaggggtatggagagaaaaaggcagctataagaggatattgtaaattacaccatgccctctgaggatttaatttggtcatctccttggcaagaaaaattagcgggaggagcttatgtatgtcggagaaaaagagtgaagagaagggggcagaactaatgatagatgaaatagctttaaggaaattgtttagtaggattaaaaaaawtttttttgcagctttttggtgactttttgtttgctcacattgtctttttctaaggtatattttaattatttagatacaggcagtgatgggttctgttccataataacctactttcaggactaggaaatatatcttaatatagtggtatgtatatgttcatgtgtttaaaatacagtgaatatataaatgttactgtaaatgatgacactataacactgaaagaattttatgtttttattctatcaaaggtccatgactccagctcaggctgacttggagtttcttgagaatgccaaaaag

SEQ ID NO: 65918 - DNA, 601 bp, Human
cctctgaggatttaatttggtcatctccttggcaagaaaaattagcgggaggagcttatgtatgtcggagaaaaagagtgaagagaagggggcagaactaatgatagatgaaatagctttaaggaaattgtttagtaggattaaaaaaattttttttgcagctttttggtgactttttgtttgctcacattgtctttttctaaggtatattttaattatttagatacaggcagtgatgggttctgttccataataacctactttcaggactaggaaatatatcttaatatagtggtatgtrtatgttcatgtgtttaaaatacagtgaatatataaatgttactgtaaatgatgacactataacactgaaagaattttatgtttttattctatcaaaggtccatgactccagctcaggctgacttggagtttcttgagaatgccaaaaagttgtctatgtatggagttgatcttcataaagcaaaggtaatgataactttgccctttattaatatgcatgtggaagatattatatgatacatgtctgttatgtatgtatcacatctgtgtcatataatactttttaacaacatctggggta

SEQ ID NO: 65919 - DNA, 601 bp, Human
caagtgattctcctacctcagcctcctgagtagctggaattacaggcgcgtgccaccatgcccggctaattttttttgtatttttagtagaaatgaggtttcaccatgttggtcaggctggtcttgaactcctgaccttgtgatctgcccacctcggcctcccaaagtgctgggattacaggcgtaagccaccgtgcctggcaggtatacatatttcaaaacaacatgttgtagatgataagtatgtacaatttttatttgtcaatttaaaaaattgatttaaaaatctggcttgaactaraatctttagctcctattactaatttctattgcataataatattgattgattggaggacttggtcaatatcccattccctgttcattgaacagtgtcccaaatgcagatagtgactaaggaaaagcagtgtctggacaatcaagaggtgacttaattgtgtctcagaaaaatgtataatgaatgtgtgtgtgttttctggaaaaaaaaaaaaaagcttaaattatatgagatgcattccctggctttcttgctttggaaaaagccaccctcagtgagtgaatttctttcagtaagtaggaa

SEQ ID NO: 65920 - DNA, 601 bp, Human
atacttacttgtaggatggcatatttaaatccattgcatcaaaataagagaataccttaaaatctaatgctcccttacataaaagtatatgtttgctgaattgaaatcaattacctcaaagggaaaaatactctctttttggtagtatttgatgtagtaatttatgtccttattcaacaaatatttattggatatcatatttatgccaggcactatgccagaagcaaaaacacaaagatgaataagccatggtctttgttctttactcctagagaattcagtcttataggggagaccagcctagaaatagattgttttaattcagtatggtacaaagagtacatagagtaccatataggaaaaagatggggttcccaactgagtttaaaaatacaccaaataacctgttaaatagattaccaggcattaattgagtttggagtgcatttgacaaaactgtcattccaggagagtggaaaaagagctctgggcttcgactttgttactgcccaatgtcctaacagctgtgtgaccttaagtaacttcttttttgaggttcagtttcctatatctataaaatggggaaaacattataaggatg

SEQ ID NO: 65921 - DNA, 601 bp, Human
tacttacttgtaggatggcatatttaaatccattgcatcaaaataagagaataccttaaaatctaatgctcccttacataaaagtatatgtttgctgaattgaaatcaattacctcaaagggaaaaatactctctttttggtagtatttgatgtagtaatttatgtccttattcaacaaatatttattggatatcatatttatgccaggcactatgccagaagcaaaaacacaaagatgaataagccatggtctttgttctttactcctagagaattcagtcttataggggagaccagcatagaaatagattgttttaattcagtatggtacaaagagtacatagagtaccatataggaaaaagatggggttcccaactgagtttaaaaatacaccaaataacctgttaaatagattaccaggcattaattgagtttggagtgcatttgacaaaactgtcattccaggagagtggaaaaagagctctgggcttcgactttgttactgcccaatgtcctaacagctgtgtgaccttaagtaacttcttttttgaggttcagtttcctatatctataaaatggggaaaacattataaggatgt

SEQ ID NO: 65922 - DNA, 601 bp, Human
tcctcccaccttggcttctcaaagtgctgggattataggtgtgagtcatcgcacctggcctagttgtgtttttctaggaaatgtgcattttatctaaatttccaaatatatttacataaagctgggtatcttttcaatatctgtaagaactatagcagggtccacttttgcattcctgatattggtaagttgtacctttttgtttcgaatagccttggtagaggtatattgattttattaatcttttcttttttatattgtaaattgacaatttatgtatgtatgtatgtatgtatgtatktatttatttttgaggtggagtttcactcttgctgcccaggctggaatgcaatggcgtgatctcggctcactgcaacttctgcctcccaagttcaagcgattctcccgcctcagcctcccaagtagctgggattacaggcatgcgccaccatgcccggctaatttttgtatttttagtagagacgaggtttcaccatgttggtcaggctggtctctacctcctgacctcaagtaatctacctgcttcggcctcccaaagttctgggattacgggcgtgagtgagccaccgagcctggctga

SEQ ID NO: 65923 - DNA, 601 bp, Human
caacctctgcctcccaggttcaaacaattctcctgcctcagcctcccgagtagctgggattacaggcatgcaccaccacgcccggctaattttgtatttttagtagagacggggtttctccatgttgaggctggtctcgaactcctgacctcaggtgatccacccacctcagcctcccaaagtgctgggattacaggcgtgagccaccgcgcccggcctattattttctttacgcttttattgagcttttttaaaaaaaattcttgaactagatactcattaatgttcattatttcttacracttaaccttagaatgtaagtgacttgcctaaggttacatagctagttggaaagaattagaagggaatccgggacaattctcctaggcccatgctttttactcttcaccatgatgacttcttttttttagaaagagtagaataaaagttaatagtcaatattccttgagcacttagtatgttccaggcactgttctatcttttaagtatctgaagtgcatataaactgaataggacaatttttttttgtagttctgtttttaaatgtcttatttttctctttgtactatagtataaaaag

SEQ ID NO: 65924 - DNA, 601 bp, Human
caacaaagttattcttcattctttctaaatgaagatgtctcccatgaacctataaaatattttcgtagagttatgtcagtaagactgtaagctatctcagaagttataaggtgacccactccttgacccaactattatttttatttatttatttatttttttgagatggagtctcgctctgtcacccaggctggagtgcagtggtgcgatcttggctcactgcaaactccgcctcgtgggttcatgccattctcctgcctcagcctcctgattagccgggactacaggcgcccgccaccaygcccggctaattttttgtatttttagtagagacggggtttcaccgtgttagccaggatggtcttgatctcctgaccttgtgatccgcccgcctcggcctcccaaagtgctgggattacaggcatgagccaccgcgcccggccccaactattatttttttaaatgatcttataaaacacaccagtatgattgatcctctgctttttaaaataattttactcatctagaaggaatctccacattgctttttaagactaagctctgctattgtgattaaaataaaattttattttctaagatg

SEQ ID NO: 65925 - DNA, 601 bp, Human
ttatttatttatttttttgagatggagtctcgctctgtcacccaggctggagtgcagtggtgcgatcttggctcactgcaaactccgcctcgtgggttcatgccattctcctgcctcagcctcctgattagccgggactacaggcgcccgccaccacgcccggctaattttttgtatttttagtagagacggggtttcaccgtgttagccaggatggtcttgatctcctgaccttgtgatccgcccgcctcggcctcccaaagtgctgggattacaggcatgagccaccgcgcccggcccyaactattatttttttaaatgatcttataaaacacaccagtatgattgatcctctgctttttaaaataattttactcatctagaaggaatctccacattgctttttaagactaagctctgctattgtgattaaaataaaattttattttctaagatggatgtatgcacatttccaaagaactggtattacataaagcgcatctgtgtggttgctcaaatcttaagtacctttacaaaaaggagaagattcattatgtaggagaggttgtactgctgagttgcctatggttctgagttaatt

SEQ ID NO: 65926 - DNA, 601 bp, Human
gcagacacctgtaatcccagctatttgggaggctgaggcaggagaatcacttgaacctgggaggcagaggttgcagtgagctgagattgcgccactgcacgccacgccagcctgggcaacagagcaagactgtctcaaaaaaaaaaaaaaaaaaaaaagggccgggcgcggtggctcacgcctgtaatcccagcactttgggaggccgaggcaggcggatcacaaggtcaggagattgagaccatccctggccaacatggtgaaaccccgtctactaaaaatacaaaaaattagccaggcrtggtggcaggcgcgtgtagtcccagctacttgggaggctgaggcaggagaatggcgtgaacccgggaggtggagcttgcagtgagccgagatcgcacctgcactccagcctgggcgacagagtgagactctgtctcaaaaaaaaaaaaaaaaaaaaaaagaaaaagaaataaccccaaaccgttaattacccctggtagttaaagtgctgtaatggggtgtgcttaacttaacacttgacagtgtcactaattttggtgctctcttaggttttttagactcagtctagggaaaatagcac

SEQ ID NO: 65927 - DNA, 601 bp, Human
ctgtaatcccagctatttgggaggctgaggcaggagaatcacttgaacctgggaggcagaggttgcagtgagctgagattgcgccactgcacgccacgccagcctgggcaacagagcaagactgtctcaaaaaaaaaaaaaaaaaaaaaagggccgggcgcggtggctcacgcctgtaatcccagcactttgggaggccgaggcaggcggatcacaaggtcaggagattgagaccatccctggccaacatggtgaaaccccgtctactaaaaatacaaaaaattagccaggcgtggtggcrggcgcgtgtagtcccagctacttgggaggctgaggcaggagaatggcgtgaacccgggaggtggagcttgcagtgagccgagatcgcacctgcactccagcctgggcgacagagtgagactctgtctcaaaaaaaaaaaaaaaaaaaaaaagaaaaagaaataaccccaaaccgttaattacccctggtagttaaagtgctgtaatggggtgtgcttaacttaacacttgacagtgtcactaattttggtgctctcttaggttttttagactcagtctagggaaaatagcacaatgacat

SEQ ID NO: 65928 - DNA, 601 bp, Human
taaaggtatttcaaagctaggcaggagaccttagctattccctttctgctattaatatcaaggatgaatcttgcccttctaccaaacacataggctccacctccctagaggagattgcagtgtgttgaatgttgcagctgaatcctgcatgtgcttgtttataagccagccctgggagtaatttcatgtgtcagttacaatttaaattgggtttattgtaatgttttgttgtgtaataaactgaagaatgaagtgcctctttaagtatattgttcaactaacaaaatcctttgtgtttacyagtttggtgtcatatgtggtttattacatgtgtgttttaactaaagattttctttttcttcctgtcatatatgtcatacgttgataacttcatatgtaaatttgtttttaaatgttatttaaagtatttccagatcagtttttaaaggcaaaacaaaaacatgggctattgcattaaataagcctaaattattcttttagtgggtacttttttataaataagtataaaaatatattttcttcatcaatagaatacttaccttaattttcttttttgataatttggatatccatattacct

SEQ ID NO: 65929 - DNA, 601 bp, Human
tgataagaatgaggaaggttagccatttttcactttcacaaaactacattgccatttcacccatgctgacttacagtgcattaaaaagacagtgatccattcttttcattgatttcttttaatcaggagttgttaatagtttcaaataatggatatgggccaggagcattggctcacacctataatcccagcactttgggaggccgaggcaggaggatcacttggggtcaggagtttgagaccagcctggccaacatggtgaaaccacgtctctactaaaaatacaaaaattagccaggcrtgttggtgcacgcctttaatcccagctacttgggaggctgaggcatgagaatcacttgaacctgggaggtgtaggttgcagtgagctgagatcgtgccaccgtgctccagcctgggtgacagatatacacatatatttacataaactgaagaaaccataatcctgtactatatgttgaaaagtttcattaaacttttcagtagcaaaatatgtttttaagcaaaatgaaataatcagtgagagtcaaacctatcttttgtatttaaaaatttataagaactatttcacaatgacatcata

SEQ ID NO: 65930 - DNA, 601 bp, Human
gtgatgtgtttttccctcagcatttcattgacagccctgagaggggatttctaaataagtgtgtttggaaattaaaaccactaactgccttttgagaacattttatatttaatgaagtgtttggtttgattgctgctaaaattatgaagtgataggcatcaaaaagtgtctaacctgaacacagccaaagtaatttggccatcattctttagaagttttttcccctgtaaggaagttctctcaagttatctgtcactccagcaggtttttttttttttaagcatccctcctcccccttctyctaccccgcccccactaatgctttgttctggcacaaataaggtcgagttcatttttagatctaccgcctcctcctccatctcccagagagaacctgtagcaagttgtctatgacaaattctatttggaacaggtccctttgagatcttaattttactctgtgcccccacaggttttcaacaaagccagctaagaaggatggagaaagctccctcagaagctactggttttaccaaaacatttattttcccaggttccaagccaatccgaagctaggcaagaagagtagcaaattacaagt

SEQ ID NO: 65931 - DNA, 601 bp, Human
agagtgagaccctgtctcaaaaaaaaaaaaaaaaaaggaaaagaaaaatgatttattttatctttatgagtaatattaaacttttaatacactgttttgtaagatagtcacaattagaggtcagagatacctttcaggggctcttctttttctgttattgtcattacctattttagaaatcctacatctgggccgggcgcggtggctcacgcctgtaatcccagcactttgggaggctgaggtgggcggatcacgaggtcaggagttcgagaccagcctggccagcatggtgaaaccccayctctactaaatatacaaaaattagccgggcatggtggcacatgcctgtaatcccagctactcaggaggctgaggtaggagaatcacttgaacctgggaggcggagattgcagtgagccgagatcacaccactgcactccagactgggcaacagagtgagactccgtctcaaaaaaaaagaaaaaaaagaaatcctacatctgaataaatgaatctattaaacatttaatgaaaatatcttgaaagttaccatgaacatataccccaaaagtttttatctttagtcagtacaagtgaaata

SEQ ID NO: 65932 - DNA, 601 bp, Human
tttgcttaaagtaatgtataaaccttcatgatggtcattattatttatttgttttggtgaaccttggagggacattataaacttttatactttttgtttttcttttgcaatctttaaaatgtataagattaagattttttatttctggagcaaaaactaattgctatactgaatgaactgttgcttttaaaactgttgtttttaaagtctatatgaagagatataaggattactttttatattctgccattatatttgtaataaaagtaactttttttttttgtctgagacagactgttgytctgtcccccaggctggagtgcagtggcgcgatctcagctcactgcaacctctgcctcccgggttcaagcaattctccggcctcagcctcctgagtagctaggataacaggcatgtgccaccacgcccagctaatttttgtatttttagtagagacggggtttcaccatgttggccaggctggtctcaaactcctgacctcgtgatccgcccacctcggcctcccaaagtgctggaattacaggcgtgagccactgcgctcagccaaaaataacttttatgatggcaaggagaatgcttc

SEQ ID NO: 65933 - DNA, 601 bp, Human
caacataaagcgtaaatgggctgggcgtggtggctaacacctgtaatcccagcactttgggaggctgaggcgggcagatcacctgaggtcaggaatttgagaccagcctgtgcaacatggtgaaaccccacctatactaaaaatacaaaaattagctgggcatggtggcacacacctgtaatccgagctacttgggaggctgaggcaggagaatcgcttgaacccgggaggcagaggttgcggtgagccaagatcacaccactgcactccagcctgggtgacagagtgagactctgtctcaaaaaaaaaaaaaaaaaaaaaaagtgtaaatagtcttggtttccttccttcattttcagtaccagaggcaaattctaatacatattggtgttaccctgattcagcttcttaatggcaagctgataaataaaaaataatttggagtaaaggtatcaatacagaccagtataatattttgggtttttgctttggttttgtcattattcatttctagggtgactctgagaggttcacttaactacttggtgcccagatttccacctagtaatgtggagacaaacctacttcatgagaatgaata

SEQ ID NO: 65934 - DNA, 601 bp, Human
gacatggtctcattgttgcttttattttttcggcaagggttttgaatacagtaaagacatacaaaatttgttgacagagttgccttcccttatattcctcttcacaggaattataaaatcccaaactatagcattctctgcagctttgaaaaagactattatattgtttttattatacatagaaacttcacttttttttcatatactcaaattacaccgtttgtaatattggtactagaaactacaacaacttcttattaatctgttttgtgtggcatgtagcattaccatatctgcttcytctacactttagtggatagtattaataggccactctcatttctgaagctgttactcctcatgccttagtatctccttttactgtagcagaatatgacacaaaaagaaacacattggtgcagatctatgaaagcatacctgaaatggttaagaaggtatgggattagagttaggaagccatacaaagttaggctagaggaagagcagtggctatgatcaacaattataaattcatggaggattccttttggtaaacaaaactcctatcatcctagaacttgaaagacaaaaggaagataaa

SEQ ID NO: 65935 - DNA, 601 bp, Human
aaaatcctagaaggcagcagtgtcttaccctttaacatagaatcctgttttgggtaaatgatagaataactctgacatttgaaagattgaaaggtaggggaaggcatagagtctcaactatcttttcttgtctcaaaatcaacaaaggcaggtgagcctctcattttcttatctactacctcttcaaagaaaagtcttcatatttataagatcctatctcaataaaacacatagaaaaatatttaaggggataacatggccaccattcattttatttatttatttaatttgtcacccaccrgcaaagtactctattatatattacaaggatgcaaagagtcagcattatcagaattttagggattggataggatcctaattcaattcctctctcttccagtgcttgactcttctctgcaatatcatttagagatttggaggccagtgttgcagtctttgtttcaatatctcctgagataacatattacatctttggacagctctgagtttgtatataaatcattcatatattaagtgaaaatctgtttccctgtagctttcactcactgatcctgaacagaggcattttaaagaattttct

SEQ ID NO: 65936 - DNA, 601 bp, Human
taccacaggtaataatgagctattctcactctagaacatattactaagaatagggtacacatctgtataaataaagtcatctcggataagtgtgatatcataaagggaacatttatgtttatctaaaatacattgcagagagcaatttgacactttttcttgtgttttacgtgatatagaaacatcaactatatcaaactcttatgggttttgatatatttggagtatcaggagtaggcaaactttttctgtaaagtgccaaataataaatattttaggctttgcaggctatatggtctgycacaaccactcagctttgccattgtagagtgaaagtagtatagataacacataaaatgaatgtgattatgctccaatcaaactttatttatggacactgaaatttaaattttgtataattttacatattactaaatattattctattagtttcctaaccattttaaaatgtaaataccattcttagctcatagcaatagaaaaataaggagagggtggctgggtgcagtggttcacgcctgtaatcccagcactttgggaggccaagatgggcagatcatttaaggtcaggagtttgaga

SEQ ID NO: 65937 - DNA, 601 bp, Human
tagttaataactcttcagtattgccactctaatcttactgaaaagtgaagaatggtgtgggtgtgggtatgtgggtgtgaggagagcttgttcctgtaatgtgaaatcgacagaaggtatatcactttatctcttacttcaccttgggtaaaccttctcttaactctcacagctctagattttattatattattcaggtgattatttcaaactaatgcttcggctgggcactgtggctcacgcctgtaatcccagtactttgggaggccgaactgggtggatcgcctgaggtcgggagttygagaccagtctgaccaacatcgagaaaccctgtctctactaaaaatacaaaattagccaggtgtggtggcacatgccggtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaaacctaacacttcacattttagagtggtctatttactagctcaaagtatgtaccttgtgatctaagtaaaataactttgtag

SEQ ID NO: 65938 - DNA, 601 bp, Human
gaggagagcttgttcctgtaatgtgaaatcgacagaaggtatatcactttatctcttacttcaccttgggtaaaccttctcttaactctcacagctctagattttattatattattcaggtgattatttcaaactaatgcttcggctgggcactgtggctcacgcctgtaatcccagtactttgggaggccgaactgggtggatcgcctgaggtcgggagttcgagaccagtctgaccaacatcgagaaaccctgtctctactaaaaatacaaaattagccaggtgtggtggcacatgccrgtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaaacctaacacttcacattttagagtggtctatttactagctcaaagtatgtaccttgtgatctaagtaaaataactttgtagtatttctccaaagccatgtttcttttatgagtttgttgaaaatgctaacacagaaagccattttcactattatacgat

SEQ ID NO: 65939 - DNA, 601 bp, Human
atttcaaactaatgcttcggctgggcactgtggctcacgcctgtaatcccagtactttgggaggccgaactgggtggatcgcctgaggtcgggagttcgagaccagtctgaccaacatcgagaaaccctgtctctactaaaaatacaaaattagccaggtgtggtggcacatgccggtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaaacctaacacttcacattttagagtggtctatttactagctcaaagtatgtaccttgtgatctaagtaaaataactttgtagtatttctccaaagccatgtttcttttatgagtttgttgaaaatgctaacacagaaagccattttcactattatacgatttctcaagaagataaaacatagctagttaatattcaataataattttctataataatagctgtctgttgcattggttctgtagaatcaaggtaactatttcttgggttttttgtttgttttgttt

SEQ ID NO: 65940 - DNA, 601 bp, Human
ctgtaatcccagtactttgggaggccgaactgggtggatcgcctgaggtcgggagttcgagaccagtctgaccaacatcgagaaaccctgtctctactaaaaatacaaaattagccaggtgtggtggcacatgccggtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaaacctaacacttcacattttagagyggtctatttactagctcaaagtatgtaccttgtgatctaagtaaaataactttgtagtatttctccaaagccatgtttcttttatgagtttgttgaaaatgctaacacagaaagccattttcactattatacgatttctcaagaagataaaacatagctagttaatattcaataataattttctataataatagctgtctgttgcattggttctgtagaatcaaggtaactatttcttgggttttttgtttgttttgtttcgtttttgagacggagtctcactctgtcaccccggctgga

SEQ ID NO: 65941 - DNA, 601 bp, Human
gaatgcaaaataaaatgaagataatgtggaaaacaatggtatagcttaacggatgtagtggattggggattacaattgtgtaaagtgactgcagaggtatatgctaaatctcagactctcattttgaggaaaatttagtaatttcaaggagcaaatgtgtgggtaatagcaatatagaaagataagctttgaggctagaaacagtaataaatctctgacattttaaaatagttgtaaattgtgtgactaatcagaaatattctattttctttcttaacagacagtatgtatcccaaaactrtccattataaatggtattcttcctgaggatcttggttcgggaatatttatgaaatagcctcatagtatacccattttaattctcctgtcacaatttctttcttcaaagttgtgatgttctctaaaatataatgaggacctgtttgagaacttgctaacaaaagctgaaaggaagcccaattttagttaaatccataggcttggcccacttcaggagttcaagaaacaccatgtagggacttcctgtctttattgctttggttcacgttactttgcaaaaagtaatattttaagaaatata

SEQ ID NO: 65942 - DNA, 601 bp, Human
gaacttttatattacataccagttactagcttataattctttcctctaactacttttttcttttagaagcctattaaggcttattttttactgtttttaaaaggcttggaagatgttaaggattttttagcactttctgcataaattgtttactagactcttcaggttttaaagatcatttcactactgaaaccagatacaagtgcttgcataagaaaataatcactttttattaccaaagtaatacatacttgttttagaaaggttaggaaatagagaaaaaccacaaacaaaaagatcrtttgcaatcccttgattattaatattttagtacaccttaaaatcttttgtctttcctttttttttttttttttgagacagagtcttgctgtgtcaccaggctagagtgcagtggtgccatctcggctcactgcaacctccgtctcccaggtttaagcgattctcctgcctcatcctccggagtagctaggactacaggcacatgccaccacacccagctaatttttgtatttttagtagagacggggtttcaccatgttggccaggatggtctcgatctcttgacctcatgatccacccg

SEQ ID NO: 65943 - DNA, 601 bp, Human
acctgaaaagaaatagactctggattgcatttgttggagtggcagcaaaatacctataaaacacccatatcctgctttttttttgagatggagttttgctcttgttgcccaggctggagtgcaatggcacaatctcagctcactgcaacctccacgtccttggttcaagcaattctcctgcctcagcctcccgagtagcagggattacaggcatgcgccaccacacctggctaattttgtatttatattagagacggggtttctccatgttggtcaggctggtctcgaactcccaacctcmgatgatcacccgccttggcctcccaaagtgctgggattgtaggcgtgagccactgcgcccggcccatatcctgcttttaataatatctggaattcataggtcaaaaaaggggtaatttataactcataaaggcatatatataatcagggtctgatgattctgagacataatccctttgcataaatagtttttgagagaaagcctttaggaaaaaaaatcttgttttcttccccaaaacaaagaaaatactgaattatcatacttagcaggagccattgactttttaaatgaaattgagaa

SEQ ID NO: 65944 - DNA, 601 bp, Human
ttaggaaaaaaaatcttgttttcttccccaaaacaaagaaaatactgaattatcatacttagcaggagccattgactttttaaatgaaattgagaatcttcaaataatgtttctgttcagttaaatatttgtctaatattctttttttcatattattaaaaccaactagatatcattgcagtactttatatatataggcagccaatctttctatcatagcatcttttttcctttttctttttttcttttttttttttttttttgagatggagcctccctacctgtcgcacaagctggagtkcagtggcacgatttcagctcactgcaacctccacctcctgggttcaagcgattctccttcctcagcctcttgagtagctgggattacaggcgtgcgctaccacgcctggctaatttttgtatttttagtagagacggggtttcgccatgttggctaggctggtcctaagctcctgacctcaggtgacccacccgcctcggcctcccaaagtgctaggattacaggtgtgagcccctgcacccggccagcatcttttttcttacagattccccatcagttcaggtaagcgacatctagatt

SEQ ID NO: 65945 - DNA, 601 bp, Human
gtgtttaattttagaaataagcactttagcagcataatagaggacacgttcaaggaaggtttgagatgagaaagaaggaaggaagaaaggaaagaagaaaaaccgttgagggcatttgtggtaatctggatgaggcgttctaagagctttaacaggctgggcacagtggttcacacctgtaatctcaacactttgggaggctatggtgggcagatcacttgaggtaaggagttcaagaccagcctggccaacatggtgaaaccctgtctcaactaaaaatacaaaaattagctgggcatgktggcacgcatctgtaaccccagctacttggaggttgaggcaagagaatcacttgaacccagaaggtggaggtttcagtgaatcaagattgcaccactctactccagcctgggcgaagagcttgaacaaaggtagtaaatgtgggaattgatgagggaaacattaaagcaaatagataaagtagatattaaaatggaataaaaatgccttgatgacataatctctgggggttagcggataaatgtaaggaagaagttgaagatgattctcagaattctggcatggatgattggatggatgg

SEQ ID NO: 65946 - DNA, 601 bp, Human
aattggctcttacttgattatcttaggtatttgtctgattattaatcagccttctcagttgtgacaaattatttgaagaagcccaaagttcctctccatgtgaatgggtttagatagctattcacaatgctaggactagcatgtagcaatttcagaaagcctatttgtttaataccagctgatctatttttggacagctctatagccacttgcctgactcaaaagaaacagtgagataagtgccctggaaagtagcatagcatcttaacaatatgacaaattcattctagtgtcccccagrccctaggacattataggtgctctgctcattggttggttgaattaaataagtatagtactttagaatttacaatatggtttcatatacagtatattattgtattttatcttcagaaccctataagtcaaaccaagtattattttcatgttaaatatgaggaaattcatacattcttgtcaagaataattgctgtatctcagatacatttgcagacagagacagccttgttgtcagtctttcagttccatctttcatatcctaagtcatatttgttatcagccaatgaaagatctacctaat

SEQ ID NO: 65947 - DNA, 601 bp, Human
tatggtcaaaggctcttaccaagatttcatgcctaagtggcttatatacagctctctggtgagcacatgcagatgtcacttgccataacatttggctttcgttaggttatttctttttcttcttttaacttttattttaggtacacgcgcaggtttgttatgtaggtaaattcgtgtcatgggggtttgttttacagattattttgtcacccaagtactaagcctggtacccaatggttattttttctgatcctctccttcctcccaccctccaccctcaagtaggccctggtgtctgttkttcccctccttgtatccatgtgttctcatcagttaggtcccacttataagtgagaacatgcagtatttgcttttattgttcctgtgttcgtttgctaaggataatggcctccagctccatctgtgttcctgcaaaggacatgagctcgttcttttttatggctgcatagtattccatggtatatatataccacattttctttatctaatttgcgattgatgggcatttaggttgatttcatatatttgtcattgtgaatagtgctacaataaacatacacatgcatgtgtcttaatggta

SEQ ID NO: 65948 - DNA, 601 bp, Human
tgggaggctgaggcaggagaattgcttgaacctgggaggcagaggttgcagtgagccgagatcacactattgcactccagcctgggcaacagaagcgaaactccatctcaaaaaaaaaaatactaaaaatacaaaaattcgctgggtgtaatggcaggcacctgtaatcccagctactcaggaggctgaggcaggagaatctcttgaacacaggaggttgcagtgagccgagattgctccactgcattaaaaaaaaaaaaaaaaaagaagaagaagaagagattactggtgagccactacrcctggccaaattttcttttctgagaaagggtctcactctgttgcccaggctgaagtgcaggtggcatgatcttagctcgctgcagcctagacctcccaggctcaagcagttctcccacctttgcctcccaagtagctggaactacaggcatgcacagctgcacctcgctaattttttgtagtgacgatattttaccatgttgccctggctgatctcaaattcctgggctcagaggatccaactgtcttgacctcccaagatgtgccactatgccctgctaaaaatttttttacttcccac

SEQ ID NO: 65949 - DNA, 601 bp, Human
tggactagaattgatttatgttgaattgtttttcttttgttattcacagaagccaaaagtaagaaaaacagttccctctataaactgagctgttatttcattcctgcaacaaatatttattgagtgttcacaatattaagccaaagcaatgtacaaggtatacatagtccctaccctctggaacttacattctagttaggagaaacaggcaataaagcacataaacaatgtataagtaaatttcagacagtggtaaatgctataaggaaactaaaatggggtaaagagttagacaatatgrgattacatgaaagattgctgctttgagactaggataatcagggaattcctctctgaggaggtgacattttggctgaggtctgaatgatgggaaagagatagccatgtgaagttctggctaggtgctttcacataaatcttttcacttaatcctcacctcaccatgaactggatgatgttatctccatttaggaaacagtgtggcttggtaatttaaaagcatgtgcattgctgggtgtggtggctcacgcctgtaatcccagcactttgggaggccaaggcaggcggagcacgtgaggtc

SEQ ID NO: 65950 - DNA, 601 bp, Human
tgtccatcagtggagagctggttaaatacattatggtacatccaattaaggtaattctgtgtggcctttaataaaagcttctgatgggaacaagctacatgataaattggtaagtgaacaagcatggtgcactatggtggtactgtttatggaggggagaagggatgtatattgcagctatgtgtgtttaggtttgtatatcaatacactctctctgaatgggtactaaaaaacaaaacaaaaaaccaacaaccaaaacgtatagtggcccctgatgaaggagactgagactgcaggactygggtcaggagtgggagggaaactgacttttcactgtaaaacattttgaagtattaaaatttttatagcatagacatagccaaaaaattttattttattattattattattatttagagacagtcttgctctgtagcccaggctggagtgcagtggcatgatctcagctcactgcaacctctgcctcccgagttcaagtgattctcgtgcctcagcctcttgagtagctgggattacatgtgcatgccaccacacctggctaatatttatattcatatttttatttttatttttgtttgag

SEQ ID NO: 65951 - DNA, 601 bp, Human
gaaaaatactgtgatcaagttattgaaataagcacaatgtttgcctggtatttattagctattcataatggtagctattattatattgcgttgttaaacatttgcctttatttcattttaaccaggcttaagacagtcaagatacaaattgctttttattttatttgtttgtttgtttatttatttatttttgagatggagtctcactctgtcacccaggctggagtgcagtggcgcgatctcggctcactgtaacctccacctcccaggttcaagcaattctccagcctcagcctcccaratagctgggaccacaggcatgcgcccccatgcccggctaatttttttatttctagtagagatgggttttgccacgttggtcaggctggtttcgaatgcctgatctcaggtgatctgcccgccttggcctcccaaagtgctgggattacaggcgtgatccactgctcccggcccacattgctttttattacttatgctagacagtggggtagagtggggaagagtgttgactttcgagtcagagtcagatttcctggctttgaacctgccctgtcactagtgtgcagtcaaattactaaat

SEQ ID NO: 65952 - DNA, 601 bp, Human
tctacttttgcttttattatcttgctggataagtaagccggagcaccatttttttatttattcacagtctctgtgctttggaaaacatggtcagaggggatagtttttacgtgtagttttttatgtgtgtatatgggtgtgtttgaggtaaaatttacatacagtgaaatgcacagacagggtctcgcactgttgcccaggctggagttacagtggcatgaccacagttcactgcagcctcgaccttttgggctcaagtgatcctcccacctcagcctcatgagtagctaggactccaggygcacaccactacatgtgactttttaattttttttttttttcgagacggagtctcgctctgtcacctggcctggactgcagtagcatgatctcagctcactgcaacgtctgccttccgggttcaagcaattctcctgcctcagccttctgagtagctgggattacaggtgcgggccaccatgcctggctaatttttgtatttcttttttcagtagaaacagggcttcgccatgttggtcaggctggtctcgaactcctgacctcatgatccttccgcctcggcctcccaaagtgctgggat

SEQ ID NO: 65953 - DNA, 601 bp, Human
tcctaaaggtaggtgtggttgttctctttacacatctgtctctctggtcagtgagtcccctgtctggctgtggaagtaagtttaaaaagtcagcatggccaggcatggtggcccacacctgtaatcccagcactttgggaggccaaggcaggtggatcacctgagatcaggagtacgagactagcctgaccaacatggtaaaaccccgtctctactaagaatacataaattagccgggtgtggcggcatacacctgtagtcccagctattcgggaggctgagggaggagaattgcttgaamccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggag

SEQ ID NO: 65954 - DNA, 601 bp, Human
cagcactttgggaggccaaggcaggtggatcacctgagatcaggagtacgagactagcctgaccaacatggtaaaaccccgtctctactaagaatacataaattagccgggtgtggcggcatacacctgtagtcccagctattcgggaggctgagggaggagaattgcttgaacccaggaagcagagattacagtgagcagagattgcgccactgcactccagcctgggtgagcgagcagactctatctcaatagaaagttaacttaaggggccaggcgtggtgtaatcacacctgtaatyccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagct

SEQ ID NO: 65955 - DNA, 601 bp, Human
aattagccgggtgtggcggcatacacctgtagtcccagctattcgggaggctgagggaggagaattgcttgaacccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagcttcagggaaattatttttggtatttttatacaaccatattttccaagcccaaaatcagaactctgggtctgaggaagaatttttacagcattccagggaca

SEQ ID NO: 65956 - DNA, 601 bp, Human
ggctgagggaggagaattgcttgaacccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccrgctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagcttcagggaaattatttttggtatttttatacaaccatattttccaagcccaaaatcagaactctgggtctgaggaagaatttttacagcattccagggacaaggccatgagaacttgtttggatgctgaaatattggaattattagaat

SEQ ID NO: 65957 - DNA, 601 bp, Human
tctaaaacagaaatgtatgagagaagagcacagaaagtcctattttgtttacttgctagatttctgtggtattcaggaggaagaaaaaggagaaagtaaatacagaattgtgactttctgtttagcttaataaagattttagtaatccaggctgggcgcggtggctcacacctgtaatcccagcactttgggaggccggggcgggcagatcacgaggtcaagaggtcgagaccatcctagctgacaaaaaaccccgtctctactaaaaatagaaaaaattagccgggcgtggtggcaggckcctgtagtcccagctacttgggaggctgaggcaggagaatggtgtgaacccagtagacagagcttgcagtgagccgagatcgcaccactgtactccagcctgggcgacagagcaagactccgtctcaaaaaataaataaataaataaataaaaaagattgtagtaatcaaggctggatgtggtggctcacgcctgtaatccaagcactttgggaggctgaggtgggtggatcacaaggtcaggagtttgagaccagcctggccaacatagtgaaaccccatctctactaaaaatccaaaa

SEQ ID NO: 65958 - DNA, 601 bp, Human
ttgcccaggctggtctcaaactcctggccgcaagcattcctcctatctcagcctcccaaagtgttgagattacaagtgtgaaccactaaacctggcctctttttctttttttttaattcttgttatatcgctgatctcatatgacatcttctctttggttccagactgtaaaaggtgggatttcagagacacgtattgaaaagagaattgtgatcacaggagatgctgatattgaccatgatcaggtgggaatgttgaagagatctgggcctgggaggggtccctgggcaggaagaccgawgaatacaggagtttgtttgccatcttcatctgcaaaaagcctctttggccactctagctcttaattgagaagaaagacaaagacaatcaaagtaagaggcctgtgggatggaggccacagattgaggagccaggaaatgtaatggaaagaacatgagctttggattccaagacttgattcaattgctggttcttaatatattctagctgttaactctctgggcctccattttgcatctgtaagatgaagatgatagtatctccctctcagggttgttgtgagaatcaggtgaaatactgg

SEQ ID NO: 65959 - DNA, 601 bp, Human
gagagggctctggatgggaccctcggacacactgggagcccatccccacaaagaggtgttcaccctgggacttgataaaggcagacgagaggctgatgtgggagatataggaaattaagtatttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagccttccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctg

SEQ ID NO: 65960 - DNA, 601 bp, Human
tttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagcctyccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctggccagtcacaggtatctttgagccagaacctgggaaagccagaggagaaaaaaccaagaagagcaggatcaggctgtctggagatgggtgggcatgcagagcagggaggtaatggctgaag

SEQ ID NO: 65961 - DNA, 601 bp, Human; identical to SEQ ID NO: 22812

SEQ ID NO: 65962 - DNA, 601 bp, Human; identical to SEQ ID NO: 22813

SEQ ID NO: 65963 - DNA, 601 bp, Human; identical to SEQ ID NO: 22814

SEQ ID NO: 65964 - DNA, 601 bp, Human; identical to SEQ ID NO: 30824

SEQ ID NO: 65965 - DNA, 601 bp, Human; identical to SEQ ID NO: 30825

SEQ ID NO: 65966 - DNA, 601 bp, Human; identical to SEQ ID NO: 30826

SEQ ID NO: 65967 - DNA, 601 bp, Human; identical to SEQ ID NO: 30827

SEQ ID NO: 65968 - DNA, 601 bp, Human
gatgacgaaactgaggcatggagagattaagtggcttgcctggagtcacacagagctagaagcaatcctgagacccaaacccctggcctggatggagacactccctcctggcttcagggctgggagactggcttcagatcctccacctttcccagctgttcttggggcaagttactctgtgtctctgagtctcagtcccttacttgtaaagagggaagctgatagtgcccacctcatagggctctgcaggggccttgcccatggatggcatcccagacacaggccctggttatcacccctrcaggcgctttgctctgtccaccaagattcctgacaccaaaggctgcttgcagtgtcgtgtgggtaagaaatgggctgggcggggtggggcggggcctggtggggggcagcgcaggcccagcccggtgcccactgcctgctcccctgccagtgcggaacccctacacgggtgccaccttcctgctggccgccctgcccaccagcctgctcctgctgcagtggtatgagccgctgcagaagtttctgctgctgaaggtgaggggcggtggggggaggcccagggcaccctcagagctctggg

SEQ ID NO: 65969 - DNA, 601 bp, Human
cctcacctcaggtgatctgcccacctcggcctcccaaagtgctgggattacaggcatgagccactgtgcacccggcctaaaaatcaccatcttgacagaacttcacgccttgctttttgttttttttcatctttgtgcttgttttccacttaacccttgatcacagacatctttccatgtggattcatgtagaactacctcattcgttagaacagctgcagagtattccactgtgcggttagtccatcatttccctaaccatcctcctgctgatggacagttagactgttccagtttttcrgtatgattctatgccaggctgccatgaacgtccttttactgatccactcaggccagtatttctgtaggagaaattcctagaagtgggataattggatcaaaagatatgcacattctaaattaggagagagactgccaaactgacctcagacaaggttgtaccagtttgcacccccatcagcagcgtacaagtgcctgcttcccaacttcctcgccaacagtggatgctataaaaagcttcacaattttgccagtctcattggcaaatggtatcttggttaaatttgcatttctttaatac

SEQ ID NO: 65970 - DNA, 601 bp, Human
ccatgttggccaggctggtcttgaactcctgacctcgtgatccacccgccttggcctcccaaagtgctgggactacaggcgtaagccactgtgctcggccctatatttttttcagatagccagttatcctaatgctcccttgatttgatggaccacctggatcacacattatgagccccctcataagcaggtgggagtctcaagcgagggccagtcccgatgggaatagcacttggtggctgaggaccctcctatctgtgcagacactgttgtaaaacttcacatgcatcatctaatttartcctcaccaaaatcctatgaaatgtaggaatgatcattacacccatttatagataaggaaacggagggacagggagattactccgctacaggtcaagaggcagggaagtagagctgcgatttgaactgaggtctgtgtctagaacacgtgctcattctttccctaaaatgtattcataggtgaaaaagggcttctgcggaaagccctgggttatgtgggaaaccctggatttacagctgtctttccagcaggatgatgcaggagagagagggatgcgatttctcccaatctctcctggtc

SEQ ID NO: 65971 - DNA, 601 bp, Human
aatgattattttgctgagaacagtccgaacaactatgttaaactggggtctaaggtagttgatcacaactgtttgggttggcataagtcctcaaaaaacagaggcaggcacagggcatacatcctcaaaaatagaaaagataaatccatttgcattgagccttccagaagtgctggggtctaaaatgtgaaatacacacaaaattgacatttaagcaaactgcgctgacaaatctgtggctgaaaaagctgtggcaaaacaaaaacatagaaaaagagcctcaaaaattgggctgaggccrggcatggtggctcacgcctgtaatcctagcactttgggaagccaaggtgggtggatcacccgaggtcaggagttggagaccagactggccaacgtggcaaaacatcatctctacaatacaaaaatacaaaaattagctgggcgtggtggcaggcgcctgtaatcccagctacttgggaggctgaggcacgagaatcgcttgaacctgggaggtggaggttgcagagagccgagattgcgccattgcactccagcctgggcgacagagagagactctgtctcaaaaaaaaaaaaaaaaaaa

SEQ ID NO: 65972 - DNA, 601 bp, Human
aaaaattgggctgaggccgggcatggtggctcacgcctgtaatcctagcactttgggaagccaaggtgggtggatcacccgaggtcaggagttggagaccagactggccaacgtggcaaaacatcatctctacaatacaaaaatacaaaaattagctgggcgtggtggcaggcgcctgtaatcccagctacttgggaggctgaggcacgagaatcgcttgaacctgggaggtggaggttgcagagagccgagattgcgccattgcactccagcctgggcgacagagagagactctgtctcaaaaaaaaaaaaaaaaaaaaaaattgggctgtgaggtcatgcagggaattgatttttggtgggtgggtctgcttctgggatgatgtggatgcctcccgtggagaggggaagggttgatgaagtcccagggacctggaagtgtgttctgcagcaatccccctcccagcagagatccgtgaggaggaggtacagacggtggaggatggggtgtttgacatccacttgtaatagatggtgagtcctcccacagctggcaccagagctccccactgagggctgggggggagctggggagtatcag

SEQ ID NO: 65973 - DNA, 601 bp, Human; identical to SEQ ID NO: 38408

SEQ ID NO: 65974 - DNA, 601 bp, Human; identical to SEQ ID NO: 38409

SEQ ID NO: 65975 - DNA, 601 bp, Human; identical to SEQ ID NO: 38410

SEQ ID NO: 65976 - DNA, 601 bp, Human; identical to SEQ ID NO: 38411

SEQ ID NO: 65977 - DNA, 601 bp, Human; identical to SEQ ID NO: 38412

SEQ ID NO: 65978 - DNA, 601 bp, Human; identical to SEQ ID NO: 38413

SEQ ID NO: 65979 - DNA, 601 bp, Human; identical to SEQ ID NO: 38414

SEQ ID NO: 65980 - DNA, 601 bp, Human; identical to SEQ ID NO: 38415

SEQ ID NO: 65981 - DNA, 601 bp, Human
agctccaattcccacccagctcaccactggccccccaggaagcccagggggaagcctgaggctgccctgcgtgcagattccttccaaggcacagacccagtttccatagcaacagcctgcggccaggtcttcacccaccttgtgcaggtgttccagggccagcacgatctcacccccatacacgcgcacctcagcctccttgaagtactggcgctggtagaggtgggtgaacatctccccgccgctcacatagtctgggaggtgcagtggaagtcaggaagcagccccgtcaggtggcctygcctgcccccagccaccccacccccgttgggatgtggtgtgcgctcacccaggatgaggtgcagcttggcatccgtctggaaagcgtagtgcagcgtgaccaggaagggcgcctggcgcaccagctccagcaccgagcgctcggtgcgcgtgtgctcttgcgtcttggcgcgctgcaccagcgccgccttgcgcagcaccttcatggcgtacagcttccccgcgtcgtgcccgcccgccttccgcaccaggaacaccttgccgtaggctgtgggagcagcgagtgggtggagggtgggct

SEQ ID NO: 65982 - DNA, 601 bp, Human
ctccactcacctcctccgtcaggaactccttgctcagcccgaagtccgtgaggacaatgtggccctcggagtccagcagcacattctccagtttcaggtctcggtaaatgatgccgagctggtaggagcaagaggggtgctgaggcttcctccccgaaaccctccccagctcctccagctcctggccctgctcaggataaggagaccccccagagaaagtcatctgcctgtagagggggtctccagggcagagccactgaataagaaaggccatttaagatataaaacaaagaaggagggmcccgtggatcaggccccaaggtcccagagagaggaaagtctgtgtgaagagctccatttcaaggaggccttaggagccaggccgtgaggtttccatttgaggaagttctgtgaacgcagccccgagttccctgaaagaggaaagccccttcgaggaggtgccaggggaggggaccccaccaggcaacgttgaggcttcctgcaaggggtccaggggaagcagctccaattcccacccagctcaccactggccccccaggaagcccagggggaagcctgaggctgccctgcgtgcagattc

SEQ ID NO: 65983 - DNA, 601 bp, Human
agaatgcaggcccagagcaggaagaggcaggaaggagaaggattgaatggggcactgcaggcagaggtggcctccactcacctcctccgtcaggaactccttgctcagcccgaagtccgtgaggacaatgtggccctcggagtccagcagcacattctccagtttcaggtctcggtaaatgatgccgagctggtaggagcaagaggggtgctgaggcttcctccccgaaaccctccccagctcctccagctcctggccctgctcaggataaggagaccccccagagaaagtcatctgcctrtagagggggtctccagggcagagccactgaataagaaaggccatttaagatataaaacaaagaaggagggccccgtggatcaggccccaaggtcccagagagaggaaagtctgtgtgaagagctccatttcaaggaggccttaggagccaggccgtgaggtttccatttgaggaagttctgtgaacgcagccccgagttccctgaaagaggaaagccccttcgaggaggtgccaggggaggggaccccaccaggcaacgttgaggcttcctgcaaggggtccaggggaagcagctccaat

SEQ ID NO: 65984 - DNA, 601 bp, Human
cgcatggccagattcactctgcactgcactctaacatgtgtgtgctcctaacaagtgagcaaacacccatgtgtgctgatcaaccgtccatctgaatgacaggcacacagactgtacagggacggggacaaagaacaaaatgcctgggtgggtgctaaaagccataagtgtgggtttccgtactgatttggaccagcaggagatctatctagacccaaggtctattcccaactcggcaccatttactgtgccgtctggggcaggtcacctgccttctctgggtctgtccagtgaaaggacygaccaatccattctcaaatccctgacagccccaacagccaatgaacctagaatcctttctttcaggaacacatctgccaagtttcagtggggatggatgtgaagagaaacctagctgacacacacttgctttctttctctggggggatttccaaataaagtgaaactggccaggcacaacctcaacctggaacagcagccccacctgggtatgcaccaggaggtatggggccctgagtcagcctcacctggaagaagggatggttccggacttcttgtgccccctggggccccgcgccca

SEQ ID NO: 65985 - DNA, 601 bp, Human
ggcactgtgaagacactgcggcagccctggtctgctaatctggacttcttttatgtgaaaagaaaaataagtaagccacttatttataagtaagtataataaaaggtttacttataagtaaacctcttaggtcactctgttcattctgatctctgtggctagcaccaaacttgattccaacagatatcaccattttgagttggactttttgtcgatgtagccaagatgactgactcaagctggaaggctccagttctaccaccaaggacctgagcactgctctcaccaaagaagctgtccragaaaaagcagaaggaggccaggcgtggtggctcatgtgtctgtaatcccagcactttgggaggctaaggcgggcagatcacgagaccaggagtttgagaccagcctggccaacatggtgaatccctgactctactaaaaatacaaaaataagctggccatgatggtgcgcacctgtaatcccagctactcgggaggctgaggcaggagaatcacttgaaccagggaagcagaggttgcagtgagccatgatcatgccactgcactctgggaaatagagcaagactctgtctccaaaaaa

SEQ ID NO: 65986 - DNA, 601 bp, Human
tgggcagttcctccatgaggcaagggcccatctggcatttggggtgggcagctgttcctcctgcctccctggcttctctctccctctggtaacacaatccctattccccttagagaaccaccatgacaccacacttagtcagttctggaacttttaatagaattggtgtgaaaaggtcgggcgtggtggctcatgcctgtaatcccaggattttgggaggccaaggcagctggatcacctgaggtcaggagttcaagaccagcctggttaacatggtgaaaccccatctctactaaaaatmcaaaaaaaaaaaaaaaaaattagctgggcgtggtggtgcacacctgtaatcccagctactcagaaggctgaggcaggagaatcagttgaacccaggaagcagaggttgcagtgaaccaagatagcgccactgcactccagcctgggcgacaagagcgaaaaccccatctcaaaaaaaaaaaaaaaaaaagagttggcgtgaaaaacaaatctctttctcctgctggacttaaatctaagaggatgtggtctggaactgctggggaccctctcagggttagatgaagtccccatgcagaaa

SEQ ID NO: 65987 - DNA, 601 bp, Human
gaacgagaaactccctccactcagcccaccctcactgggcagttcctccatgaggcaagggcccatctggcatttggggtgggcagctgttcctcctgcctccctggcttctctctccctctggtaacacaatccctattccccttagagaaccaccatgacaccacacttagtcagttctggaacttttaatagaattggtgtgaaaaggtcgggcgtggtggctcatgcctgtaatcccaggattttgggaggccaaggcagctggatcacctgaggtcaggagttcaagaccagcctrgttaacatggtgaaaccccatctctactaaaaatacaaaaaaaaaaaaaaaaaattagctgggcgtggtggtgcacacctgtaatcccagctactcagaaggctgaggcaggagaatcagttgaacccaggaagcagaggttgcagtgaaccaagatagcgccactgcactccagcctgggcgacaagagcgaaaaccccatctcaaaaaaaaaaaaaaaaaaagagttggcgtgaaaaacaaatctctttctcctgctggacttaaatctaagaggatgtggtctggaactgctgggga

SEQ ID NO: 65988 - DNA, 601 bp, Human
gggcgggagtccggggaatgggcatgggcatgggggttgggggtgcgggtgaggagactctggtggggaaccaggcaaaggcaagaccctggacaagggggcagtggggggtgttccagttgcattctggtacacacaggatgtgtggacactttttattccacctggttttataatcacttggggccatgtctgtccccaccagcctgtgaccccaactttctcatcagagtgaccacttattcctccccaggtgccaagggctgaaggcactgaaaggaccaatgaatatattgaaagkgtggcctgagttcacgcttagcttatgagaatccaactctatccgctgaggaaaaaaaccttattcctccctttcaagccggactttggcttcttctgcaaggggagctactgaagaaatgcaaaaagaaggcagagttaattctttgcttttcctaaagatccatgtcctggcaatttgaggagcttttaagggtcattttaattgcgtgttgtggccaggcacggtggcttgcgcctgtaatcccagtactttgggaggctgaggcaggtagatcacctgaggtcaggagtttgagac

SEQ ID NO: 65989 - DNA, 601 bp, Human
cacctgcatcatagcgctcctggccaccgctgcccgacctggccggtctccagcaccaggcgcttccagcccatcggtcatcaccgcgttgttgtggtcaaagagaatggagggtgccacaaaggagtatccctgcagggcgggagtccggggaatgggcatgggcatgggggttgggggtgcgggtgaggagactctggtggggaaccaggcaaaggcaagaccctggacaagggggcagtggggggtgttccagttgcattctggtacacacaggatgtgtggacactttttattccayctggttttataatcacttggggccatgtctgtccccaccagcctgtgaccccaactttctcatcagagtgaccacttattcctccccaggtgccaagggctgaaggcactgaaaggaccaatgaatatattgaaagtgtggcctgagttcacgcttagcttatgagaatccaactctatccgctgaggaaaaaaaccttattcctccctttcaagccggactttggcttcttctgcaaggggagctactgaagaaatgcaaaaagaaggcagagttaattctttgcttttcctaaagatc

SEQ ID NO: 65990 - DNA, 601 bp, Human
cacccacccacggcggcaagccccctcccaccacccaggccccgcccccggccttcgggccctgccaatgttcgagaaccccctcctcaaagtcctttttctttctttctttctttctttgttacttttttggagacagtctcgctttgtcgcccaggctggaatgcagtggcaccacctcggctcactgcaacctctgccttccgggttcaagcgattctcgtgcctcagcctcccaagtagctgggattacaggcgcacgccaccgcgtccggctaatttttgtatttttcgtagagamggggtttcgccatgttcccaggctggtctcgaactcccgacttcaagtgatccgcccacctcgacctcccaaagtgctgggatcacaggcgtgagccatcgcgcccggccaaagtcccttttcttgtccatcctcagctccgccttcccgtcctcaggccctactcccctcaaattccactccctgcgcctccctggtccctttgggccccgaatcaaacgctaggccccgcccaattcacccctagatcccgcccatagtgcccccaagccccgccgcctgccccttttctctccgccc

SEQ ID NO: 65991 - DNA, 601 bp, Human
gcagctccccgccccgcagcagctccaggaccaggtacgtgtgcagctgcgggcggcgtggcgggccaaggtcaacacccacccacggcggcaagccccctcccaccacccaggccccgcccccggccttcgggccctgccaatgttcgagaaccccctcctcaaagtcctttttctttctttctttctttctttgttacttttttggagacagtctcgctttgtcgcccaggctggaatgcagtggcaccacctcggctcactgcaacctctgccttccgggttcaagcgattctcgtgyctcagcctcccaagtagctgggattacaggcgcacgccaccgcgtccggctaatttttgtatttttcgtagagacggggtttcgccatgttcccaggctggtctcgaactcccgacttcaagtgatccgcccacctcgacctcccaaagtgctgggatcacaggcgtgagccatcgcgcccggccaaagtcccttttcttgtccatcctcagctccgccttcccgtcctcaggccctactcccctcaaattccactccctgcgcctccctggtccctttgggccccgaatcaaacgctag

SEQ ID NO: 65992 - DNA, 601 bp, Human
ggatctggcttgcttccgactcgctgaagtgccgcttcttgcggatgtgctccagcagctccccgccccgcagcagctccaggaccaggtacgtgtgcagctgcgggcggcgtggcgggccaaggtcaacacccacccacggcggcaagccccctcccaccacccaggccccgcccccggccttcgggccctgccaatgttcgagaaccccctcctcaaagtcctttttctttctttctttctttctttgttacttttttggagacagtctcgctttgtcgcccaggctggaatgcagtgkcaccacctcggctcactgcaacctctgccttccgggttcaagcgattctcgtgcctcagcctcccaagtagctgggattacaggcgcacgccaccgcgtccggctaatttttgtatttttcgtagagacggggtttcgccatgttcccaggctggtctcgaactcccgacttcaagtgatccgcccacctcgacctcccaaagtgctgggatcacaggcgtgagccatcgcgcccggccaaagtcccttttcttgtccatcctcagctccgccttcccgtcctcaggccctactcccctc

SEQ ID NO: 65993 - DNA, 601 bp, Human
ggatgttctgcgagggcggcggggtagtggtcagaggcagcccccggcgccaccgctccgccccgccgccgaggcagctcgcccacctccggcttgaggtcgcggtgcaccacgcccgcctcctcgtgcatgaagctcacggccgacacgaggctgcgcaggatctggcttgcttccgactcgctgaagtgccgcttcttgcggatgtgctccagcagctccccgccccgcagcagctccaggaccaggtacgtgtgcagctgcgggcggcgtggcgggccaaggtcaacacccacccacsgcggcaagccccctcccaccacccaggccccgcccccggccttcgggccctgccaatgttcgagaaccccctcctcaaagtcctttttctttctttctttctttctttgttacttttttggagacagtctcgctttgtcgcccaggctggaatgcagtggcaccacctcggctcactgcaacctctgccttccgggttcaagcgattctcgtgcctcagcctcccaagtagctgggattacaggcgcacgccaccgcgtccggctaatttttgtatttttcgtagagacggggtttcgcc

SEQ ID NO: 65994 - DNA, 601 bp, Human
agcgcactgcgggcccagaggactcgagcacgtcgggcgtccggagcgggggcgaggagcgcgcgctgccgtcctgcagccacgagctgccccgcagtccctcgagcttcagccgcttggcggggtccacggtcaggagccctggaggcggggcaaggaagtgtggggaggagcctggcgtaaaggctgagccccaaagagatcgtaacagccccactctcctcccctacccatccccaaccaggacacctggcccagtgaccatccctgtcccagcgtccccctccccaaccatggtctrtgacctccagctccgcacctcggaccagctccttggcttcctcggatacaccctgccaggcctccccgtcaagggagaagcgcccctcgcggattttgcacatgatctcggccgcctggctctgcccgccctggccagaggccccctggaaggggacctgccccgacagcatcatgtactaggagggtgaggggaaggtgaggccggcccaggctggggtgccgaggctgacccctccgctcccacagaaccactcaccctccccactaggggcactcctgagacccacgcgtggtgaac

SEQ ID NO: 65995 - DNA, 601 bp, Human
aaaggaaagggtgagtgcccccacccccgcctgaccccggcttccagatctagtttgacctccattcccagaccttgcctccagccgcctaggtcaaggccgacagggccttggcctccagaccgaccaccggattcggttcacctccctttttttttttttttttttttttttgacggagtctccctctgtcgcccaggctggagtgcagtggtgcaatctcagctcactgcaacctccgcctcctgggttcaagagattctcctgcctcagcctcctgagtagctgggattacaggcgygcgccaccacacccggctaatttttctctttttagaagagacggggtttcaccatgttgttcaggctggtctcgaacccctgacctcgtgatccgcccgcctcggcctcccaaagcgctgggattacaggcgtgagccaccgcgcccggcctcacctcgcctttctgtgctccgatggccgggcctccccagaccccacctctcgaggcttcgcccaccccttcccttcaacagaccctgccccttaccatgaaggtggcgttgagacccgagcgcactgcgggcccagaggactcgagc

SEQ ID NO: 65996 - DNA, 601 bp, Human
gagaccctcagtgaccactccctggtccaagggccctgccccttcccagagtaaacccactgggggtctaagagtgggcgttgtcggctcccccagcttctgtcctccccagaatcttccagggtaaccaccaagccctcctgcagatcccagccccactcccctcagcagcagggccgcagtaggaagctgagccattcctgcgctccttttcttggtctccacctccgtcccgcaggctggatgcacctaattcacggaaatcaaccctcccctccctgtcttcttaagtgtcaatagyaaaacacaatgaaacttttagccattcccttctctggtgcggtgtgggtctgctctgcctcccctgggacggtggttttgtgtaggagggaggaggaggatcggctgtggcttgctgactttggggcagccccttggaggcaggggacagttgaggttcgaacacttctcccaatggcagctctcaagaggtcagtgctgccctgaggggtttcaggaagcaggatgaggtggtggcagtgggagccctgcaatgagattctggccctaagcccttctgtgcactgagggacagaatctg

SEQ ID NO: 65997 - DNA, 601 bp, Human
gtcggctcccccagcttctgtcctccccagaatcttccagggtaaccaccaagccctcctgcagatcccagccccactcccctcagcagcagggccgcagtaggaagctgagccattcctgcgctccttttcttggtctccacctccgtcccgcaggctggatgcacctaattcacggaaatcaaccctcccctccctgtcttcttaagtgtcaatagcaaaacacaatgaaacttttagccattcccttctctggtgcggtgtgggtctgctctgcctcccctgggacggtggttttgtrtaggagggaggaggaggatcggctgtggcttgctgactttggggcagccccttggaggcaggggacagttgaggttcgaacacttctcccaatggcagctctcaagaggtcagtgctgccctgaggggtttcaggaagcaggatgaggtggtggcagtgggagccctgcaatgagattctggccctaagcccttctgtgcactgagggacagaatctgaggttccttcacccacttggacctcacttttccagttaagtggcctctgcacgcgaggagagtgagctccaggactctgcct

SEQ ID NO: 65998 - DNA, 601 bp, Human
atctgtcactgcccctttttcacagacgggtggggcgctttggggcctgatgctttctgggaggagcttgagggtaggctggtacctggcaggtgaggagtggagtctacagctccaaatgtgaaaatgaaataagatcaaactcaaagaggggttgaggacaagtgagcaagtttgttgatgattaacttgcagatccttcccgtgtcccttaccctctggactggcctttgctgggtgagccttgcagtcaaagccggcagctaggatttggggtgcacatgtctctctgctagggctstgagggcatggggactctgttcttggagctgagaaaccttgcttctctttccttccagccttgcgggccttgcccgtgtgggactgcatcagagcgtactgaaatcactggccctcatctggtttcagagctgccagttaagctgttagattctcccacccctggtgacagtgatgcacctaggagttaagggagtagatttggagacccctttaaaaaaaaaaaaaagcgagggctagtatttttatttcttactgctattgttgttccaacctagttttagtaaatgccggataagca

SEQ ID NO: 65999 - DNA, 601 bp, Human
ctcctgtgtcagcagagaaaggtggcctctgggggctgcgttcattcttgagtgctgcctgtgtgactgataagggcattccaaagggcagctgggtccggcaggggtggtgcccttggctccaggggctgccgaccagttgcgtggtcccggcagtgcctcatgccgagtcatcccccggcggggcctctgtgggcagcccggccagttcgttcgttccccaccatggtcactaggcaactgtgaactaagcgggagtttttgtgtctcaatctccccatgaaagctgtatcagcatcarcagggtagtgtttctacttgcagtagcagatcagagacctggccagctttgtgtctgactttctgctggccactgccacatcagtgagttccattgagttatcacagcagctgcatctaggaggaagctcctgcctttcagaggaggaagcagaggcttaggaaagttaagtaattggcctaagatgacaggcaggccagcaagtgtcggcgctaggatttgaacccaggtaggggctgtgctcctactgcggcggagctgagaagggtgccttggcatgaaggctgtgggcgaaggagt

SEQ ID NO: 66000 - DNA, 601 bp, Human
gggtttggtgtatagattatttcatcacccaggtaataagcgtagtatctgataggtagtttttcttttctttttttttttttggagacagggtctcactctgtcacccaggctgggagtgcagtggcacaatcacagctcactgtagcctccacctcccgggcccaaacaatcctcttacctcagtgtcccaagtagctgggaatacagatgcatgccaccacacccaaatttttttaaatttttgtagaggggggtctcgctatgttacccaggctggactcaagcagtcctcctgcckcagcctcccagagtgctgcgattacaagcgtgagccaccatgcccagcctgctaggcagtttttctgtcctcacccattccaccctcaagtaggccctggtgtctgttgttctcttctttgttgccatgtgtactcaatgtttcacacccatggatgagtgagaacatgcggtatttggtgtggaacatgcggtatttggttttctattctagtgttagtttgctgaggataatggtctccagctccatccatgttgctgcaaaggtcatgatcttgttcctttttatgggtggatagta

SEQ ID NO: 66001 - DNA, 601 bp, Human
agtgctgcaatggacgtatgtgtgcatgtgtccttatggcagaatgatttctcttccttagggtttatgcccagtaatgtgattgctgagtcgaatggtagttctgttttaaattctttgagaaattgccaagctgcttttcacagtggctgaactggtttacattcccaccagcagcgtataaatgttcccttttctctgcaacctcaccagcatctgttatttttagactttttaataatagccattctgactgttatgagatgttgtctcattgtggtttgatttgcatttctctaaygattagtgatgctgagagttttttcatatgctcgttggccgcgtgtgtgtcatctttggaaaaggtcacagacttatttcatcacttagcatcatgtcttctaggtcccaggattttctgagctagagcttcctggtggcttatgatcccttatcagagggggctctggcttttactcactaaaaccactccctctgcaggtgggcctttctctccagcccacccgcttgggccatgttttctgtgtccttttgctcggcatcagttctgtcactcccactggggcctgagctagtcaag

SEQ ID NO: 66002 - DNA, 601 bp, Human
atgatttctcttccttagggtttatgcccagtaatgtgattgctgagtcgaatggtagttctgttttaaattctttgagaaattgccaagctgcttttcacagtggctgaactggtttacattcccaccagcagcgtataaatgttcccttttctctgcaacctcaccagcatctgttatttttagactttttaataatagccattctgactgttatgagatgttgtctcattgtggtttgatttgcatttctctaatgattagtgatgctgagagttttttcatatgctcgttggccgcrtgtgtgtcatctttggaaaaggtcacagacttatttcatcacttagcatcatgtcttctaggtcccaggattttctgagctagagcttcctggtggcttatgatcccttatcagagggggctctggcttttactcactaaaaccactccctctgcaggtgggcctttctctccagcccacccgcttgggccatgttttctgtgtccttttgctcggcatcagttctgtcactcccactggggcctgagctagtcaagctaacagcaaggcccctaccttggtgggtgccaaagcctgaag

SEQ ID NO: 66003 - DNA, 601 bp, Human
ggcgtcttttaggctgagtgaggtgcctttgagggcagcgagggcctggtgggctaaggagcgccggtgggcctggtggggcgtgcagttacgtggtcactgcctgcatggcacaggcctgagtgctgtggccctttttgtcacctgtgggtgtggctggccagtcactgtgtttccctcacagcaaaagcacattttctgtaataaacaggaaattttagtcacctgcaaagaaatgggcttacctctgttgactccagcttgagatgacggccagtaactgggtttcagagcaggtggsgcagggcttctggacctggggcagggagttttggagtgctcactcttctttcttccttcccctcctttttctctctttccccagggccccccagccatccagggggaggggggagtggggccttgctgggtggagtttgggagggtgacctcagctccccaggcgccgtcctgactcccaggccaaagctaacatgggctgagcacagcccatcagggcgccctcattcccaagaactcggttttggcatcacagcctccccagctgtgtgaattctagtttcagcttgtggcgggctga

SEQ ID NO: 66004 - DNA, 601 bp, Human
ggcacgatgcccttccacaccttctgggcacagggaacctggcagctctgctgtctccgaccatccacctgagcctctggaaggctgatcgggcctccccgtccaggctggaggccaggaccccggctcccctgcactgctaccctgttaagaagcttggccctcggggctgcttctggtcagagtgccctatttcctgttgagctggggcagggaacggccgcacatcacctgtggagaggctgccgaggctgtgtggctgaagctgtggatttgggattttccttacattttggtgacyttgctcaaggatgaaagtccttgaccggtgatgggtccaggccgctggccccttgttcccacagagccctggcttcccctgccccagcctgccaaggaggctgtccctgtcgggtcctgggctggaggcccagtgctcccacacgccctcctccctgcagcccggctgaggaattggtatttaaatttcacagatggagaaagtaactgagaagttaggaaaagaacttcaggtcacagagtcagtggcagggggcgggagtggagtgcagagccatcttagttagtggcccgagttcct

SEQ ID NO: 66005 - DNA, 601 bp, Human
cgcggtggctcaggcctgtcaccccagcactttgggaggccaaggcgggagaatctctgagcccagcagttcagcatagacaacatagtgagacccccatctctacaaaataaaaatttaaaaattagccagacatggtggcacacgcctgtagtcccagctactcaggagtctaaggtgggggggatggcttgagcccaggagttcaaggttgcagtgagcgaagattgtgccactgcactccagcctgggtgacagagcaaaaccctgtctctaaaaaaatgaatataaaatttttttwaaaagaatatggagcttaaagctggagtctgtccagtccaaccactttgttttggagaagtgtttaagacccaggaaggggaagtggttcgtagcacttcctgggcttcttgtagagcagaggtcagcaaactttttctgtaagggtgggatagttaatacttccagctttgcagaccttatagtttctgtcacaacgactgaactctgctgtgttagacaaaagaagccatggataatacaaatgagcatggctgtgtttcaataaaactttatttatacaaacaggtggtgggccagg

SEQ ID NO: 66006 - DNA, 601 bp, Human
cacagcccctgtccactcctcagccttcatggggaaagcagagcacgcaaacaaaaaataaacatcagttatttgtgtcgtctcggagcgagcacaggctgctgcgggagctggcgctaggggctgtcccagtggagtagaagggctgggggggcctggcaggagctgaagcttaagctgtgacaggaagcagctcgtgaggagacagggtgccagcctgcagcccggggagcactgtgcatggaagccaaggtcacgctgaggcagtgtcagttcagcaggccttgcagaccatccttasgtctcctggcagcccaggcctggtggcacctatcagcagcctctgaatggccaaagggtttggaatctcagtggctgaccaagtacttgagtgagagccggtgtgggtggggccaggaaacaaaggttaatgccaccagcgggcccttccaacacagaatgacagaacacatgcccttggcgtgtctgactttggatagcaccctatcgtgagccagcctagacgagtcaccatgagtgacagtcccggctgtggttggggttgaccccgtggacaggagtgtttgacacagattgtctg

SEQ ID NO: 66007 - DNA, 601 bp, Human
gctgtcccagtggagtagaagggctgggggggcctggcaggagctgaagcttaagctgtgacaggaagcagctcgtgaggagacagggtgccagcctgcagcccggggagcactgtgcatggaagccaaggtcacgctgaggcagtgtcagttcagcaggccttgcagaccatccttaggtctcctggcagcccaggcctggtggcacctatcagcagcctctgaatggccaaagggtttggaatctcagtggctgaccaagtacttgagtgagagccggtgtgggtggggccaggaaacraaggttaatgccaccagcgggcccttccaacacagaatgacagaacacatgcccttggcgtgtctgactttggatagcaccctatcgtgagccagcctagacgagtcaccatgagtgacagtcccggctgtggttggggttgaccccgtggacaggagtgtttgacacagattgtctgaacagctgagaagtgaccaagcccacatttgtatcagcagggcacctagctattctttcaggctcttagcacagggctcggttgtttcagaaataggctccagccaggcatggtggctcatc

SEQ ID NO: 66008 - DNA, 601 bp, Human
gtaatcccagctacttgggaggctgagacaggagaatcacttgaacccaggagggagaggttgcagtgagctgagatcacaccaccgcactccatcccaggtggcagagcaagactctgtctcaaaaaaaaaaaaaagaaaagaaataggctctggccaggcatggtggctcacgcctgtaatcccagcactttgggaggccaaagcaggaggatcccttaaggccaggagttagagaccagcctgagcaacctagtgagaccctgtctctatttaatttaaaaaaaaaaaaaaaaaaaaagcccttgccgtagctcctatctccaggccagccaggccggagcgtggctggggaactgtcctgcctgccaagccaggccctttggtgatacgtccccagttcttcaacagagcagggtgcttgcccccacctcatggcatgcagggggtaccagggtagacatcatgtgggcatgaaggcttcagtgacagatgtgcctgtggccagggtcacagtcccctgatctccagaatataactgaggactgaggatgggcacttcctggggagcccatgtccctgcctgctcagaggcatggag

SEQ ID NO: 66009 - DNA, 601 bp, Human
gtccctggggagactctagatccagacccacatggcacggggctgcctccctcaggcagttctcagccaggcccccacccagggcacaggctcaggctgagcggggtggtggatgggctggagccggggagaagggcagcaaggctggctggccgcagccctctgtggctggacacgacttggcaaggccgagggatctgagggctgggctactctcgagggctgccaggttcccagcttgctgcagggaaatgaagggggtgccgccctgaacaggcacatgcctaagcaaggtattgaygcttggataaagctggcaaccaccaggagaagcctttttgggatttttcaaatccttcgtcatccgagctgtgatgatggagtggagcgtggcacgggcccattggagttctgtgggctccatcggcactcagcagggatttggacgtgcaggctggtgggccctgcaggaagcctgctccctgctctgctgcgtgggagggggcagctcgggggaagggggcttgcagagaaacagaagaacatgggctgtggggcaccttcagcagcccggggttccaatcccagctcctccatgtgg

SEQ ID NO: 66010 - DNA, 601 bp, Human
acgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggtacggctgtcccgaggccccatgcaggctggtggccatcagggcagaaggaaggcccagggcactggatttggagggaatcccatctccatggggaagggcctccctgaacggaagcagctgggttaatcaccagcacyccacccaactcagagttgacccaggcggtgacactgcagaggggaatgtggtgactcaccctgcgtggtggggggagggcagggccatgccaggcgctctggtgccctgtccatgaatccttgccgcagccctgcaaggaaagagctggaggtgcctcctgtgtacaggttagagagccaagggccagatggttttgccgagtcgcccctgctagtgtgggggagcagcactttctgcttgtgaagccctgactggaaccacttggcctggagtctgggaggggcctcccttcccagccc

SEQ ID NO: 66011 - DNA, 601 bp, Human
aagatgcaggtacggctgtcccgaggccccatgcaggctggtggccatcagggcagaaggaaggcccagggcactggatttggagggaatcccatctccatggggaagggcctccctgaacggaagcagctgggttaatcaccagcaccccacccaactcagagttgacccaggcggtgacactgcagaggggaatgtggtgactcaccctgcgtggtggggggagggcagggccatgccaggcgctctggtgccctgtccatgaatccttgccgcagccctgcaaggaaagagctggagrtgcctcctgtgtacaggttagagagccaagggccagatggttttgccgagtcgcccctgctagtgtgggggagcagcactttctgcttgtgaagccctgactggaaccacttggcctggagtctgggaggggcctcccttcccagcccttgtccttcctcccccgcccacaggaactcctgcagacccaggacttcagcaagttccaggcgctgaagcccaagctgctggacacggtggatgacatgctggccaacgacatcgcgcggctgatggtgatggtgcggcaggaggagtccct

SEQ ID NO: 66012 - DNA, 601 bp, Human
gagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataaygttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggccc

SEQ ID NO: 66013 - DNA, 601 bp, Human
cggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagygactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtc

SEQ ID NO: 66014 - DNA, 601 bp, Human
ccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcrcttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggcca

SEQ ID NO: 66015 - DNA, 601 bp, Human
aaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggtyctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcacca

SEQ ID NO: 66016 - DNA, 601 bp, Human
gcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtatt

SEQ ID NO: 66017 - DNA, 601 bp, Human
ggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggygcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagt

SEQ ID NO: 66018 - DNA, 601 bp, Human
ccgaacagggactctggctaccacatacctttatgaccttgggcaagtcccatacctaaccccttgaaccctcagtttcccagctgtaaaagtgccccacagagttgggtcgtgagaattaaaggggataatatggtcaaaacatccagcatggttcatgacacctaagtgctcaatatacaagtcctattcacagccagcacacaataaatatttgtcaatagtcaacatacagtgaggggccccagggtaggtaggagatacccgcaccctggccggctggctcactgttcttcagagygggaagggtgcacaaagtttaagattggtggattttggccaagttaaaacttgctggattggcggggtgcagtggctcacacctataatcccagcactttggaagcccgaggagggcagatcgcctgaggtcaggagtttgaggccagcctggccaacatggtgaaaccccatccctactaaaaacacaaaaattagccgggcatggtggcaggcgcctgtaatcccagctacttgggaggctgaggcaggtgaatggcttgaacccgggaggcagaggttgcagtgaaccacgactgca

SEQ ID NO: 66019 - DNA, 601 bp, Human
ttggcaagggccaaggcctttagtagaacatactcctctcgctccagccgcagggcctgcagccgccgcactagttgcagcagggcagcccccagttcccccaggccagctgcccgtgccccctcttcatccaggactaagtcctcagcgaaggccagctcatcctgcagtggcagtgagcgctgggccacacccagcaccagcacctccatccacacgctctgcagtactgacatctggtcagacagcgacagcgatgagaagcctagggggcagcggggagcgggcctggctgagcaarcgcaccagagccgggcccgttcagggcagccccgggtcacctgggccctttacctgggatgctcttggcccagctgatggtgaccacaatctctcggtcaaagaggtcacagagggtagccacggctgggaggtgcccatcagggcctgcggggtcaggcatggcatagagcttctcaggctcaaccaccagcagatgagacaccagtgcattcactggggctgctgtgacaattagaggacaagagtcaggagcactcgaatctgtcaggcctcaggggtcaagcatcttcccacagtg

SEQ ID NO: 66020 - DNA, 601 bp, Human
tgctggatggggcctaaggaagagccaaacgaggatttgttgattggctgactgagaggcaccactcattgctgcggctcgtgggccaggaccccaccctctctccctcaactgtggccaccttgtaccctccccaccttccctcccactaaatgacctttctgcattagtgtggcactagggctcaaaatcctgtgtgcagtttggagcctgcacttggcttgctttttgacttctagcaagtcattgttcttccctaagcctcagttttcgttatctgcaaaatggggctgtgctaccrtcactgagttaacctgaagaccttacggagacacctcacctgtcagtgcctgccccagactcacctgaattggcaagggccaaggcctttagtagaacatactcctctcgctccagccgcagggcctgcagccgccgcactagttgcagcagggcagcccccagttcccccaggccagctgcccgtgccccctcttcatccaggactaagtcctcagcgaaggccagctcatcctgcagtggcagtgagcgctgggccacacccagcaccagcacctccatccacacgctctgcagtact

SEQ ID NO: 66021 - DNA, 601 bp, Human
aagacttataataaaaggttacagttccttgccacatcctccccaccccagccccacctccagtctatcttcccagggacaatctatttatttgctttttttttttttttttttaaagttgtgtgtgtgtctgtattttaatattgatccggggtctcactatgttgcccaggctcgtcttgagctcctgagctcaagcaatctgctgcctcagcctcccaaagtgctgggatttacaggcatgagccactgagcccggccttatttgcattatttttaggcatggaaaagacgtaaacgrtttggggaaagcatattttaaatagctaagattctgcacttagatcactttggaagtgtccttatgtgcctgctttgcttttagagttaactaatgcaccagcttaatagtcgcctggttgaaaattctaaaagtacaaaaaatttacagtaaaaagtcttcccctaactcctgtccccagtgacacagttcctctccctggggaccttccttgttaccagttcttgttatcattctacaggtgtcctgttttactgtttcatttttaattattgtcatggtttcctccatgtctctcta

SEQ ID NO: 66022 - DNA, 601 bp, Human
cgcccaggctggagtgcagtggtacactctcggctcactgccacctctgccttcagggttcaagcgattttcctacctcagcctcccaagaagctacagacatgcaccaccacgcctgctaatgtttgtatttttagtagagatggggtttccccatgttggccaagctggtctggaactcatgacctcaagtgatccgcccgcctcagcctcccaaagtgctgggattacaggcgtgagcacccggccatcagcccaatttttatcccagttccttgaacagaccaagtccctccatctmcttctgaaaccaaagaaccccaagcctccaaagaagggaggttctgcctcaggaacctccttccctgcgggagaagatcctgcgcttcagcgccctggacacagaagaaaccatcactggagttgaagtccctggaagggcagacttgggtctgaggtgaaaacaagattcagttttcatcgttatgttcataataattttaaaataatgtcctatggtttggggtacttgacagtttaataacatctcctatgccaggcacggtggctcacacctgtaatgccagcactttagggggcc

SEQ ID NO: 66023 - DNA, 601 bp, Human
ctttggccattggcctctggcatcaaggcaccctggctttaagccttcgcgtgtaattttagcaacttttcctactatgtacctcagtttctccatctatcaaataggaggacccctaaaggcccatttggactgctccaacctcagcccaacttttttttttttgagatggagtctcgctctgtcgcccaggctggagtgcagtggtacactctcggctcactgccacctctgccttcagggttcaagcgattttcctacctcagcctcccaagaagctacagacatgcaccaccacgcytgctaatgtttgtatttttagtagagatggggtttccccatgttggccaagctggtctggaactcatgacctcaagtgatccgcccgcctcagcctcccaaagtgctgggattacaggcgtgagcacccggccatcagcccaatttttatcccagttccttgaacagaccaagtccctccatctacttctgaaaccaaagaaccccaagcctccaaagaagggaggttctgcctcaggaacctccttccctgcgggagaagatcctgcgcttcagcgccctggacacagaagaaaccatc

SEQ ID NO: 66024 - DNA, 601 bp, Human
gcggaggtccccttttgcccaatgctccctccatctttggcccgagtgccccaatctaacactcaccaaacacctgggcccgggggaaagcagggaactcctcgaggcggcggaagaggttgcggtgggtgtaggccaggtctccatgcagcttgcggaagtcgctgtaccgcttccagaccaccacctatgagggacatgagacttgcccagaaccagcaatggtgggaggcagccgcccccatgcctagcctgcccccagggggcgtgaggatcaggaagcagctgcagcagcccctcrcccagggacagggaggaaggagggccgatgtccaagcagagttaccagctgccccttgacagtttccagatctggaactgcagaacagtccctcttcctcccaggagcctcacctctttgacatcctctgggtccttctttgagatgaactgagaaagaaaggcaagagctggttgagaccagagactgccatctgacaccctctcaccctgtaatgccccaggtgcctcctagtccccctcacggggcagtagcctttggccattggcctctggcatcaaggcaccctggctttaagcc

SEQ ID NO: 66025 - DNA, 601 bp, Human
ctctgagcctcagtttccccatctgtcaaatgaggtcatctctaagggcccttccaaacatgactctgcccagggtttcaggccctctctatccagcccccactggcggaggtccccttttgcccaatgctccctccatctttggcccgagtgccccaatctaacactcaccaaacacctgggcccgggggaaagcagggaactcctcgaggcggcggaagaggttgcggtgggtgtaggccaggtctccatgcagcttgcggaagtcgctgtaccgcttccagaccaccacctatgaggkacatgagacttgcccagaaccagcaatggtgggaggcagccgcccccatgcctagcctgcccccagggggcgtgaggatcaggaagcagctgcagcagcccctcacccagggacagggaggaaggagggccgatgtccaagcagagttaccagctgccccttgacagtttccagatctggaactgcagaacagtccctcttcctcccaggagcctcacctctttgacatcctctgggtccttctttgagatgaactgagaaagaaaggcaagagctggttgagaccagagactgccatct

SEQ ID NO: 66026 - DNA, 601 bp, Human
gagttttgccttggcctcccaaagtgctaggattacaggcgtgagccacacgcctggcccaacaggaatgttaaaaggtgaaatacacagtaagggttaggctactctgagcctcagtttccccatctgtcaaatgaggtcatctctaagggcccttccaaacatgactctgcccagggtttcaggccctctctatccagcccccactggcggaggtccccttttgcccaatgctccctccatctttggcccgagtgccccaatctaacactcaccaaacacctgggcccgggggaaagcrgggaactcctcgaggcggcggaagaggttgcggtgggtgtaggccaggtctccatgcagcttgcggaagtcgctgtaccgcttccagaccaccacctatgagggacatgagacttgcccagaaccagcaatggtgggaggcagccgcccccatgcctagcctgcccccagggggcgtgaggatcaggaagcagctgcagcagcccctcacccagggacagggaggaaggagggccgatgtccaagcagagttaccagctgccccttgacagtttccagatctggaactgcagaacagtcc

SEQ ID NO: 66027 - DNA, 601 bp, Human
agccacaagttaattttaatattttatttaacccaatatatcccaaatattctcattgcaacatgtaatcaatatactaagtattgagatgggccgggtgcagtgtctcacgcctgtaatcccagcactttgggaagccaaggcgggcaggtcagctgaggtcaggagttcaagaccagcctggccaatatgatgaaactctgtctctactaaaaatacaaaaattagccaggcgtggtggtgcacacctgttatcccagctactggggagactgatgcaagagaatcccttgaacctggraggtggaggttgcagtgagccaagacagcgccactgtactccagcctgggtgacaaagtgaggctgtcaacaacaacaaaaaagaaaaaggaaaataaaatggagctgataaagacaggattttttttcctttgagatggagttttgccttggcctcccaaagtgctaggattacaggcgtgagccacacgcctggcccaacaggaatgttaaaaggtgaaatacacagtaagggttaggctactctgagcctcagtttccccatctgtcaaatgaggtcatctctaagggcccttccaa

SEQ ID NO: 66028 - DNA, 601 bp, Human
ccctggacacctccaagggtcgggtcacctccccaccctgcaggacagaaagatcagacatggggagtcatggggtgcaatctggtgggtgggtaagtggcccaagttctgggaaggtggaaggtgcacatacccggaagaactccttgagctgggggctgttgttgagcgcaggtatgtgcacagtgaagcgaagcaggtcctctgccccctttcgccgctcctcgatcactgaggcttcaaaccggcctacggcccccaggacaaggaacaggggagagtggcggtgacccacaggggyttctgccccaaggccacttttcctggtcctgcctgagatgctctgagcaactcactgccctcctacccattctcccagcaatctgccctggttcctcctggggtgaggtaggggcttccaggagggatcaatttccctattcattcatttgccagatgtttactgagcacctactatatgctagactcagaaggtgaacaggggaggaaccagtctctgcccttgtgaatatcatatcctacccagggggagctaggcagttaacaagaaacaaaagcatttctgatggctttgatctaa

SEQ ID NO: 66029 - DNA, 601 bp, Human
accctgacctccattgggggggcccttctacctccagcatccccaaatgccagtggctccaggcccccagagggatttccctttgcagctgccctttgagctgagaactcactcccattgaccagcaggcctcttgccttcaggatctgcagccagaccctggccagtcaggaaatcccaccaagagcttgcagggaaggaactaaaatgtcccagagcagtgtgacccggctctttccaaagccttctcagtgagatggccccaacatgggaagtgcctcctttccttcctcgtggctayttgttgcacaggtgcatccagcacaccacaccacgtgccctggcacagggcttctaattctcattgaagctgctattggcccacagggcagcactgctgaggagacgtctctccctgatctgcgcaggcactgagcaggctagtggggctctgccctcctccctgtcccaaggacgtcctgccctggctccttcccggctgtcccagctcattaccttccttggagaaggggtcgaagagggcaagctcagcctcggtgagggggcctcgggcaggggaaccagatgcctcctcggtgct

SEQ ID NO: 66030 - DNA, 601 bp, Human
tggctggacacagtcactcatgcctatgatccagcactttgggaggctgaggtgggaggactacttgagtccaggagcttgagaccagcctgggcaacatagtgagatctcatctctacaaaaaatcaaaaacttagctgggcatgatggtgcatgcctgtggtcctgtcccagctatttgggaggctgaggtgggaggatcgcttaagcctaggagttggaggctgcagtgagccgtgatcgcaccactgccctctagcctggtgacagagccagactctgtctcaaaaaataaataaawaaaaataaaaaaattaaaaaggagaggaaaaaaaatagaaaagctcctgcccaggcagctagctgcccagcagggactcagctggcacaaggacagagcacttggatgcctgccacccagaggccaggcataacagccctgtgacaccaacattgcctttccctcccattccttcttcccactccccaaccctggagaggcaggagcaggaacgggaggaggcagaacaagaaaagtgaaagaggcagggcattttggctcacgcccgtaatctcagcactctgggaggcggaggcaggt

SEQ ID NO: 66031 - DNA, 601 bp, Human
aagtcgtctgtggatcaaaaactagccatgagctatttgatcgatagggttcatgtgcttctgtaaaaacagccttaccttcctaattatgtctttaggtacacactctagtttgtaagctctgggtcactggtcctatttccctcttgactccagttgacctagaaatccaaaaatcccctccagaaagtttccctgaaggatgctaggccaccaccaccaggctgagggtagaaatgctccaagacttggaataatcttagaataggagacttagagaatctcaggggttttctgaagmcttgcagtttcagctgaggcccccaaatgtaaagacagtgagtgacaggtgtcctcacatttcccaggtaaaggctcattatatccccctggactggctaaaagggggtcggacatcctacctgcagcttacacacgaggcgactggaaatctggtgcacctttggtgaaaaggcctctgaggggaaggtgcgggggcaggaagcatcatgataccctatcatcctggagagggaaaaagtgggtgcctctctaaccccatccctgtgagttccatgagagccctgagaagtccgggcct

SEQ ID NO: 66032 - DNA, 601 bp, Human
tgagccgagattgtgcactccagcctgcaacaagagcaagactctgtctcaaaaaaaaaaaaaaaaaaagaggaagaagaaaactgaggccacaagaggttaaaaacaacaacaacaaaaaaacagaaacaaaaatctgcccaggttacacagctggtcagtgaggagtaaaagggctcctgatccgtgatttgcttgtttttttgctcccttcatcactgccccacctgggacccaggcctgaccctccaccctcagtccctactcactggggactccctgaagcaagacgtgcacgccrtctcgatagccctggagtgcagcagcgtaagcgcctgccttctcatcccgcagggcctgggtgatgagctctgtggcctggcttaggtaggcaggggtgggccctccttccccatcctcttcctcctcctgccctcctggctcccagggttcctggtccagccttgcagactccacctccatcgttgccagctcagccacatgggtggggctgggggctgcgccttctgcagttagaaagggaggactcggaccagactggcccttcctttcccaggccctctgcccaaccccaagactt

SEQ ID NO: 66033 - DNA, 601 bp, Human
gcccccggtgcttcacacagctcttggcacataagtagctgtgtgctcagcaaatttattttatatgagccaatgggctctgttactaaggggctgattgatgttctaacacctacaataaagtgtggtccatgcaaagtacatgaaaagtgcagactcttttcagaggagttaatttattcattgaggccaggcacggtggctcatgcctgtaatcccagcactatgagaggccgaggtgggaggatcacttgaggccaggagttcaaaaccagcctggcaacatggtgagactccattaaaaaaaaaaaaatcattgagaaagagagggagacacagagagaggcaggacactagcagaaagttaccaactggcatgagtcgtttatttgtgggatgctttatggttgaggaagctggaccccaccctttctctttctgaggtgcccacagcagcctgtgcagttcctgatgatcagctccattttccagacggggaagctgggacttagagcccagctttgtgaccagcgaaggtcacaaagctggtggtggagccagcactagcgcccaggtcttctttctcacatcacatttcctc

SEQ ID NO: 66034 - DNA, 601 bp, Human
cttcacctttcccaaggcccaggatggctagtgcaggtgaagctgtctctgaccagtctcttcctagttatcttctctgaacttcctggttctagcggtgtggtggctaactttccttgtctctcctcctgtcatcctccttctcctccccttcctcccactgaaagcctcgtcagcaggctcaggatcttggctggcctcccactcttcctacctgttctcatttcacaccatcgatgatgatctagtggggatacctctcattaatgccactcctccttgccaggagaacgcagtgactaatcctgctgcttttcctcaggcctgccactacctgttgcagccgggctcctactaatgtgcctattcttagggacccctgcgtttcacagagtgacgtgcttggtggagtcactccttaatgcggggctcctcttcttgtcaaatcatccctttacccaatcagagggctgtcccgcgttgtcattaccgagcacatctgagtgtgtcatgtgcatttgtgacagtttcagatgccacacacattttattggggggtatagaggagttgcctctagtgcttcctgctcactttgctctc

SEQ ID NO: 66035 - DNA, 601 bp, Human
gatggagtccccaataatgggggactgccccaggggcagagtcctctaaagatgcagtcctcaaggatggaatctgccaaggatggagtccccaaggatggaatacccaaagatggaatccccaagaatggagtccccaaggttggagtccaccaaggatgcagtcctcaaggatggagtccagcaagagtgtagccccccaaagatggagttcccaagcatgcagtccccaaggatggagtcattaaggatggggagacccctgggagtcttgggatgcattccttaggaacgcattccyctaaggatggagtccccaggggtggagtccatcaggcaattagattcctttcctctccttcctgcccaggcctctctccctctctggcatggtgtacaccctgtctcagggtctgctatgctgttctccatactcatccgtgccaattttcttagtttttccctttgttttcacagttctcctacagataccacttagttgccctcctttctttctggtgatatcctagatctgaggtttgagtcagaaagaccaggttcaaatcccagctctgccaatagtttgagtgcttttaggcaa

SEQ ID NO: 66036 - DNA, 601 bp, Human
tccccaagaatggagtccccaaggttggagtccaccaaggatgcagtcctcaaggatggagtccagcaagagtgtagccccccaaagatggagttcccaagcatgcagtccccaaggatggagtcattaaggatggggagacccctgggagtcttgggatgcattccttaggaacgcattcccctaaggatggagtccccaggggtggagtccatcaggcaattagattcctttcctctccttcctgcccaggcctctctccctctctggcatggtgtacaccctgtctcagggtctgctrtgctgttctccatactcatccgtgccaattttcttagtttttccctttgttttcacagttctcctacagataccacttagttgccctcctttctttctggtgatatcctagatctgaggtttgagtcagaaagaccaggttcaaatcccagctctgccaatagtttgagtgcttttaggcaagttatacaacctctgtgagcttcagctcctcatcagtaaagtgagaatgagtcttttgatgactaactggggtattgccttaaaacactcaacacagtgcctggcacgaattagttgt

SEQ ID NO: 66037 - DNA, 601 bp, Human
ggagttcccaagcatgcagtccccaaggatggagtcattaaggatggggagacccctgggagtcttgggatgcattccttaggaacgcattcccctaaggatggagtccccaggggtggagtccatcaggcaattagattcctttcctctccttcctgcccaggcctctctccctctctggcatggtgtacaccctgtctcagggtctgctatgctgttctccatactcatccgtgccaattttcttagtttttccctttgttttcacagttctcctacagataccacttagttgccctcytttctttctggtgatatcctagatctgaggtttgagtcagaaagaccaggttcaaatcccagctctgccaatagtttgagtgcttttaggcaagttatacaacctctgtgagcttcagctcctcatcagtaaagtgagaatgagtcttttgatgactaactggggtattgccttaaaacactcaacacagtgcctggcacgaattagttgtatttttttcaatccttcaggcccagcttaaatgccaccttcttcaaaaagccttccttgatcccttcctccagccagccttccttcttt

SEQ ID NO: 66038 - DNA, 601 bp, Human
aagctgcattctagtatttcacaacaattgcccccataaacatgatctccattggactgggtctggatccttaatccctaggtctagaggggccccatctcatctactccaaccctgctatttttaagaggtagcctggatctcttgtcaaattagtggaaggcccaagggttagaactcacatctgtttcttctcaatcctgattctttttttttttgagacagagtctcgctctgtcacccaggctggagtgcagtggtgtgatcttggctcactgcaagctccgcctcctgggttcaygccattctcctgcctcagcctcccaagtagctgggactacgggcgcccgccaccacgcctggctaattttttgtatttttagtagagatggggtttcaccgtgttagccaggatggtctcaatctcctgacctcatgatccgcctgcctcggcctcccaaagtgctgggattacaggtgtgacccaccacgcctggccctcaatcctgattcttaatttgctgttctacttcttaaaaatggaatcttgttcataaagttgaaaacttttgaatcttattttattctccataaccagttc

SEQ ID NO: 66039 - DNA, 601 bp, Human
tctcagccttgagggttcctggttccatgtcccccacattttgcatggcatgaatggtcttttcccctgaccagggatagcgtccagttcccccaactgctccgctgctctgactaacactgtgtttcacactgtcttccttcccgtcaccccctgccctctctgcccgctgcctgccccgcatggcctctgacaggggctggtttccttccctgttgaggggagcgagaggaggaggcctgcaggggtgggaaggggcagcattggttgtccttgtcaccgagctcctctgtttgggttrggctcagtcctggtgagtgttggtgtgggtgtctgtgtaaatgcagctggtgtgtgttggtgtgtgggtgtgactgtgtgtaaatgttggcgtgacatttcggggtgttagtgggaagctgtactgtgtgtgcgaggctctgctggtgactctccacgtgtgagctggtgtgagctgggggctgcgtgactatgtgggtttttgagcctggtgaggactctgtgtggaggtggactgtggagactggcccttcagttgcagtgccatggcagtcaggaacagggaaggagctggggctag

SEQ ID NO: 66040 - DNA, 601 bp, Human
gaggtgcatggagcagaaagagaggtggggtcagcagggagggctgagagcccacccaagtcacaggctgccccttgtgtccacctccagccagcctctctgctcctggggagtacagtgggggctgggcagtgggctcctgctgcctctgcaccctctcccttctctggctggacacaactcttccagggcagaagctctggctcattccccttggccagctcagtacccactcggcctgcttgtctgtgttgagtgggttggcatgggttgggtgcagacactctgctgtgtctcagtratgctgtttggaaggagagagctggaaggtcccactgccctgggtaggatgtggtatgtacgcaggtgtgtctcggggttggtgatcggtggcgaatgggtggtggaatgagtgttgggtcgcctgctgttgaggaaggtagagtcaaatgtcttttctctttatttttcaacccataagtgtctctgtcctagtggtcactcctctctctttacccccatcatcggaaggaagctctccctacctgcaccccacagctctgttgcctccatctctgctcctcccagtgcccctgccccg

SEQ ID NO: 66041 - DNA, 601 bp, Human
aaggaataaccccacaagggccatcgagaggagaaaataagagcacatctgtggaagcattagcacagtggccaacatagagtagataccccattcacctttaagaatatatcttccggccgggtgcgatgcctcatgcctgtaatcccagcactttgggaggcggaggtgggcagatcaggaggtcaggagatcgagaccatcctggctaacacggcgaaaccccatctctactaaaaatacaaaaaattagctgggtgtggtggcgggcacctgtagtcccagctacttggaaggctgrggcaggagaatggcgtgaacctgggaggcggagcttgcagtgagcctagattgtgccacttcactccagcttgagcgacagagcgagactctgtctcagagaaaaaagaatatatcttcccagccatgcctcccttctgtctagagccattcaacttaaaaaaaaattaactcactaggccgggcgctgtggctcacgcctgtaattccagcactttgggaggccgaagtgggtggatcatttgaggtcaggagtttgagaccagactggccaacatggtgaaacccagtctctactaaa

SEQ ID NO: 66042 - DNA, 601 bp, Human
ttttgcattctcttcttgttttctgtctgctaattctctctcctttactcttctccatcttgttgaacatgagagaattatccaagaaagggaaattgatataaatgagaactgacacattatccaatttaagcacttatcaacgtcagctaaatttttgtgctcctccgcctgtcactgagctgggcctgtgagtttgggtggagtgaccgctcctccccatgcaggaaggaggggcccctgtggctctgggagagtgacagtttctaatgggcttgctatttctttagcttccatcctygaagtgttgcctcccccgggctttacattaaatggtttcatccccggggtgtgtctcaggacagcaccaggaattcttcccagagccctctgccccacagggtttctaccaggtggtcagtaacactctaggttggacgtctgcccaagccttgcagggcactgcagggcttccacttctctgtgctttcaggaagtgctcctgttagctcaacaccgatctctggagccagagtctggaccaggtgtggccagtctttggattcctgtcttgaccaattctggacatttctgacggccc

SEQ ID NO: 66043 - DNA, 601 bp, Human
ttgtacttttagtagagatgggggtttaccatgttggccagaatggtctcgaactcttgacctcatgatccgcccgccttggcctcccaaagtgttgggattacaggcgtgagccaccgcgcccggcctttttttttttgagacgaagtctctctctgtcgcccaggctggagtgcagtggcgtgatctcagctcactgcaacctccgcctcctgggttcaagcgattctcctgcctcagcctcccgagtagctgggattataggggcatgccaccacacctggctaatttttgtattttyagtggagacggggtttcactgtgttgaccaggctggtctcgaactcctgaccttgtgattcacccgcctcggcctcccaaagtgatgggattacaggcgtgagccacggcgcccggcctctgatgacccatttcctatgtgcacacaaacacagacttggggcagctattccgagaaaactctcttagatcttttccatttttttttctatttttgtttttgcaattgtggtaaatgatacataataaaatttactaccctttcctgcagatcacatgggacagagaaagaaatgaaaaa

SEQ ID NO: 66044 - DNA, 601 bp, Human
cctcaggtgaggttttgagcagagaggaacacgtcctgaatgaggggatgtgtctgtagaggaggtcccagttcttccctcttgggttcccaccctgtgctcacattgattctcctcccaaagctccctgccaaattcaggcctcatgcagacccaaaccctccttaacctctctttaaccccatgaagttaggcagagtcttttttttttctaactaggatgtctgcaatggggtcttgcgtgaggagagagattgaactcaactcccaccctgaccccttttatttatttatttatttwtttttttgagacagaatctcgctctgtcgcccagactggagtgcagtggcacgatcttggctcactgcaagctctgcctcccgggttcacaccattctcctgccttagcctcctgagtatctgggactacaggcgcccgccaccacgcccagctaattttttgtctttgttagtagagacagggtttcaccgtgttagccaggatggtctcgatctcctgaccttgtgatccacccgcctcggcctcccaaagtgctgggattacaggcgtgggccactgtgcccggccccgaccccttt

SEQ ID NO: 66045 - DNA, 601 bp, Human
ccatgagctttcacatttgagcctcatggctgtcctgtgaagacactagatcaccaaacaagcattactgtccctgttttatagattatgaaattcatgtattgacttgttcaacattacaaaactagtgaaggcagagggaggagccaggactcaacctgggccatttgccttaaaattcagtgcttttcccattgcctcggacagggctgctgaccctccccctcaggccactcatgctgactcatgtctccacccatgcccagggttgagagcaggccttgactccacttcacctggyggtccccggggtgtccatgagggccagaccatgagcctgttaggttcttctcacgggcttcagctctcctagtcagggcaaaaagaaaacagcaggttcactcattcagctatttatgggacaccatataaatgctaggtatgttcaagccaggggctacagcagtgaataagcagtccccacccctttggagctttcagagcaggggaaccctgggaatgagaggtcctaagctgttcaggctgaggtcaaatctgtccatttcagactggcctctagaagcttataaaggtgtagcac

SEQ ID NO: 66046 - DNA, 601 bp, Human
gatcacagcctgtagagcgggtggtgtgcagcagctctgcaggggaaagcaggctgggagacactctagtcaatgctccacaagtctgcacaatgctcccttgcatccctgaaactgtcacaagaggatagccccagccaaggaccccataagtggctctgtacttccaagtctgcccagatttgtgtatccagtgtgagttcccccctactttgcctgggcatatgtgtgttgtctgcatctaaacacatgtctctgtgcttgctggggacacagcaggaaaaatctggggccttggatytgcagggaaggcagatgcattttgcttatttggactgtcctaggcccctgggaagaagattgtgtctcttaagattagacaggaaacaatgtccttggtcaggaaaacctatcctgtgggcccttgggacccaccctctcctctccatgggcacacttttctgtctgtgccacataagtgctcagaagtcagataacaaggtggcctcttggaagacacatcatgttaagaataggcttcccagactgacagataacaggactctcctcccacccatttcttactcctggctgtgcccct

SEQ ID NO: 66047 - DNA, 601 bp, Human
agggaaggcagatgcattttgcttatttggactgtcctaggcccctgggaagaagattgtgtctcttaagattagacaggaaacaatgtccttggtcaggaaaacctatcctgtgggcccttgggacccaccctctcctctccatgggcacacttttctgtctgtgccacataagtgctcagaagtcagataacaaggtggcctcttggaagacacatcatgttaagaataggcttcccagactgacagataacaggactctcctcccacccatttcttactcctggctgtgcccctgccsccatctgtagacatgtgtgtgctgagatgccatctctagcatgactcctgacaatctgtgaccaaaggcttggtgcaaatgcatccgtctacagattcctcctctgtaggcactgtggacacgcaggtggcccctacccagccaccaagccttgggttgggatgggaagagttctgggctccgggccagaagacctggggcctaactttggtatcttttactgttgggtaagtcatttcccatctctgagtctctctctcttttttttaatctttaaaatggagataagaatcttcactc

SEQ ID NO: 66048 - DNA, 601 bp, Human
gtgtgctgagatgccatctctagcatgactcctgacaatctgtgaccaaaggcttggtgcaaatgcatccgtctacagattcctcctctgtaggcactgtggacacgcaggtggcccctacccagccaccaagccttgggttgggatgggaagagttctgggctccgggccagaagacctggggcctaactttggtatcttttactgttgggtaagtcatttcccatctctgagtctctctctcttttttttaatctttaaaatggagataagaatcttcactctgcctacgtctgtggtrgttttgaggctcagatggaagaatgggaatgaaaccattgaaaccattgtgtagatgcaagacccatagtagagacccacccagccttcttgaaggaaaacaaaaccatattggaatagagacttgagtttggagccaggcctgggggccacttccacatagcatggacagactggagttgtcctctactaggtgtgcccatggggtcccagctgtcagtgcagctgatgggaaaagtgcagtgtaaagaatctctgaaccacaaggcgtcacctccttcagcctcctggcccacgtgaa

SEQ ID NO: 66049 - DNA, 601 bp, Human
gcatggcctgggcccctccctggaggggaggagaggacaggccaggctgggcactgtcctctactaggtgtgcccctggggtcccagctgtcagtgcagctgacctgaagggtgtggtgtaattaaagaatctctgagctgcaagggggttacctccttcagcatccctccccaccccatgaatcacccatacactccctaccagtgggaggccttctacctcccacctccaagatccattctgatcattgagtggttctttcttagtgtcaccctgcccttctgaaattcccacttattrtgaaattcccacttattgtgaaattcccgttagttctgccccctggaatcaaacggagaaatctaactcccgtttgtgttttaaatcaggctaaatacacattgtatcccaaagccctttaatccctggggccatgggagggtacattgcctttccacctgaggctgatcagtaattatcaggggggctgctgggagccagctctgaaggagggctatgacagagtgcatgctgccactctgtgatgtcacttctgagacagatgcctgggagccttgggcccactgtctccaacccaca

SEQ ID NO: 66050 - DNA, 601 bp, Human
tgtcctctactaggtgtgcccctggggtcccagctgtcagtgcagctgacctgaagggtgtggtgtaattaaagaatctctgagctgcaagggggttacctccttcagcatccctccccaccccatgaatcacccatacactccctaccagtgggaggccttctacctcccacctccaagatccattctgatcattgagtggttctttcttagtgtcaccctgcccttctgaaattcccacttattgtgaaattcccacttattgtgaaattcccgttagttctgccccctggaatcaaayggagaaatctaactcccgtttgtgttttaaatcaggctaaatacacattgtatcccaaagccctttaatccctggggccatgggagggtacattgcctttccacctgaggctgatcagtaattatcaggggggctgctgggagccagctctgaaggagggctatgacagagtgcatgctgccactctgtgatgtcacttctgagacagatgcctgggagccttgggcccactgtctccaacccacagggcctgggcggggaaggaacccaggtgaggcagggctgggaagccagtgttct

SEQ ID NO: 66051 - DNA, 601 bp, Human
ctctgtgatgtcacttctgagacagatgcctgggagccttgggcccactgtctccaacccacagggcctgggcggggaaggaacccaggtgaggcagggctgggaagccagtgttctttcccctgagttcctttccatgcagactgctttgtcttacctccccaacacgtgttcatactacgaccctgctctctctgtccagccagggccttcgtgggtctgtgccacgaagaccactcacttctgcctattccctgcacttgaggcacaggtcactagttaacaggttactagttagtgccccctgaactttggtgaatgtgtatgttgaagaggctgggtttctcctgctcactctcagtctctggctttcttctggatggggctggcttccctctgggtgcccatcttcaagtcgtttgctcttgcaaaccctactggagcctgtgtttctgagggtggagtctctgcaggggtgggcctggagctgacacctcttctctggacagatggaccccccattcctggtgctcccttgctggggaaggagaagaatcaagctccttctttgggtcttttccccagtaggggacctgcttgc

SEQ ID NO: 66052 - DNA, 601 bp, Human
tgaatgtgtatgttgaagaggctgggtttctcctgctcactctcagtctctggctttcttctggatggggctggcttccctctgggtgcccatcttcaagtcgtttgctcttgcaaaccctactggagcctgtgtttctgagggtggagtctctgcaggggtgggcctggagctgacacctcttctctggacagatggaccccccattcctggtgctcccttgctggggaaggagaagaatcaagctccttctttgggtcttttccccagtaggggacctgcttgcccatccagcctcccyttttttctttttttggacccttcattggtgaagactctgctggccccgagagagcccccgtgacctgactccagggcctggcacccttctaccctcaccctaacagtcctccccttcctcttctgtccagcctcccctgtcccctctgtgcagccgctccttcctctgctccgttttcttcctcttttctctctgcactctctctacctcattcctctcactgagacttctcacttccctctgtgtctgccttttgacctttttctgctcctctgctcctcccttggtgccaggctgtgg

SEQ ID NO: 66053 - DNA, 601 bp, Human
aagtatgttttgttttagactctggaagctgataatcctggtcttgagtaaatggccatagttcctaagaaacagaaccttcccctctctggccatcctgcatatttatgggcagtacgtgtggtggcgtgacttggtgtgtgacgttaaccaggcatgtgtatgtagaaaggtcccatcgggtcccattgtagatggaggagctggtgtctgtgtaacagaggccgaagctgtgggctcgcatttacatttgggtactgtgtgaagttttgaaagttttaggtctgtgtttacaccctgrgaatatagcttctggccacactcactgaaggcccttaggaatctgggggaagagtatgttggtcataggtgtgggtgtctgtgtgcagggcctcagggtacaactccagaggcaccattcacttaatattctatgtgcatggcacctcctaaagtcacacaaagggcagtcctgagagtggatgtatgactggggtataaaagctctgcgtgtgcatggactccaggtgtgatgggaggctataagtgtgtgtacttgtattcatgggtgtgttgcgtggccaaatatgagccactggtc

SEQ ID NO: 66054 - DNA, 601 bp, Human
tggtgggggagagactagggtgaggagaggtcacaccttcagaacaacttttccccacttaccacctcaatttctccatctgtgacatggggactactcctgggggtggaggggactttgtgttcctttaaggcttatgagtgtctgctctgggaagacaggagagaaaagatgagatggaggaaagtggacagcaaatgaaaaagagaatatgaaatgagaaagggtagctaaaagagacacttcccagggctgagatttgggaccgaggtgttcccatcaggcctgcttactcctctgyctttcagagcctgtctcctgcctctcccaggcggtcaattccttaccatctctgcctccctgtctccgttcatctctgcagtctctattgatctcttacatacctctgtctttcccttcttttttaccctctatatctccccctcccttctcagccttggcccccccatctctctccagttcccactcactggtattgattggcctctaggcggtttcccttcctttcctctcgccaccggctcctccctccctccctgtggaaccataaattttctgcctgctcagagctgtgtcagtc

SEQ ID NO: 66055 - DNA, 601 bp, Human
aatttctccatctgtgacatggggactactcctgggggtggaggggactttgtgttcctttaaggcttatgagtgtctgctctgggaagacaggagagaaaagatgagatggaggaaagtggacagcaaatgaaaaagagaatatgaaatgagaaagggtagctaaaagagacacttcccagggctgagatttgggaccgaggtgttcccatcaggcctgcttactcctctgtctttcagagcctgtctcctgcctctcccaggcggtcaattccttaccatctctgcctccctgtctccrttcatctctgcagtctctattgatctcttacatacctctgtctttcccttcttttttaccctctatatctccccctcccttctcagccttggcccccccatctctctccagttcccactcactggtattgattggcctctaggcggtttcccttcctttcctctcgccaccggctcctccctccctccctgtggaaccataaattttctgcctgctcagagctgtgtcagtctatattccagatccaggggcccaagaacgtgatagagagggcaggaggacgtggcctctgggggcccc

SEQ ID NO: 66056 - DNA, 601 bp, Human
tgacatggggactactcctgggggtggaggggactttgtgttcctttaaggcttatgagtgtctgctctgggaagacaggagagaaaagatgagatggaggaaagtggacagcaaatgaaaaagagaatatgaaatgagaaagggtagctaaaagagacacttcccagggctgagatttgggaccgaggtgttcccatcaggcctgcttactcctctgtctttcagagcctgtctcctgcctctcccaggcggtcaattccttaccatctctgcctccctgtctccgttcatctctgcagyctctattgatctcttacatacctctgtctttcccttcttttttaccctctatatctccccctcccttctcagccttggcccccccatctctctccagttcccactcactggtattgattggcctctaggcggtttcccttcctttcctctcgccaccggctcctccctccctccctgtggaaccataaattttctgcctgctcagagctgtgtcagtctatattccagatccaggggcccaagaacgtgatagagagggcaggaggacgtggcctctgggggccccagccctgctcctgg

SEQ ID NO: 66057 - DNA, 601 bp, Human
ctctgcctccctgtctccgttcatctctgcagtctctattgatctcttacatacctctgtctttcccttcttttttaccctctatatctccccctcccttctcagccttggcccccccatctctctccagttcccactcactggtattgattggcctctaggcggtttcccttcctttcctctcgccaccggctcctccctccctccctgtggaaccataaattttctgcctgctcagagctgtgtcagtctatattccagatccaggggcccaagaacgtgatagagagggcaggaggasgtggcctctgggggccccagccctgctcctggcatgcagtctctcctccagcactgcatggctcggggccctgcaccaccggaagcctcctctgggtgcctctgaggaccgctttcttcacttctaaagacctgggggccaaatccagctctggcatgtagtagggatggaggactggcagcagcattggggagatgtcctgggtcctgactgcatcctggagctgggggtggcacatggggctcgtggtgacagtttttgctcccaaatggagtttagaatcaataaataggagccagc

SEQ ID NO: 66058 - DNA, 601 bp, Human
ttgctccatgccagtccctctttgcttcccaatcctgcccctgtatcacctccaatctttctgctcatttgctggtcttcttccttttctcctactttatctttatctcccttttcatgcttccgttttctcttcatccagtttccctggagcacttccttcaaactctttcctccattcttttattctctcatcccgaatacagtttgcctcatcttatctctgtcccacctggctcctctcaggcaacactcttcagtttccttctcttcttccatgaccccacccaaccccttgctcmtggaccttaactccctccccctccccaggaactctctggctctttgttaccttcctccccctttcattgtctccttctggctcccttgaggcccagtgttgcccccaaaggtgcccagataggccatggtctttctgggcagtgaggcaaagcatgaaggagtcagatagataaaggaagtcagggatactggggagctttgcaggatgaagagagtgtggaagaggaaggtgtaggagagaggaactggctgagggaccctgagcaggtaggaaggagggcctgggagccagagtgccc

SEQ ID NO: 66059 - DNA, 601 bp, Human
cgtaataaactggcagcagtgtgagaacggctgggtgataaatcccaggggaggtctgggcttgggcagcctgtgcgccgcgggcctcgggggcggggacgcgtgcgccctgtcccacgcttggccagtccctgtcctggggccgccttccctggtctgtctttgtgccttcaccgccatgtttcctggctgcttcgcctcctgtcgggggtctgcctctctacgctgggtctttgtgtgcagctgggtgcgtcgccgcctgtgtgtgggtgtggggcctggggcttgggcgctgggcacmgcctctgatccctcctgcctcactgcctgcccagtggggcatttggccggctttttcctcccgccctctctgggcacagacagggctctgtccatggtgatgtgcttgctgtctggaatctggggtgggaagtgaagagaaagggcctcttttctcctagacctgggggatttggaggcagcctgcaggtagacttggtttccttccctggtctgagggatcaagaaacccaataaagccttctctgaatgggaggccctggagcccaggggtgaagaggctgcagcctctgatcaggaa

SEQ ID NO: 66060 - DNA, 601 bp, Human
tgatgcgattgcggaaaggttgagttcagaaatgagggagacagatgcagaaacaggagagaaaatccagaagtaatataaaacgtgtcttggcaaggagacagggctgttaccacgggcagagccaaggaaagaaccgaggtccttataaagagcaagtcagagatccatattaggagatctaacgaaggaagaggagtagccacggagactcagagaaaaggacccccagtgtccaaggcggtgagggacatggtgaaagggaggaagagacaagtgacaacaaaaatgaaacacaggktcatgtgcgttcaataacctttgttgacaacctacttagatatcagggcttgtgctaggtccggggcactcagtccctgcttgcagggagccttgagaatgcagacagaccaagttcaacagggtgacagctgtggcggccaaggacaaaccaaggtctgaggagcacaggagagggatggagatgaggacatggaagaaatgaggaggcagagactctgaaagatattgagggaggcagagacagagccttagaatgagaggaaaccagaggggaagcaatggaaagatatggaaatag

SEQ ID NO: 66061 - DNA, 601 bp, Human
cccaacaagccaacactgacagctctggctgtgtaggcatgattcctgtgggcagcagacttctctcattctccgatgcacacatactagggcaacctttgtagcagtgatgacattggcctgtgctggacagggctgggcttggaagcatgaaggcctcaccatgtcaagccaggacttggatctagagcttctccccttggggcccaggaggccagcagtcagggtggaagaattattcctgctctcctctcctcagggacccctgactaggggtgaggaaaggctgctgggtgccccygcctgtaaaggggagtaacatgagggtctggtggttgcctgtatatactgagggcagatcctgagcaataccagcaggtcagaccatcagtatgcatgggcccagagtggggggggaccctctgattctttgggagcacagagacacagcccatggattctgagtcagaagaacctgggttttaatcctggatctcccactgacaagcgtgtaaccttggacaagtcatctagcctctctgaatctcagtttccacttcggaaaggtgatgatacctacctcatagcaatactgtgagaa

SEQ ID NO: 66062 - DNA, 601 bp, Human
tcctcttggagacacacacacaggattgaatgatctgtttttaatttaaacacaaatatcctgaatctatagggaaagcagaatctccttgcctcataagcacccaaggaggcaccatccatacccacatgaacacatcgtgtgtaccttcatgggaggtgtacataggcaggcccaggcccgggtctctgggcaggtgagcacagctgtgcagtgagagatgagaggaaaagcctcctggccccaccagcgtgcactgaatagtatgtcagtggcttaaatgggaggagtggccagattstcaaaggaaatcagttctctttccactgctgcagaccaggatcacccacagctcacagaggtgtacagatcctctcaggtgcactgacaaacctctttccacataggcgtctgtgcacacacacacattcacacacattccctttcccagtctccaggggctggagattggtgagcgcagagaggaacaggtgggtatccagatgggcagccaagcttgcagaagagatgggggctggaactggggggaggagcctggaaaagaaaggctgagggcctggcagggtgagcaagatgaggt

SEQ ID NO: 66063 - DNA, 601 bp, Human
agtttgggaagtgctgaatcctgtttcttcctcttggagatgcatatgtgcattagtttaataaaggctctgagaagcccttggagaaagaaacctgttcgattgtgaaatgtttccttccccaactcatttgaccactgtgatccttctctcctttgttttcctcatgattcttatgtctgggaaaaaactttgatgcagaggtcttcctgggcctctctgggtctggtattccaggacttgtaccagagctgctaccactggccctctgcctcttggcctcttggccattagtaatggrcgttgctggtccaggggctatccttgcctgagtgggcagtgggagggtgctggaggaagaaggaaggctgagtggggggctggggagacaccccagtggccatcattggctagaggctggatggatgtttggatgtcccagaggcctgggtgtcccagagaacctgtttccaaagaggttgtgggcttcacaagttggactgtcctcagcccgggttttgggggcaaggcttacaggcaccgaactctaaaccagatctttaacgaggcactaaccagaggctaacaagggctaagccag

SEQ ID NO: 66064 - DNA, 601 bp, Human
gtttgggaagtgctgaatcctgtttcttcctcttggagatgcatatgtgcattagtttaataaaggctctgagaagcccttggagaaagaaacctgttcgattgtgaaatgtttccttccccaactcatttgaccactgtgatccttctctcctttgttttcctcatgattcttatgtctgggaaaaaactttgatgcagaggtcttcctgggcctctctgggtctggtattccaggacttgtaccagagctgctaccactggccctctgcctcttggcctcttggccattagtaatgggmgttgctggtccaggggctatccttgcctgagtgggcagtgggagggtgctggaggaagaaggaaggctgagtggggggctggggagacaccccagtggccatcattggctagaggctggatggatgtttggatgtcccagaggcctgggtgtcccagagaacctgtttccaaagaggttgtgggcttcacaagttggactgtcctcagcccgggttttgggggcaaggcttacaggcaccgaactctaaaccagatctttaacgaggcactaaccagaggctaacaagggctaagccagg

SEQ ID NO: 66065 - DNA, 601 bp, Human
ccaaaccaaaacaacaaactcagagggttaaaccgacccccagatccactaaaaacaaacagaacagcccaaccccacccagctgggaattctgaggtgtcatactggagtgtggggtgagattggagctggagcgggttttattggctgtcagtgagcgaagcaaggtccctttaacattttccacttctgtgcttgcatgtccaggtggggaggaagggctcggcttaacagggcctggtcccaggcagtgctgggccttggcagtccgggagaagagaggggatcctggccaggggtsagaaggcctggttgtaggtgggaggtcagcctgggcaggttgctgcttccacacaccatcactctgtctcacctccttctctgctctcacacgcaccgactccaccttggcctggcagctacctcctctgtctctgcctctttgtctcctctatctgcctcttccaggggctccatggcttcagggcttggggctggacactggggcaggatgtttggggaagcagagggagaagatggggatggactgagggaagaggatgaagaggggagatgaccttggagctggagaggagaggga

SEQ ID NO: 66066 - DNA, 601 bp, Human
tggcctctgcaggctccgccccatagggccttgcctccctggcaccttccctgaggcatcctagatcctcttgccctggcgctgcaggtcaaagtctggcgtccactctcctcacttccgagaaataaaaagcaccatgtgtgctgtttcactgaccttcggaagccatgaaaacctgcagggctgttgctggggagttccctgtgcatagcaggaaatggaggcccgaggtcagccagcaagagatgggagggctgggactcagaccagtctggtccgtctcagcccaggggcatccccygtgccaccgtgcacctcaagtggcagctgtgggatctgctgacctgcctggaacctctctttccccaccccttctctcgcccctcagaacacagatgacctgctggtggcctctgctgagtgtccaagcgatgatgaggacctggaggagtgtgagcccagtactggtgagtgcctttcccccctcccctgccccgggtccctctgcgatgctgctgggaggggggcgactgtccctgccacctggcccaagccccagggcctgctgccaggccttagctttccctgatagttccccctt

SEQ ID NO: 66067 - DNA, 601 bp, Human
ggttggcttttgaatgggagtgcctttagcagggcatgcaccatcggtaatgtacccactcatagttgtctcagctggcccaacccacatattgtgtcctgggcctggcccctgaggggatctgactttgcacaacccgagacgtgcaggaagagaagagcacacacaggctcagacccacagaggcagggtctgtatgcacatgtatgaccagaggcatgcacacatacagccctacacatacatacatttacatacccaccagcaagctcacatgggcccacttccacacacacacatccacacacacacacgttcaaacctagaggagcacacactatttgtacctagaccaacagaggcacacacatgcttagactccaagagacatgtgtgtgcttatacccccctgaagtccataaacacagatacacacctgttgagactcacagaagcataaactcatgcacacatgcatagcctaatgaaagcacatgcatgcactcagagctaccaactcttgcatgtgtgtgcttagagctccagaaatagccgcagaggcactcagatgcacacgtgtgcacctactcagctcccagag

SEQ ID NO: 66068 - DNA, 601 bp, Human
ggtctggggcccagctagtgaattatttgtcaccggcttgcctgtggtcatcaaggatccgtttcactctttctcacctccaggacacacccacccctccccaagggagaccacccaaagtcccaaccagctagggcattcatctcaaagctcatgatgtctgggagatggtggcccaccgcatccagtcaagacctggctcctctggaatggggacccatatgtgatctggatacccaggaactaaatggatcatttatctcactgctcccacagcccgatacacacccagcatactgtrgtgtggggcagagggaaaaatggaagacacacagcagcctagattcacacaggccaatgtgtgctgctagcgctgaggaaatccagcaggcaggcaggccaggctctctgcccctgcagtgggggaaatttcttcattaaaccctgggagagattctgctctctgggggagactcccctctcctttgtctggggtccctggctgtcccctctgggaagttcctcccagtcctccttctccatggccatgtctgaagtgggtgttgggaacaatgtcctccttgggggtgctgtagcatga

SEQ ID NO: 66069 - DNA, 601 bp, Human
agagggtggagggggtggggtgtttagaactcagctgctctggcctgtgagagagacgcccactcccttccctagatacctagcctggcctggctcagaggaaatgcctgaggaatattactccccttcccctggaaaagcataacgagccccaattctgtgccaggcccactgctggaggttagggagacagataggacccgggccgttggcccttccctggcagtgagtacaaagccatgcctccaggacagaattgggatatggtgtcagagacactcaaggcagggagcatcctctkcctggaagaggaggtgtttggccagactctgagatgtcagcagggaagggtgttctgaatagaaggcaaaggtcaggtagagggctggtggtatggaccagcaggaaggaccccagaggcactcagggttcatgcagggaggggaaccctgccatgattgggcccaggttacgaccgctcgagaggctgccaaccctcctgagagctgacagctgagtttgccccttacctggagaccagggtgctggctttccttgtctggatcccaggtgggtacaggaagacatatttgttcatcca

SEQ ID NO: 66070 - DNA, 601 bp, Human
gaactcagtgacagaacaggtgttctgtcatccaagttagcatccaagccaagagtcaagcagccccaacagattcctggaggcattgggaggatgacttaggttttcttgggctcctcatgagatctagcccttccccggcctcactcaccttgctgggcacctacacctggtgatcttgggaagtcctgcccacccaggcctcagcattcttatccataacgagctgggatcagatagtcccagctccacaaaacatgctactttgctcgtagctcaaagtttttcactgtgactgagsctttggagggccaggagccctggggtttcaaaatctagggtgtaggtgagcccctggccaggggagattggagtcgggtgggaagagcagcctggggagctcagcaagccttcaagttcaatggaaaggtcttggccacaggctggctggcgtggccaaggacagctctgtaacattgctggagcttgtgatctgaaggttggcaacagtgtttgaactcagggcagaggcagagggctgtgggtgggtggggagcaggagaagagcgccaagatgtgaaggtggaatgtggctggcctg

SEQ ID NO: 66071 - DNA, 601 bp, Human
gcctggggagctcagcaagccttcaagttcaatggaaaggtcttggccacaggctggctggcgtggccaaggacagctctgtaacattgctggagcttgtgatctgaaggttggcaacagtgtttgaactcagggcagaggcagagggctgtgggtgggtggggagcaggagaagagcgccaagatgtgaaggtggaatgtggctggcctggctgcagtggggctgcagtggggcaggcgggacctggcagtggaggccctggggtgctttaccaccaagaggctgaggggcttctgggcrtgatctatgaagaccacaccctgcagagaccagcgagaggcactcagatgtgggcagggcttaggctgtgctgaagagagagccagagaggaaacctccaaccctcgtcaggcccagaggtgcccctgcaagaggagcaagtcctcccaccagccacctagagctgagccccagctcccttctaccccaaaccaggaggttgcacaattttggtttgagaggaggaccaggaggctgatgggagtcacagttgttgactcagtggctgatgggaattgtgttctacactcctccaaggac

SEQ ID NO: 66072 - DNA, 601 bp, Human
tcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaaggtgctgctggggagcctggggtgggggtatgggctgaaggcgctgccrgggagctggcgatcttgacttaagtggctgcccctcgtcactctaggttcttgggggtggagaatccaggggtgccaggcacaaggggtgctgggacaatctgagggagaaacctggggcaggagtgggggtcagggagctcagagcaggtgggctggctgcaaagggtcagtgcccactcggagaaggttggagtgggtgctggtgggcaggacggcgcctgtggcctggctgggcccaggtggaaggacacatcagttgctgcatgtatgcgcggtgtgcctgtgcagcaggcggggc

SEQ ID NO: 66073 - DNA, 601 bp, Human
cggggctgggcaacgggggcctgggccggctggcaggtaagaagacagggccgtgagggtggagtgggccgatggggtcctccttgctgggtccctgacagccacctccctgcacacccccagcctgctttcttgactccatggcaacactgggcctggccgcctatggctacgggattcgctatgagtttgggatttttaaccagaagatctccgggggctggcaggtgagcagccttggctctaacttgtggggtctagtcaggatggggaagacccccacttgtttatcatctctggmaaggtccgaaacagccccgcaagctctgtggaaagcatccttgctgctccccaccccccgacccaaagccagctggtgcccctgaaacaggtggtccgtgtcccactcgatagcccagcagaccaggggcccacctcagagctcctgacttatacttggtgtagggtacaccggcccacagcccccaccctgccccaccgtgcactgtgagtgcctgtactgatactgctggcctttctccctgacctgccttgggtgcagatggaggaggccgatgactggcttcgctacggcaacccc

SEQ ID NO: 66074 - DNA, 601 bp, Human
cgcaacaatgttgtcaacaccatgcgcctctggtctgccaaggctcccaatgacttcaacctcaaggactgtgagttcatccactggtagccagcaaccccagcttgcccgccggccacgcccagcgcaggccttaccctgtccccacttttgtccctcagtcaatgtcggtggctacatccaggctgtgttggaccgaaacctggcggagaacatctctcgtgtcctgtaccccaatgataatgtgcgtcaccccctgggctgggggctggaagcctgagtccttggcagcaggggtcagggagagctggggaaggacacttgctggtgccctagtcacacccagggcatattgctggccttgtgcatcctgtgcccccacctcaagtcttttgagtgcaaggacacctgagtcctgaggaaactgggttagcgaagggcactttggaggggctgttccctggcgacacccacaacacactcggttcttgtacccctcttcctgacactgtctctcgccactagttcttggtggaggaaaggcccctgggtcccagagagggggccggctcagggctcaggggtcccggtatgggtggga

SEQ ID NO: 66075 - DNA, 601 bp, Human
cactgggcagagctctgggggtgtggggctggggactggggatgggggttcctgggtctggttctagctctgggctctctgggcacagcgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatgtgagccccgctttccagatcccgcccctctctaggccccacccactcmacgcctctgtcacacagaagccccgcccttcaccgaccactctctggtctctgggccctggcgcctttcacaggtggcgtcattcttacaagcacagcagccccttccagtgccgccctgtcctgagatgacctcctcttacacacagcacccccaaccttccccaggtctgcattccctgccccaggcccctttcagcaagacaccagggtaggggccccagggcagaggccttcattgtacaggggtgagtggtgaccctcgtccaacctcatcctgcagcttcaaagacttctatga

SEQ ID NO: 66076 - DNA, 601 bp, Human
aacctcatcctgcagcttcaaagacttctatgagctggagcctcataagttccagaataagaccaacggcatcacccctcggcgctggctggttctgtgtaaccccgggctggcagaggtcattgctgaggtgagaggccaccgtagggccagtagagtcaacatgggtccctgcagggatcagctgggtatggtcgtgtaggtggttcactgcatcagggctcccagctgaaggctgaaatccctcctgcactgtgttccccaagcctcgcatccacctggaggagggacaccatcttawttgcatgagggtgctctgtgtgctaatggaggccctggctgtggaggtgaacacagcagagggagtcatccatgggtcacatctgaagtgagcctggaagggggcagatatctggtagggaaggcgcaaggtcatgctggcgttaggaaaaggccaggaagccaggaaggcctgctggggtcaggtggggtcagccatcagagctcaaggacgggaggggaggaaggtgcatggatgccccgtgccccatctgggcggctggaggaggaggggctgggagggcccccagagcagcctgct

SEQ ID NO: 66077 - DNA, 601 bp, Human
accgagtctcactggccgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttgggaggccaaggtgggtggatcacctgaggtcaggagttcgagaccagcctggccaacatggtgaaaccccgtctctactaaaaatacaaaaattagctgggcrtgatggcaggtgcctataatcccagctacttgggaggctgaagcaggagaatcacttgaacctgggaggcggaggttgcagtgagccgagatcacgccattgcacttcagcctgggcaacaaaagcaaaactccgtctcaaaaaacaagaggaaacaaaacaaagcaaaaaccccatgaggatgccctctaatggtggaatttcaggcagtacagggtgaaattaccttcaaatctgcaacagaggtggggaaatccaggttggacctagatggtcaagaatcaacaagaggtagagggc

SEQ ID NO: 66078 - DNA, 601 bp, Human
gagtctcactggccgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttgggaggccaaggtgggtggatcacctgaggtcaggagttcgagaccagcctggccaacatggtgaaaccccgtctctactaaaaatacaaaaattagctgggcgtgrtggcaggtgcctataatcccagctacttgggaggctgaagcaggagaatcacttgaacctgggaggcggaggttgcagtgagccgagatcacgccattgcacttcagcctgggcaacaaaagcaaaactccgtctcaaaaaacaagaggaaacaaaacaaagcaaaaaccccatgaggatgccctctaatggtggaatttcaggcagtacagggtgaaattaccttcaaatctgcaacagaggtggggaaatccaggttggacctagatggtcaagaatcaacaagaggtagagggcagt

SEQ ID NO: 66079 - DNA, 601 bp, Human
cactggccgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttgggaggccaaggtgggtggatcacctgaggtcaggagttcgagaccagcctggccaacatggtgaaaccccgtctctactaaaaatacaaaaattagctgggcgtgatggcasgtgcctataatcccagctacttgggaggctgaagcaggagaatcacttgaacctgggaggcggaggttgcagtgagccgagatcacgccattgcacttcagcctgggcaacaaaagcaaaactccgtctcaaaaaacaagaggaaacaaaacaaagcaaaaaccccatgaggatgccctctaatggtggaatttcaggcagtacagggtgaaattaccttcaaatctgcaacagaggtggggaaatccaggttggacctagatggtcaagaatcaacaagaggtagagggcagtgggggt

SEQ ID NO: 66080 - DNA, 601 bp, Human
cgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttgggaggccaaggtgggtggatcacctgaggtcaggagttcgagaccagcctggccaacatggtgaaaccccgtctctactaaaaatacaaaaattagctgggcgtgatggcaggtgcctrtaatcccagctacttgggaggctgaagcaggagaatcacttgaacctgggaggcggaggttgcagtgagccgagatcacgccattgcacttcagcctgggcaacaaaagcaaaactccgtctcaaaaaacaagaggaaacaaaacaaagcaaaaaccccatgaggatgccctctaatggtggaatttcaggcagtacagggtgaaattaccttcaaatctgcaacagaggtggggaaatccaggttggacctagatggtcaagaatcaacaagaggtagagggcagtgggggtgcggtgt

SEQ ID NO: 66081 - DNA, 601 bp, Human
gcacgatcttggctcaccgcaacctccaccgcccgggtacaagcgattctcctgcctcagcctcctgagtagctgggattacagatacccaccaccacgcccagctaatttttgtatttttagtagagacggggtttcatcattttggccaggatggtctctatctcctgacctcaggtgatccaccctcctcggcctcccaagtgctgggcttacaggggtgagccactgcgcctggcctatttatttttatgtttttgagacagagtcactctgtcacctaggctggagtgcaatggcmtgattttggctcactgcaacctccgcctcccaggttcaagtgattctctcacctcagcctcccgagtagctgggattacaggcacccaccatcacgcccaggtaatttttgtatttttgtagagatggggtttcatcatgttggccaggctggtcttgaactcctgacctcaagtaatccacccgcctcggcctcccaaagtgctgggtttacaggcgtgagccaccgcgccctgcttgaatcctgatatcttagcattggagagagattttccatgttattagtcttcaaaaatatttt

SEQ ID NO: 66082 - DNA, 601 bp, Human; identical to SEQ ID NO: 34884

SEQ ID NO: 66083 - DNA, 601 bp, Human; identical to SEQ ID NO: 34883

SEQ ID NO: 66084 - DNA, 601 bp, Human; identical to SEQ ID NO: 34882

SEQ ID NO: 66085 - DNA, 601 bp, Human; identical to SEQ ID NO: 34881

SEQ ID NO: 66086 - DNA, 601 bp, Human; identical to SEQ ID NO: 34880

SEQ ID NO: 66087 - DNA, 601 bp, Human; identical to SEQ ID NO: 34879

SEQ ID NO: 66088 - DNA, 601 bp, Human
caggctggtctcaaactcctgggctcaagagatcctcccacttcagcctcccaaagtgctgggattacagacgtgaaccactgtggctggccggtttttgtttttctattcttgcttttatccctttcacaagtttttctgagggcaaatatcatgtcctacacacccgtcagccccagtgcaatataccgtacacagcaggtgcccaatttgctatctgacaattgcctcttcacagttatttacacactgagtgtaacacatgtaggctgtgactattactttaataaatgacaagttrtatcattaaagagcagagctttgctcatactggacttagtatttgatgttagattccaggaaacaaaggatagtttgagttatccttaggaaaaaggagggacattgttaagtaaaatttgtaaaattctgaaaatctacctggcctaccactaacctttttaagagaatctccatgtctttcctggatgtatttcaggaatgctgtggtccactgcagagttgtggccttgtcagtctcggcattgcagaacggcactaagagattcaactcatcacagcaaatgcggattctgcgcct

SEQ ID NO: 66089 - DNA, 601 bp, Human
atgatctcagctcactgcagcctcgacctccctggctcaattgatcctccctcccagcccccgccccgagcagctgggactacaggcatacgccaccacaccaggttaatttttgtattttttagtagagatggggtcttgccatgttgcccaggctggtctcaaactcctgggctcaagagatcctcccacttcagcctcccaaagtgctgggattacagacgtgaaccactgtggctggccggtttttgtttttctattcttgcttttatccctttcacaagtttttctgagggcaaawatcatgtcctacacacccgtcagccccagtgcaatataccgtacacagcaggtgcccaatttgctatctgacaattgcctcttcacagttatttacacactgagtgtaacacatgtaggctgtgactattactttaataaatgacaagttatatcattaaagagcagagctttgctcatactggacttagtatttgatgttagattccaggaaacaaaggatagtttgagttatccttaggaaaaaggagggacattgttaagtaaaatttgtaaaattctgaaaatctacctggcctac

SEQ ID NO: 66090 - DNA, 601 bp, Human
aagtatatgcacccagtccacagaagtatatgcacccagtccacagaagtatatttcttattaacctgctgggcatatttgaagtccagatcagactatttgacacttatctgcatttttgtttctctttcttttttggggtgggtgggggtggggcagggtcttgccctgttgcccaggctggagtgcagtggtatgatctcagctcactgcagcctcgacctccctggctcaattgatcctccctcccagcccccgccccgagcagctgggactacaggcatacgccaccacaccaggytaatttttgtattttttagtagagatggggtcttgccatgttgcccaggctggtctcaaactcctgggctcaagagatcctcccacttcagcctcccaaagtgctgggattacagacgtgaaccactgtggctggccggtttttgtttttctattcttgcttttatccctttcacaagtttttctgagggcaaatatcatgtcctacacacccgtcagccccagtgcaatataccgtacacagcaggtgcccaatttgctatctgacaattgcctcttcacagttatttacacactgagt

SEQ ID NO: 66091 - DNA, 601 bp, Human
tatattcacccagtccgcagaagtatagtcacctagtccgcagaagcatggtcacccggtcggctgaagtacattcacccagtccgcagaagtatagtcacccggtccacagaagcatagtcacccggtccacagaagtacagtcacccggtccgcagaagcacagtcaccggtccacagaagcatagtcacccggtccacagaagtacagtcacccggtccacagtatagtcacccagtccacaaaagtatagtcacccagtccacagaagtatagtcacccagtccacagaagtatatgcacccagtccacagaagtatatgcacccagtccacagaagtatatttcttattaacctgctgggcatatttgaagtccagatcagactatttgacacttatctgcatttttgtttctctttcttttttggggtgggtgggggtggggcagggtcttgccctgttgcccaggctggagtgcagtggtatgatctcagctcactgcagcctcgacctccctggctcaattgatcctccctcccagcccccgccccgagcagctgggactacaggcatacgccaccacaccaggttaattttt

SEQ ID NO: 66092 - DNA, 601 bp, Human
ccatggaagtatagtcacccagtctgcagaagtacattcacccagtcagcagaagtatattcacccagtccgcagaagtatagtcacctagtccgcagaagcatggtcacccggtcggctgaagtacattcacccagtccgcagaagtatagtcacccggtccacagaagcatagtcacccggtccacagaagtacagtcacccggtccgcagaagcacagtcaccggtccacagaagcatagtcacccggtccacagaagtacagtcacccggtccacagtatagtcacccagtccacaraagtatagtcacccagtccacagaagtatagtcacccagtccacagaagtatatgcacccagtccacagaagtatatgcacccagtccacagaagtatatttcttattaacctgctgggcatatttgaagtccagatcagactatttgacacttatctgcatttttgtttctctttcttttttggggtgggtgggggtggggcagggtcttgccctgttgcccaggctggagtgcagtggtatgatctcagctcactgcagcctcgacctccctggctcaattgatcctccctcccagcc

SEQ ID NO: 66093 - DNA, 601 bp, Human
atattcaccgagtccacaaaggtatagtcaaccagtccacaaaagtatgttcacccagtccatggaagtatagtcacccagtctgcagaagtacattcacccagtcagcagaagtatattcacccagtccgcagaagtatagtcacctagtccgcagaagcatggtcacccggtcggctgaagtacattcacccagtccgcagaagtatagtcacccggtccacagaagcatagtcacccggtccacagaagtacagtcacccggtccgcagaagcacagtcaccggtccacagaagcatrgtcacccggtccacagaagtacagtcacccggtccacagtatagtcacccagtccacaaaagtatagtcacccagtccacagaagtatagtcacccagtccacagaagtatatgcacccagtccacagaagtatatgcacccagtccacagaagtatatttcttattaacctgctgggcatatttgaagtccagatcagactatttgacacttatctgcatttttgtttctctttcttttttggggtgggtgggggtggggcagggtcttgccctgttgcccaggctggagtgcagtggt

SEQ ID NO: 66094 - DNA, 601 bp, Human
tgccagctccctgtcatcattgggccttggttgggcgcctccctcgaccacccaacatcacccaatccaaagcagcccccgagtccggctggctcgcagcagcaccttccacccgcaaggccctgctcccactgtcttcacgtttactcgtcccctgcctccctccatgccagacatgcctctatcttgcgcagggtaccccagcaccttcagcagtgcctggtcacactggaaaagacctgctgagtgaaatgtgtaccaaaataatgtagagaaatcacttaaaactctcatgtattaygtcttcaaggacaaaaatatgcatccaagtaaaagggggcagtcactaaagaaacaattaagaacccatgtgtttcggctttttatgttctaattccccgaaaaaattgtgaactgacttgacctcagcctgtttcttggtgggtctaataatgtgacccagaagtaatcagattcaatgtaattacatttaagaaatattcagcaaacataatgtatgtaaagtatcatatccataaacatttggtctacttaatctttgactatacatacaattaacattttttaatttcaaaaatta

SEQ ID NO: 66095 - DNA, 601 bp, Human
ggccaaaccctgacgcctttttcccatcacaacccccaactggtaccgccacaaacacaagaagccttgtgcctttcctcctccccagcgccgccccctggcagccatcgcccggcaagccacatcttccagctactgcagactcctggtttccactctcaccccagcccagctcctactccctagcatccagtgtcccccagcagcagggtgatatgggtcatgtcactcactgcccaaagactgccgaggcccccaaccctcaggactagcggtccaccaggccccagcctgccccggkgccctgcccagcaacactggctggcaggcaggcactcctcagactctgcagccggcaggtcctggctgccagctccctgtcatcattgggccttggttgggcgcctccctcgaccacccaacatcacccaatccaaagcagcccccgagtccggctggctcgcagcagcaccttccacccgcaaggccctgctcccactgtcttcacgtttactcgtcccctgcctccctccatgccagacatgcctctatcttgcgcagggtaccccagcaccttcagcagtgcctggtcacactggaa

SEQ ID NO: 66096 - DNA, 601 bp, Human
gtctctattaaatacaaaaattagctgggtgtggtggctcaatggtaatcccagcactttgggaggctgaggtaggcaggatcacttgaggtcaagagtttgagaccagcctggccaacatggtgaaacctggtctctactaaaaatacaaaaattagccgggcatggtgggccatgcctgtagtcctagctactcaagaggctgaggcagaattgcctgaacctgggaggcagaggttgcagtgagctaagatgacaccactacacttcagcctgggcaacagagcgagacgccgtctcaaaaaaaaaacacggaagtatttaagtataaagaagcatggtgtctgcagcttactatcaaatggatcccaaagatacctggagagaaactgggaccggcagggagaatggagcaaacccggacaggcctacaaagagctctttgtactgttcttgcaatttttctgtaagtttgaaattacaccaaaatttaaaattaccaacagtaaatagagccatctaaacccagaatgtggggcattctctagacaaccggcctgatctcttcaaagcctcaatgccatagttaataactgtgggg

SEQ ID NO: 66097 - DNA, 601 bp, Human
ctttgggaggctgagacaggcggatcacaaggtcaggagttcaaaatcagcctggccaacatggtgaaaccctgtctctattaaatacaaaaattagctgggtgtggtggctcaatggtaatcccagcactttgggaggctgaggtaggcaggatcacttgaggtcaagagtttgagaccagcctggccaacatggtgaaacctggtctctactaaaaatacaaaaattagccgggcatggtgggccatgcctgtagtcctagctactcaagaggctgaggcagaattgcctgaacctggsaggcagaggttgcagtgagctaagatgacaccactacacttcagcctgggcaacagagcgagacgccgtctcaaaaaaaaaacacggaagtatttaagtataaagaagcatggtgtctgcagcttactatcaaatggatcccaaagatacctggagagaaactgggaccggcagggagaatggagcaaacccggacaggcctacaaagagctctttgtactgttcttgcaatttttctgtaagtttgaaattacaccaaaatttaaaattaccaacagtaaatagagccatctaaaccca

SEQ ID NO: 66098 - DNA, 601 bp, Human
ctccagcacggcccaggccagaggggtacagcagaccaaggagctcaggtggccagaggtaaggaggcataaactcattaggacaaaaagaatggcttttctttttcaagatgctttatttttaaaacaggtcacaacacagcgttcggctcattctgccacgaacaagctacaaacgcttgctctgcagccgagaggccctccagtggccatgttcaaaaacagaatgaaaatccgtatgtaggccaggcgcggtggctcacgttggtaatcccagcactgtgggaggccgaggcgggcrgatcacctgaggtcaggagttcgagaccagcctggccaatatggcaaaactccatctctactaaaaatacaaaaattagctgggcgtggtggcgtgaccaaacggcatgggaggccatgatcacaggctgctgggaatggatccaagagaggatgaagtggctcaggaggtacagacaagcgccgggcagccgggcagccaaggagagcagagaaatgggcggttgccagtacaggacacgaggtccagggagttctcacagaaggatcacgggagaagtcacagcgtgtccgcaggaaa

SEQ ID NO: 66099 - DNA, 601 bp, Human
aaaaaattacaagctatttaaaactgagaaacaatgaaagcattgtgtcctaacctgtgaaatgtttcaaaagcacaccaggacaaatttactataatgcattgattagaaaacaacatagacaaaataaactttcaacccaagataccagaaaaaaataaaacttcaagaaggaaataatagaaataaggttttgggataataaagataagagcaaattatgatggaaaaagcactaccactgaccccacataaaaaaccaacaaagtgaatgactgagccccagaaagactccagcacrgcccaggccagaggggtacagcagaccaaggagctcaggtggccagaggtaaggaggcataaactcattaggacaaaaagaatggcttttctttttcaagatgctttatttttaaaacaggtcacaacacagcgttcggctcattctgccacgaacaagctacaaacgcttgctctgcagccgagaggccctccagtggccatgttcaaaaacagaatgaaaatccgtatgtaggccaggcgcggtggctcacgttggtaatcccagcactgtgggaggccgaggcgggcggatcacctg

SEQ ID NO: 66100 - DNA, 601 bp, Human
gctctaactataagtcaggaaaatataccaggaagttattaagaggaagaaagcggccgggtgcagtggctcacacctgtaatcgcagcactttgggaggccgaggtgggtggatcacctgaggtcgggagttcacgaccagcctcaccaacatggagaaaccccatctctaataaaaatacaaaatttgccggggtggtggcacatgcctgtaatcccagctactcaggaggctgaggcaggagaattgcttgaacccaggaggcagacgctgtagtgagccaagatcgcgccattacayggcagcctgggcaacgagtgaaacttcatctcaaaaaaaaaaaaaaaaaattacaagctatttaaaactgagaaacaatgaaagcattgtgtcctaacctgtgaaatgtttcaaaagcacaccaggacaaatttactataatgcattgattagaaaacaacatagacaaaataaactttcaacccaagataccagaaaaaaataaaacttcaagaaggaaataatagaaataaggttttgggataataaagataagagcaaattatgatggaaaaagcactaccactgaccccacataaa

SEQ ID NO: 66101 - DNA, 601 bp, Human; identical to SEQ ID NO: 34878

SEQ ID NO: 66102 - DNA, 601 bp, Human; identical to SEQ ID NO: 34877

SEQ ID NO: 66103 - DNA, 601 bp, Human; identical to SEQ ID NO: 34876

SEQ ID NO: 66104 - DNA, 601 bp, Human
ccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcrctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgcttcgccagggctggacatgtgctggacgctgagggacctggctttggccagccctggtgcctgggtgccgtggggcgggcggcagggtccaggcgagggg

SEQ ID NO: 66105 - DNA, 601 bp, Human
cccctgcccggctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggygctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgcttcgccagggctggacatgtgctggacgctgagggacctggctttggccagccctggtgcctgggtgccg

SEQ ID NO: 66106 - DNA, 601 bp, Human
tctgtgctggaaggacgctgcctgtggcccctcaccgtgccgtccgccgaggcccactgtgtcccaaagccagagacggcaccgggatccaccctgtgccagccactcggggccccctgcccggctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccaygggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagt

SEQ ID NO: 66107 - DNA, 601 bp, Human
tgcaccgaggggaggaattggggtgcacgggacagccagtgctctgcggggggcatcatcaccatggtatggggcaggaggaccttgcaaccctgggaattctggctgggcagacccccttgtggagacaagctctgcactatgccctgtgtgcccccacctctcagcaggcggcctgtgctccgggaagggggcacgggggaggggggctcaggcaccccgtgagcggtctgctctcagctcaccagcgctgggagggcccatccccctccccgttttgcagatgggcaaatgtggccckgtgggcgcacagagggcggacgaaagcagcacacatggagcccgcagagctgccgccatctgcagtctctcactcgagcctcccctggcctgtctcgttttcacactgaggccttcaggggcggctgcggttacatatctgaacggggacagcgggttccggctccaggtccggcttctaaccccacactcctggggctgatgcagggcggacctcccccgggtgacccccaggagcagaggcctagggagggcagaggcagtggcctggtcaggcctggagtcgggaagccactctcga

SEQ ID NO: 66108 - DNA, 601 bp, Human
tgtctgacccacgcacggccgctgcagctaaggccacactggggcctgaccaccttcaggagcccaacttcccctgggattgcaggtgtgtggggaccggagggcccgggggacagggaactgggaggctcccaggccgtcagaggggcccagggctgggccagtgaacaaggcacgtgaacaaggcagcggctgcgtggtgggccctgctgtgcgtgccattcagaatgggggccccaccggactcacggtggcttcccacctccctgcccagcctgggctcccgagggcaggggccgcmtcctgctcccagccgagtccccagctccacacacaggaagcccccagccctccggccacgccccggccacgaccccagccacgccctctgagggccctaccttgataagcctggctaacccgaagtccccaactttgcagagggtgttttccccgacgaggatgttcctggcggccaggtcccggtggatgtaattctgcgactccaggtaacacatgccctcagccacctgccaggcgatgtccagcagctccgaaacgggcaggactttctcatcagagtctgcagaggggagtggag

SEQ ID NO: 66109 - DNA, 601 bp, Human
ggacagtggggacagtacctgggtagggcacctgacccctgctgaacatctcatgcaggagaatcccaaaggaccagacgtcggatttggtggagtaatggcctcgggagagcgcttcaggggccgtccacttgtaggggatattgtggtcatgggagaggtagacgtcctcctgcaatcagcctggagctgagtgggccgtgggggctgcctgtgccctgcccccgaagcatggacgggcacagcggccgcattgccccagcagtgggacggtgatgaccccactgtctgacccacgcayggccgctgcagctaaggccacactggggcctgaccaccttcaggagcccaacttcccctgggattgcaggtgtgtggggaccggagggcccgggggacagggaactgggaggctcccaggccgtcagaggggcccagggctgggccagtgaacaaggcacgtgaacaaggcagcggctgcgtggtgggccctgctgtgcgtgccattcagaatgggggccccaccggactcacggtggcttcccacctccctgcccagcctgggctcccgagggcaggggccgcatcctgctcccagccg

SEQ ID NO: 66110 - DNA, 601 bp, Human
cctcccccaagaagccacaccagccatccactgccccttcctggggccttccccgcagcctcagctgccatgccttggcgccacccagcacactgtccactgctaacacctccctctggacagggctccaacaggcagctccaggcaccagcctgggtgctcagagaatggtgcaggtgtggagttcaggcgatggcccgcggagggccctgaagcccgtgggggaggcaccccccagcgtccctgccggctacccaggacctcccccactctgcctctcatgcccagtcagggacagtgrggacagtacctgggtagggcacctgacccctgctgaacatctcatgcaggagaatcccaaaggaccagacgtcggatttggtggagtaatggcctcgggagagcgcttcaggggccgtccacttgtaggggatattgtggtcatgggagaggtagacgtcctcctgcaatcagcctggagctgagtgggccgtgggggctgcctgtgccctgcccccgaagcatggacgggcacagcggccgcattgccccagcagtgggacggtgatgaccccactgtctgacccacgcacggccgctg

SEQ ID NO: 66111 - DNA, 601 bp, Human
taccctcccccaagaagccacaccagccatccactgccccttcctggggccttccccgcagcctcagctgccatgccttggcgccacccagcacactgtccactgctaacacctccctctggacagggctccaacaggcagctccaggcaccagcctgggtgctcagagaatggtgcaggtgtggagttcaggcgatggcccgcggagggccctgaagcccgtgggggaggcaccccccagcgtccctgccggctacccaggacctcccccactctgcctctcatgcccagtcagggacastggggacagtacctgggtagggcacctgacccctgctgaacatctcatgcaggagaatcccaaaggaccagacgtcggatttggtggagtaatggcctcgggagagcgcttcaggggccgtccacttgtaggggatattgtggtcatgggagaggtagacgtcctcctgcaatcagcctggagctgagtgggccgtgggggctgcctgtgccctgcccccgaagcatggacgggcacagcggccgcattgccccagcagtgggacggtgatgaccccactgtctgacccacgcacggccg

SEQ ID NO: 66112 - DNA, 601 bp, Human
atcgcttcaaaaggtcagctaggaggtcacctcatccaggacccccaccccagggctgccctggacagcagccctccacagcccagcacaagaaaatggagcagacgggccggctgcccatcaatcagctattaatagtagcgtgcgccctggcagggccctaggacaagtgagggcagtaccatccccagccccagccttggccctggggggaagggggtaaggctccagcgccctccagccccagctcaacatggcagagttccagagccttctgcagaccctcccaggtcacctcccycaccacagggcaagtccggcagctcgatggccacccctcccccaccaagctccccctaagagagaggctgccccaccagaccctctgaggcctgagtgccccacagcgggggtccctcctgccctggaggaggtcacctgagccccatgccctggggctgggagatgccaagcctggccaccacgggagttgggggttccttctcagggggccaagaccatagcctggggagctcacctcagccgcctccttctcgaacttctcaatggtccttttgtcaatacctccgcatttgtagat

SEQ ID NO: 66113 - DNA, 601 bp, Human
acaggccctcccaggagtgggcttctccccagagtcctgggtgggggatggggatcagagagcagaccccgtctcatgaccgctccccaccaccgtctcagccaccaaagaggaatcgcttcaaaaggtcagctaggaggtcacctcatccaggacccccaccccagggctgccctggacagcagccctccacagcccagcacaagaaaatggagcagacgggccggctgcccatcaatcagctattaatagtagcgtgcgccctggcagggccctaggacaagtgagggcagtaccatcyccagccccagccttggccctggggggaagggggtaaggctccagcgccctccagccccagctcaacatggcagagttccagagccttctgcagaccctcccaggtcacctccctcaccacagggcaagtccggcagctcgatggccacccctcccccaccaagctccccctaagagagaggctgccccaccagaccctctgaggcctgagtgccccacagcgggggtccctcctgccctggaggaggtcacctgagccccatgccctggggctgggagatgccaagcctggccaccacgg

SEQ ID NO: 66114 - DNA, 601 bp, Human
gggccctggcctccgccctcatcatccaggtgagagctcccacaggccctcccaggagtgggcttctccccagagtcctgggtgggggatggggatcagagagcagaccccgtctcatgaccgctccccaccaccgtctcagccaccaaagaggaatcgcttcaaaaggtcagctaggaggtcacctcatccaggacccccaccccagggctgccctggacagcagccctccacagcccagcacaagaaaatggagcagacgggccggctgcccatcaatcagctattaatagtagcgtgygccctggcagggccctaggacaagtgagggcagtaccatccccagccccagccttggccctggggggaagggggtaaggctccagcgccctccagccccagctcaacatggcagagttccagagccttctgcagaccctcccaggtcacctccctcaccacagggcaagtccggcagctcgatggccacccctcccccaccaagctccccctaagagagaggctgccccaccagaccctctgaggcctgagtgccccacagcgggggtccctcctgccctggaggaggtcacctgagccc

SEQ ID NO: 66115 - DNA, 601 bp, Human
gtcggggtcctgggacgccggccccctccgtcgggaccccacacccagaccctgccccccagggccggcctccgcacctgctccgaaatgggcgcggctacgcaggtccaccagcaggtggcgcaagggcctgggagtcgctcgctctacgagcgaagccgccagatgggataaacccctcccgggcgagggctcccctttatctgaagctgcggacgcccccagatcccttcctcaaccagaggccaataataccaccgtgtttggggctgtcagataaataaccctctgtgtgtgtgtktttttttaaggtaaggagaaaggaaaactgaatgaggtcaggaggagggcctggccacgcagctccttcccgctgctccagcctccccatccctctgaggcttctcctccccttcctcgctctgccggacacgggaagctggggggcctcggccagtgagacccccacagaaggggacgggcttcagtcagggcagcagcggcggtcactacccagctgggcagaactcctcgccagggcctcgcacagacaggactctgccctccaggaggctgcccagtctggagcagacccagatgg

SEQ ID NO: 66116 - DNA, 601 bp, Human
gtgatgccgcgctcacgctccgccttcagcttgtccagcacccaggcatacttgaaggatcccttccccatctggagcgggtgagggtcacggctgagggcgggacccgggacccaggagtccctggtggtgcgagctgcttgttacagcagagtggccgcgagaggcgggagatgggctccagcacccccttgctctccgtcggggtcctgggacgccggccccctccgtcgggaccccacacccagaccctgccccccagggccggcctccgcacctgctccgaaatgggcgcggctaygcaggtccaccagcaggtggcgcaagggcctgggagtcgctcgctctacgagcgaagccgccagatgggataaacccctcccgggcgagggctcccctttatctgaagctgcggacgcccccagatcccttcctcaaccagaggccaataataccaccgtgtttggggctgtcagataaataaccctctgtgtgtgtgtgtttttttaaggtaaggagaaaggaaaactgaatgaggtcaggaggagggcctggccacgcagctccttcccgctgctccagcctccccatccctctgagg

SEQ ID NO: 66117 - DNA, 601 bp, Human
cgtgatcatgttcttgatgaagtcgcggtggccgggggcatcgatgatggtgatgtagtacttggtggtctcgaacttccagagggagatgtcgatggtgatgccgcgctcacgctccgccttcagcttgtccagcacccaggcatacttgaaggatcccttccccatctggagcgggtgagggtcacggctgagggcgggacccgggacccaggagtccctggtggtgcgagctgcttgttacagcagagtggccgcgagaggcgggagatgggctccagcacccccttgctctccgtcrgggtcctgggacgccggccccctccgtcgggaccccacacccagaccctgccccccagggccggcctccgcacctgctccgaaatgggcgcggctacgcaggtccaccagcaggtggcgcaagggcctgggagtcgctcgctctacgagcgaagccgccagatgggataaacccctcccgggcgagggctcccctttatctgaagctgcggacgcccccagatcccttcctcaaccagaggccaataataccaccgtgtttggggctgtcagataaataaccctctgtgtgtgtgtgttt

SEQ ID NO: 66118 - DNA, 601 bp, Human
ggtgtccgtgcgtctctgtgagtgccctgaaatgtcatacagtctacacctggcgggtggcacctctgcccactgctcactctccccatcctggcctccaacccctccatgtatgaaggtgtgtccacgtccccatctgcccccatctatctggggactctgacactggctggatgccttcacaggcactggttcagatgccagagcactggattcatccttaggggggctctgagccagactgggtgagggtggcccaggtgaggggtcccctgccctcacaggaagcacaggagacccyaccatcccagtgaccccaggggcccccagtgtcccttgaagggtgcagcggcctctcccccagccccgcctgctgtgccctgctcacctgggatgtacccgtgatcatgttcttgatgaagtcgcggtggccgggggcatcgatgatggtgatgtagtacttggtggtctcgaacttccagagggagatgtcgatggtgatgccgcgctcacgctccgccttcagcttgtccagcacccaggcatacttgaaggatcccttccccatctggagcgggtgagggtcacggctgagggcggg

SEQ ID NO: 66119 - DNA, 601 bp, Human
gggccctgagccagttagggaaacccagcaggtttcgaggggaacctgcatttcccggggacaggccctcgacctccccgtgccacctgccggtgcctcgctctgggccagggggtccagccagctcccgtggcccgccccgccctagccgccactcacgttgggggagggctccagcatgttgtcgccgtgccagccggagatgggcacaaagggcacggtggccgggttgtagccgatcttcttgatgtaggcgctgacttccttgacgatctcgtcgtagcgcttctcgctgtaggcyggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacagtgagccctgccccgcctgcctggcaggggacagagcgagcctggccccacctcacttccaggcctctccaggcagcgggctggggcctgagcagcccactggggccttggggagggaggcatggg

SEQ ID NO: 66120 - DNA, 601 bp, Human
aggccgctgcccctgctgtgttgacatcgtagatgggccctggccccggccagccgcgtgggaggctgagtgtaggagcaaagcccggtgctgaggggcatggggctccccgccgggccctgagccagttagggaaacccagcaggtttcgaggggaacctgcatttcccggggacaggccctcgacctccccgtgccacctgccggtgcctcgctctgggccagggggtccagccagctcccgtggcccgccccgccctagccgccactcacgttgggggagggctccagcatgttgtcrccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacagtgagccctgcc

SEQ ID NO: 66121 - DNA, 601 bp, Human
ctgctggtctgtctccctgctgtctctagactccacacctgcaccctcactgtgggcagcgacagtgctggcagagcctagtggtggccattctggggtctcctctggcttggagaaccctgggaacagtctcaggttctgcaagtgtctccacgcgtcacctccagccaaggcagagtccctgggctacagactgttcgcacgttgagctcccaggtgaccggccaagagccaacccttggccatcccagcaagcccagaagcatgcacacttcccaaagcccaaccctgctccaagatyccaggggaggcagccaaggaggcccccacggcccagcccaaagcccctgcacggtgtccaggaccaggacaatggcctggcagagatgaaaccgaccgcccccatggcagggctctggagaccaagcacatgggcctggtgctggaggccgctgcccctgctgtgttgacatcgtagatgggccctggccccggccagccgcgtgggaggctgagtgtaggagcaaagcccggtgctgaggggcatggggctccccgccgggccctgagccagttagggaaacccagcaggtttcgaggg

SEQ ID NO: 66122 - DNA, 601 bp, Human
catcccatgaagcctccctctgggccacctgccacaaacagggagcaggggagggggccggcagcacagtgccccagccccccagggcctgtgtaagcacgggccacctagcagctcaggccagaggggagtgcagggtccctgatggctggaggcctccctggggaggggagagtggcgttcgccacatgataccccatgaggaaaacgccatcacaggtaaacaacaccgagcctcgtgagatggaggcggagctgggggagtccctctcagttctgtccccagacctcagctccaggytcagtgctgctggtctgtctccctgctgtctctagactccacacctgcaccctcactgtgggcagcgacagtgctggcagagcctagtggtggccattctggggtctcctctggcttggagaaccctgggaacagtctcaggttctgcaagtgtctccacgcgtcacctccagccaaggcagagtccctgggctacagactgttcgcacgttgagctcccaggtgaccggccaagagccaacccttggccatcccagcaagcccagaagcatgcacacttcccaaagcccaaccctgctc

SEQ ID NO: 66123 - DNA, 601 bp, Human
agtccccgaaaccccgggcccctgaccatcagctccaggcagggcagatgacttgactaggaggatgctgagtctggccaagggccaggccagggacagagctggaggagcctcgccccaccctagcttctggacaccgtgctgcctccgagcttggcccagccttgtccggagcttctcctagtgtggcccccactcccatcccatgaagcctccctctgggccacctgccacaaacagggagcaggggagggggccggcagcacagtgccccagccccccagggcctgtgtaagcacgrgccacctagcagctcaggccagaggggagtgcagggtccctgatggctggaggcctccctggggaggggagagtggcgttcgccacatgataccccatgaggaaaacgccatcacaggtaaacaacaccgagcctcgtgagatggaggcggagctgggggagtccctctcagttctgtccccagacctcagctccaggctcagtgctgctggtctgtctccctgctgtctctagactccacacctgcaccctcactgtgggcagcgacagtgctggcagagcctagtggtggccattctg

SEQ ID NO: 66124 - DNA, 601 bp, Human
actgtgaacaaatccccagtccagccccaagtccccgaaaccccgggcccctgaccatcagctccaggcagggcagatgacttgactaggaggatgctgagtctggccaagggccaggccagggacagagctggaggagcctcgccccaccctagcttctggacaccgtgctgcctccgagcttggcccagccttgtccggagcttctcctagtgtggcccccactcccatcccatgaagcctccctctgggccacctgccacaaacagggagcaggggagggggccggcagcacagtgcyccagccccccagggcctgtgtaagcacgggccacctagcagctcaggccagaggggagtgcagggtccctgatggctggaggcctccctggggaggggagagtggcgttcgccacatgataccccatgaggaaaacgccatcacaggtaaacaacaccgagcctcgtgagatggaggcggagctgggggagtccctctcagttctgtccccagacctcagctccaggctcagtgctgctggtctgtctccctgctgtctctagactccacacctgcaccctcactgtgggcagcgacagt

SEQ ID NO: 66125 - DNA, 601 bp, Human
tgaagccgacgttgtcgccgggcagagcttcgctcagagcctcgtggtgcatctccactgacttcacctcagtggtgatgttcactggcgcaaaggtcaccaccatgcccggccgcaggatgccggtctccacccggcccacgggcaccgtgccaatgcctgcagaggggagggggtgtgaggggaaggtggggcccgaggggatgctggggcaggatattcggggacagagcctggaaaccaacaaagcctgggactggatccccccgacaggcctgggggttggggccacatgggcggrgtgcaggggaagggaggccagggacaagggcagacacagagattccaagggaagtgggggctctcccacccagctggggaaataagaggctgagcagcagagctcccaggaacccacggaaaagccacagggacagagaagcgggaggatgggcagagaggggctgtctgaacctggggtcccatccttgcccccggagagcactttccctcaaaggaggcactatgggacccctcctttgtctgaggactcctccctgtgagtgtgggcggggcgactgactgcttctgcctggggcct

SEQ ID NO: 66126 - DNA, 601 bp, Human
agacctgaacctcaacatcctcattaagcaaaagataaacaactgagattcattgtttcgaaggggcaggggcagcacttacacggccaaccccagctggaactaaggcgggggggtgacaaaactggacctcaattcctgtgtttcagttgtatctcaataaagccacttttaaaaatcatatgaagaggccaggcacggtggctcacacctgtcatcccagtactttgggaggctgacgcacgtggatcacttgaggtcaggagttcgagaccagcctggctaacatggtgaaaccccrtatctactaataatacaaaaattagccaggcgtggtggcacatgcctgtaatcttacctacttgggaggctgaggcaggagaatcacttgaacccgggaggcggaggttgcagtgagccgagatcgcaccactgcactccagcctgggcaacagagcgagactccgtctcaaaaaataaataaataaatcatatgaagaggccagcaaagaggggcaatgaagactgtagagaataaaagtatgacagagatgtctcagacagtaagttaacaaaagcgtttttctaggacgaatgtagg

SEQ ID NO: 66127 - DNA, 601 bp, Human
ctgaggacccagcccccagacctgaacctcaacatcctcattaagcaaaagataaacaactgagattcattgtttcgaaggggcaggggcagcacttacacggccaaccccagctggaactaaggcgggggggtgacaaaactggacctcaattcctgtgtttcagttgtatctcaataaagccacttttaaaaatcatatgaagaggccaggcacggtggctcacacctgtcatcccagtactttgggaggctgacgcacgtggatcacttgaggtcaggagttcgagaccagcctggcyaacatggtgaaaccccgtatctactaataatacaaaaattagccaggcgtggtggcacatgcctgtaatcttacctacttgggaggctgaggcaggagaatcacttgaacccgggaggcggaggttgcagtgagccgagatcgcaccactgcactccagcctgggcaacagagcgagactccgtctcaaaaaataaataaataaatcatatgaagaggccagcaaagaggggcaatgaagactgtagagaataaaagtatgacagagatgtctcagacagtaagttaacaaaagcgtttt

SEQ ID NO: 66128 - DNA, 601 bp, Human
ctcaggctctgaggacccagcccccagacctgaacctcaacatcctcattaagcaaaagataaacaactgagattcattgtttcgaaggggcaggggcagcacttacacggccaaccccagctggaactaaggcgggggggtgacaaaactggacctcaattcctgtgtttcagttgtatctcaataaagccacttttaaaaatcatatgaagaggccaggcacggtggctcacacctgtcatcccagtactttgggaggctgacgcacgtggatcacttgaggtcaggagttcgagaccrgcctggctaacatggtgaaaccccgtatctactaataatacaaaaattagccaggcgtggtggcacatgcctgtaatcttacctacttgggaggctgaggcaggagaatcacttgaacccgggaggcggaggttgcagtgagccgagatcgcaccactgcactccagcctgggcaacagagcgagactccgtctcaaaaaataaataaataaatcatatgaagaggccagcaaagaggggcaatgaagactgtagagaataaaagtatgacagagatgtctcagacagtaagttaacaaa

SEQ ID NO: 66129 - DNA, 601 bp, Human
accgagaggcgggtactgggagaagctctccacacacatgggctttcccggcaccatctccacgatggccgcgtctccagacttcagggacttggggttgtcctccagcttcttgccagagcgccggtcaatcttctccttcagctccgcaaacttgcaggcgatgtgggctgtgtggcagtcgatgaccggggagtagccggcgctaatctgccccgggtggttcaggatgatgacctgcgagcggagccacaggcggccatcaggcacatcggcggtgggcaccgggagggcgccagarcggggctgggaggcccagtcaccggcgcccctgcacgggctcctgggcccggagtgctgactggagggggctcaggctctgaggacccagcccccagacctgaacctcaacatcctcattaagcaaaagataaacaactgagattcattgtttcgaaggggcaggggcagcacttacacggccaaccccagctggaactaaggcgggggggtgacaaaactggacctcaattcctgtgtttcagttgtatctcaataaagccacttttaaaaatcatatgaagaggccaggcacggtggc

SEQ ID NO: 66130 - DNA, 601 bp, Human
cacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggtcagtcccgggcgggggggccttcctgccgtgggcctgggcacgattctggacccttccagcccagggctctgcctcctccgtagcatccatcccccracaggaagggtctggcctgatgacggagcagtggtcctgcaagcccctccagtgcccatgggctcgtgcctgacaccctcccccggagtctctgctggctgagtgtttcagaccgtgggacgtgaggaggggctgcctctggccacagtctgagggtctcagctgtggaggccgccagcttggtgcacaagtacccctttgtgatagaagtgggtggggctgacattgcctggggccctcaccttccccgctgctgttctgcacagggagaggagatgtttaaagaacaggatcagggtg

SEQ ID NO: 66131 - DNA, 601 bp, Human
gtctggcctccttctatgactggccgctgactgctgaggtgccacccgagctgctggctgctgccggcttcttccacacaggtcagtcccgggcgggggggccttcctgccgtgggcctgggcacgattctggacccttccagcccagggctctgcctcctccgtagcatccatcccccaacaggaagggtctggcctgatgacggagcagtggtcctgcaagcccctccagtgcccatgggctcgtgcctgacaccctcccccggagtctctgctggctgagtgtttcagaccgtgggaygtgaggaggggctgcctctggccacagtctgagggtctcagctgtggaggccgccagcttggtgcacaagtacccctttgtgatagaagtgggtggggctgacattgcctggggccctcaccttccccgctgctgttctgcacagggagaggagatgtttaaagaacaggatcagggtgaccaaggcaggcagtggtcagccagaaggtcctggatgctcagcctgtggggaatttctccaggccccaacctgcagctactgtctggtcttccccaactgaatcaagtccccggagtacc

SEQ ID NO: 66132 - DNA, 601 bp, Human
gtgatagaagtgggtggggctgacattgcctggggccctcaccttccccgctgctgttctgcacagggagaggagatgtttaaagaacaggatcagggtgaccaaggcaggcagtggtcagccagaaggtcctggatgctcagcctgtggggaatttctccaggccccaacctgcagctactgtctggtcttccccaactgaatcaagtccccggagtacctatcctagtcttggcccgggcctgctcctctgccctacagctgcagaccatgtggtcagacctgagttcaggtcccagcyctgccacttcctggctgaaggacagggcagcagggcccaccgagggctttacaaatactggcacagccatggtcattgtcagcagtgggctctgggggggcaccatcctggtaaggctggaccaacttaagacagctggtcggggggacagtggctgggacagtcagaagccgtggcgtgaaggggcaggcccagctcacccacctccctggaagtccaaggctcaggaggcaaaggccaggcaagaggcatggcaggtgcagagccggggtctttggggctggtagaggtccagtgccc

SEQ ID NO: 66133 - DNA, 601 bp, Human
ggtgaccaaggcaggcagtggtcagccagaaggtcctggatgctcagcctgtggggaatttctccaggccccaacctgcagctactgtctggtcttccccaactgaatcaagtccccggagtacctatcctagtcttggcccgggcctgctcctctgccctacagctgcagaccatgtggtcagacctgagttcaggtcccagctctgccacttcctggctgaaggacagggcagcagggcccaccgagggctttacaaatactggcacagccatggtcattgtcagcagtgggctctggsggggcaccatcctggtaaggctggaccaacttaagacagctggtcggggggacagtggctgggacagtcagaagccgtggcgtgaaggggcaggcccagctcacccacctccctggaagtccaaggctcaggaggcaaaggccaggcaagaggcatggcaggtgcagagccggggtctttggggctggtagaggtccagtgcccgatgcagcccaaacctgtgatgtcagtggcaggtgacgtatcgcatggatgccgatgaggggacggggtcgccaggaggtagagagatgacgggtc

SEQ ID NO: 66134 - DNA, 601 bp, Human
ttctggctcctgaagccccagggctatagatgtaccaagccctggggggcccccactgctcactctgggaacaatgcaaatgccagctcagtcctttcctgaacattctcgcccatcctggccggcaccccagtcacccttgtccccttttcacctttgatgctaatgaggtacaagtgacatcccccaccaagccccctgcccaccccctcctccttcttgccacctgggagctcccctccagctgaagctctcatagccttggaaggacacaccgggggcccggggactgggtgggacytggctggggccagcatctctccgcaccccaggccatcaggacaaggtgaggtgcttcttctgctatgggggcctgcagagctggaagcgcggggacgacccctggacggagcatgccaagtggttccccaggtaccggctgcccctgcggggccccgggtctgatcatgggtagggggtgggcccccaacggctctgtcgacccaacaccaggcctgctttgcctccctggccccacagggcactggggaggcccttctgtgggaggtgcttctggccggcaggtacccacttttcctgt

SEQ ID NO: 66135 - DNA, 601 bp, Human
gaagcgcggggacgacccctggacggagcatgccaagtggttccccaggtaccggctgcccctgcggggccccgggtctgatcatgggtagggggtgggcccccaacggctctgtcgacccaacaccaggcctgctttgcctccctggccccacagggcactggggaggcccttctgtgggaggtgcttctggccggcaggtacccacttttcctgtgagggccccttttcggaagggctgctgggggcagaaatgcctctcccatgggactaccctgaagccccatggaggcgtctccamagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcttgggtgagcgccacctctcctcggggctccgggtggcagtggggtcctgcccctcctatttccccaaggcctgatggtctc

SEQ ID NO: 66136 - DNA, 601 bp, Human
gggccccttttcggaagggctgctgggggcagaaatgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcytgggtgagcgccacctctcctcggggctccgggtggcagtggggtcctgcccctcctatttccccaaggcctgatggtctctggctccttccaggacccgtgggaagaaccggaagacgcagcccctgtggccccctccggtgagagctgacaccacccctgctgactccttgtgcgcctgcagcctgtgcttggccaaggccactgggtgtccccaccctcccagacagcagggagagtgacgggcatgtgacagggtgtgacgctgctgcctgggttggcttcagggggctgtgccat

SEQ ID NO: 66137 - DNA, 601 bp, Human
gcaaggccccattctgcttctctcccagcttaccccttgggcacagcccattgcccgtcgccataccacccccaacagtgcccagcacacagcatctgcagctactgccagatgggcaggatgtgcagagggcattggacaagggacaggctctctggtggcgcctccaggaagcctctggatcctgttatgctgtgggaggggtgggaagaagtgtcgggagcggggatactctgcagcccctccactcccggccagaactggaccccacaggctgcagacctgtatctgggccggcccrgctttctccttgggagttaggcctcaagtctatcctaactgtccacagtccctgcctctgggtaccctgagctgcccacacccaggagagaggtccagtctgaaagtgcccaggagccaggtgcaggcccgggaccccctgggtgagggctggggcaggggagggctgagggaccccgaccttccatggcccatagagggtgggggccagggtgtggggacatttcgcaggcctgtcctcctaggaggggtcagtccagccgaggcccagagggcgtggtgggttcttgagcccccagga

SEQ ID NO: 66138 - DNA, 601 bp, Human
ccagcacacagcatctgcagctactgccagatgggcaggatgtgcagagggcattggacaagggacaggctctctggtggcgcctccaggaagcctctggatcctgttatgctgtgggaggggtgggaagaagtgtcgggagcggggatactctgcagcccctccactcccggccagaactggaccccacaggctgcagacctgtatctgggccggcccagctttctccttgggagttaggcctcaagtctatcctaactgtccacagtccctgcctctgggtaccctgagctgcccacayccaggagagaggtccagtctgaaagtgcccaggagccaggtgcaggcccgggaccccctgggtgagggctggggcaggggagggctgagggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatc

SEQ ID NO: 66139 - DNA, 601 bp, Human
agggacaggctctctggtggcgcctccaggaagcctctggatcctgttatgctgtgggaggggtgggaagaagtgtcgggagcggggatactctgcagcccctccactcccggccagaactggaccccacaggctgcagacctgtatctgggccggcccagctttctccttgggagttaggcctcaagtctatcctaactgtccacagtccctgcctctgggtaccctgagctgcccacacccaggagagaggtccagtctgaaagtgcccaggagccaggtgcaggcccgggaccccctgggtgagggctggggcaggggagggctgagggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgc

SEQ ID NO: 66140 - DNA, 601 bp, Human
ggaagcctctggatcctgttatgctgtgggaggggtgggaagaagtgtcgggagcggggatactctgcagcccctccactcccggccagaactggaccccacaggctgcagacctgtatctgggccggcccagctttctccttgggagttaggcctcaagtctatcctaactgtccacagtccctgcctctgggtaccctgagctgcccacacccaggagagaggtccagtctgaaagtgcccaggagccaggtgcaggcccgggaccccctgggtgagggctggggcaggggagggctgrgggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagcc

SEQ ID NO: 66141 - DNA, 601 bp, Human
cccgtccgcagccgcgtgcgcaccttcctgtcctaggccaggtgagcgccccagcaccacgcgcagccagccctcctgcggagggggccctgagccggctgtgcccggccctcctgaacccatgcaggcccttcccgggtggcagcgtcagcttgtttttacccggctcccaggtcccgctgatagcgcccatcaatcttactacctcccttgacgcttaggttggggcctggtccttcgggcaccgtgccctggcggccaccatagctctgcctgcctgcattaactgacgcctgctggytcctctcagccttgattttcctcagtggtcaaggaaagccggctttggaggcgtttggggaaacagggtgggccaggttgggcttacacaagcgagacactggcctggcttcaacccggggccaaggcatggtgggaacacctgcacgggaagggggtgtgtgaacctgttcttagagaagtgggtgggataccccatactggccgagggacaggtgctgtgaccgcctcggggctccccagagcctctgtagttacccccgggatgtgtctgaagatctggcaggggacaaagtggtcg

SEQ ID NO: 66142 - DNA, 601 bp, Human
gtgaattcctcacagatgaaatcaggagctgcccctcaaggactctatttcttccttcggctctatcaaatattttaaggtacttcccagcaacggaaacatgggaccctgcaatgacagacttcgcattcctcctgagcggacaggcaataagcaagtaaacgcgcaaatacccaagtgcggcctcaacccgcgctcctgccgggagggtctccagtcaccgagtaaccccggccctgccccgcgccgccgccgggactccgccccgcaagcaagtggggtctcctttgtcccgcgcgcyctggccgcgtcccgcccttcggcgtagcccatgggaggcgccctgagggcagggcccttctgattccccacctggcctcgagtgaggacgcgctcaacaacatctcgagtaaagcgggggaactcgcttcaacgcgcagacagcacagctctcgcccagcccggtctcgggtcagccgtctctccctggacctcagggacactagccctggaaggccgccggtcgggaggggactccctccgtctgaggggcggccgcggacacccggcgcctttcccccgccccaccccgtgcggcctc

SEQ ID NO: 66143 - DNA, 601 bp, Human
atgccttgggagtatgggaccttaggggtaaggatagggctacaattgtgcaggctacaattaaagatttttttcttaaatgaaaacactttaagaagtgaaagagactccagcaaccttccagaatttgtccagatatgaataactatataaattaattcctgctcttgcttagttcacaaaaacaaaatggtaaaactgagaaagagtgtgtttggaggaaataccaacaacaacaacaaagactgaggtattagcagtttccaaaagacacccaaatgggaactggaggttttttccyttcagggaggtcttgctttgttgacctggctggtctcaaactcctggcctcaagggattcccctgtctcagcctccccaaagtgctgggattgtaggtgtgagccaccctgcctctttcattccaataggaaagtatttaaagagtaaatgtagggccaggcacggtggctcacgcctgtaatcctgacactttgggaggcccaggagagaggatcacttgagcccaggagttgaaggccagcctgggaaacataggaactcttatttctacttctacctgcccatcagacacgtgatca

SEQ ID NO: 66144 - DNA, 601 bp, Human
tctttctggccggagatcggcccggtcgtgagtcgtgtctgtgccaggccccccacgctgtgctccagggcctcagtgcccggcgcgccgggggctgtatcgccagccacttggggcaggaaaaaggaatcacaaaatacaaccctctcctttacccaggaggagaacgtggattcccagaaaaaagaaaaagtgtatatatatatatatatgcctactgttttcttattgctaacaaaaacttcagccactgttttgttttttttttttgagaaactgatgaattttctttacttttacrttgtataaggccagctaactttaacagttaattttagataaatcaactcaccaatgctaaaaggtgtcacaatcaaatcgtccactacttcccctcaaagcaaacacgaaagcactgcctttggctcctttgaagaatactaaccagatctgccaggcgcggtggttcaagcctgttcccagcacttaggtaggccgaggtgggtggatcgcctgaggtcctgaggttaggagttcaagaccagcctgaccaacatggtgaaaccccatctctactaaaaatacaaaaattagccgggcg

SEQ ID NO: 66145 - DNA, 601 bp, Human
agaaaggagcacagcgaggaagggaggcgggcacgctggacctctaggccccagggaccttggcggtgtggtcccaaagctctgcctcctcccaccatgtcaatcctacactcagaactactgaccagtagctagaactcaaagaacgcatggacatgtttgcccacaggggttggagggaaagattagacacttactatcaagagaggggaaagtgaggtatggtagatgtcaaccttccatgtggattttcttcagttcgctcaatagtaactagagtgacactctatcacctgtctgyccccagatactgcaggaaagagactgggagggggcaggaggggcagctgttgcctcgaggcaccatgggcactggccacttgctccgagggcagggacctggggggggtggaggtggccccattacttgtttctgcttctgtgaacagtgatacgctacctggaagcatggaccatctagcctttggcgttggccctggccaagagtaaaaggggcccagagtgccgtaaagctgcccctaatacagaggcttctgcgatgcttccatggatgaaccaggggctttgaggcaggtgtgct

SEQ ID NO: 66146 - DNA, 601 bp, Human
gaacagcccgggcagggcgcaggcggaacgtggatgctagccccgagggactgcactccgccaggatttcgctcttaagaccgataaacccttcaagtcggtggggatagaaagctcctgggctaaatttgtaagaggtgtaggggggcggggacaggggataaaagaagaaaaggcccaggttttctcttccagattgtgtttctcaaaacgcaggcccctgacggcctcggctgggaatggcagcgaggggcgaggtccaggtgtgggcggggtttctctccaacttgaagaccctacctgctgcctccccaccccaagctcggctccagaaaccaggagcgtgggggtgggggggagagaaaggagcacagcgaggaagggaggcgggcacgctggacctctaggccccagggaccttggcggtgtggtcccaaagctctgcctcctcccaccatgtcaatcctacactcagaactactgaccagtagctagaactcaaagaacgcatggacatgtttgcccacaggggttggagggaaagattagacacttactatcaagagaggggaaagtgaggtatggtagatgtcaaccttcc

SEQ ID NO: 66147 - DNA, 601 bp, Human
tgcgcccgtctttcatacctgcactccggacgcgcccttcgggtctgcactgacaatgacttgcttgcatcctttgtggacaccttatttccccgactccaagagtgaaagctggggcagtgcccttgcggggatccctcggaacagcccgggcagggcgcaggcggaacgtggatgctagccccgagggactgcactccgccaggatttcgctcttaagaccgataaacccttcaagtcggtggggatagaaagctcctgggctaaatttgtaagaggtgtaggggggcggggacagggrataaaagaagaaaaggcccaggttttctcttccagattgtgtttctcaaaacgcaggcccctgacggcctcggctgggaatggcagcgaggggcgaggtccaggtgtgggcggggtttctctccaacttgaagaccctacctgctgcctccccaccccaagctcggctccagaaaccaggagcgtgggggtgggggggagagaaaggagcacagcgaggaagggaggcgggcacgctggacctctaggccccagggaccttggcggtgtggtcccaaagctctgcctcctcccaccatgt

SEQ ID NO: 66148 - DNA, 601 bp, Human
gcttcaaggggtcctctggcctctggcctcagcctcccaaagtgctgggactacaggagcacatcagcatgcttggcctaattattattattttttttttgagacagagtctcactgtcgcccaggctggagtgcagtggtgcggtctcggctcactgcaacctcgacctcccaggttcaagcgattctcccacctcggcctcccaagtagctgggattacaggcacgtaccaccacacccagctaatttttgtatttttagttagagatggggtttcaccatattggccaggctggtctygaactcctgacaagtgatccacccatcttggcctcccaaagtgctgggattccaggcacgacccaccatgcccggccgggaattctttaagggtgatgaatcatcacatgcacagccgtgagaaaaactccctggcacctgagtgagagccgcagacaagccggccagggcagtggccacagcctccaacgcatcccgttcactagtgcaaaacagctgtaacgtggagcttttctggacagcaccctttctagtgtctttactttctatttttacataatgtttaagtttcctgtatgt

SEQ ID NO: 66149 - DNA, 601 bp, Human
acacacaaacaatgcccggctcttttatatgtatgtgtgtgtgtgtgtatatatatatgtacatatatatacacacacacacatatatatatatacacacacacacatatatatacacacacacacaggtgtctacctggcctgtgtctccagggtcttgggagcatctctggggcctactcccctcagtgcaggttcagcattcccagtcctgacagctgcagccagcagtgcccacccccacccagacatttataaccaggacaagccctcagttaagcagatggggggctcactcaarggggaacctgtctatgaatgcagggttcaaccccagctgcaaacgatagcgggggtgggggggtacagtgtaccaggcagtgtatctgtctaggaacgcgggggccacagggtatcaggcagtgcatctaaggcctgcactttcctgtctgtgaaatggggacggtaacgacctcacagcttcctacaaggttttctgaagcgacatcctgtgccaaatcatctgcggcaagtgtgcaacagacggtaggtgccacctaagaaagtgacacagcctgtgctggcgagggcttggagagaa

SEQ ID NO: 66150 - DNA, 601 bp, Human
accgctgacacagcagcgccttccactgctggagcctgaaaggctgctccccgaggccattccggttcagtcaggatcctagtggcagtgacaggtactgctttagcattcactttttccagacaccctgtctactctcattcagtttcatgtgattactgaccaggcagggattgccaagtgagatgatggccaccctaagttcaggtggagagaatggggtttcttctttaaaaacccttctctcacaagaatttgcttctcaaattggagctgcagccaattttttttttttttttttggagacagggtctctgtcgcccaggctggagggcaatggagcgactgatcacggctcactgcagcctcaatctccctgggctcaggttatccttctacctcagcctcctgagtaactgggactacaagcatgcactacaatgcccagctattgtgtgtgtgtgtatatccacaatatatatatactatatatatccactacatatacccgctatatatatatccacaatatatatacacactatatatatatccacaatatatatacactatatatgtccaaaatatatatacactatat

SEQ ID NO: 66151 - DNA, 601 bp, Human
cgggttcaagtaacagacagattctcaatgtccacacatctcatcggatagcataaaacaaacattttttttcctgttgcccaggatggagtgcagtggtgcaatcaaggatcactgcagcctcagcacctcccccacccacaccaccgccaggctcaaagcggtcttcccacctcaccctccccagtagctgggactacaggtgcatgccaccatgcccaggtaatttttgcatttttttttgtagagacagggtcttactatgttgcccaagctggtctcaaactcctgggatcaagtkatctacccacctccgccttccaaagtgctgggattacaagtgtgagtcacctcacctggccgataatgtcgggtccaatctccaagaagactttaattactagaaagccatcaggtttacaatggcagatacaagttttctaaaattccaattttcaccccaaagctcaaattttatccttagcaacaaatactgttcgttttttctttgagacatcactcgttttggacaaaacgcctgccacatgctgagtctgaaaactgtcctccgtctgttgttctgtcagggacagacagcgtt

SEQ ID NO: 66152 - DNA, 601 bp, Human
tcacaacactcaaaggttccaggtgccgagtttctagctaggtccttgccccaaagccgacacttccaaactgagccccagctctcacctcttcctcagcctcaagaccaactgccttccctctgtggtctccctggcaacctcagaacaaagggacaaacattccaactcccctccttttaaagggacagtgacaactgggcatagtgtttcgcatctgtgatcccagctgcttgggaggactgcttgagcccaggagttcaacaccagcccaggcaacgtgtcaccatgtagacacccygtctctacaaaaaataaaaataagacaggcattccctctgataagccaaacggcatcgtcatagtcaccatctcttcaatgtggtaaaactatcatcctcaaaacaattacttcaagaattcagaaacgactgctcagaaaacactggaaataaacttttatattttgcaacactgagcatttaatttattttactttactttttaaagagttggcatcttgctttgttgcccaggctggagtgcagtggcccaatcatggctcactacagtctcaaactccggggctcaagtgatcctc

SEQ ID NO: 66153 - DNA, 601 bp, Human
gagtaaggacgtgagcaaggacgcgagcagctcggaggtggcacgagctccccagcacctccgcaggcagatgggctgctctgaccacaagcacagtgaacaagacgctgtgccagtttgggtgtggcctgcaaagggacccaagtctgttctggacttttgcaagtatgggctggccaccaccatgctgaaaagaggatatgaagaagctgagtcccgactttcagctccccaaccaggggctggggccaggaaggatgctatcactatctgggaccctccataccagccctgctgccamgtgaatgaccctcacgggcacaatgtgagagaactgcctaactcctgacccaacagattgtgtggtatgaaataaaccttgttttagtctactgagctttggagatattgttagcagcaagacaactgggacacttagaaaacatggtcaaggcgatcactttaaggtatatttctttttttttttttttgagacggagtcttgctctgtccccaggctggagttagccactgtgccaggccagtatatttttttttctgtattatttttcactttcattctaatacattactaaagaat

SEQ ID NO: 66154 - DNA, 601 bp, Human
acattgccgccaaacacgcgcagcaggggccacctccctacaaacagtggagctctacataaagcaagtccttctgaccagtgtttcctaatgtgtgctatgtgagatgattcaagatgatttgtaaagataattttaatatagttaaacaactaacgtttagacaaaaatacagctaacaaatcaaatgtacaatttcatcatttaactgctcaggacaaggcttcacaagccagacagtagggacaaataggaaatattggacagtatagcagggtaaggatgtgagtaaggacgtgarcaaggacgcgagcagctcggaggtggcacgagctccccagcacctccgcaggcagatgggctgctctgaccacaagcacagtgaacaagacgctgtgccagtttgggtgtggcctgcaaagggacccaagtctgttctggacttttgcaagtatgggctggccaccaccatgctgaaaagaggatatgaagaagctgagtcccgactttcagctccccaaccaggggctggggccaggaaggatgctatcactatctgggaccctccataccagccctgctgccaagtgaatgaccctca

SEQ ID NO: 66155 - DNA, 601 bp, Human
gcgatagtggtccttcgaaaaccccatgttttcctgaactctttgctggtgggtttgatggccttaggtgcctcctcattgctcgggtcgcctttgtcgtccatacctagcggtaaagtgtaagcacatagtgaccaactgaccacagaacaaaaggtgacattgccgccaaacacgcgcagcaggggccacctccctacaaacagtggagctctacataaagcaagtccttctgaccagtgtttcctaatgtgtgctatgtgagatgattcaagatgatttgtaaagataattttaatayagttaaacaactaacgtttagacaaaaatacagctaacaaatcaaatgtacaatttcatcatttaactgctcaggacaaggcttcacaagccagacagtagggacaaataggaaatattggacagtatagcagggtaaggatgtgagtaaggacgtgagcaaggacgcgagcagctcggaggtggcacgagctccccagcacctccgcaggcagatgggctgctctgaccacaagcacagtgaacaagacgctgtgccagtttgggtgtggcctgcaaagggacccaagtctgttctgga

SEQ ID NO: 66156 - DNA, 601 bp, Human
ttccttcacagctgtggaagcagactgggggccgcttctggtctcagaagcgctttccacgctgccctcggaggctgtctcggcgtctgtggcggggcaggacgtgggctcaccagaatcctccagggagacaggcatgctcctcctgccgcggcgccgcgcaatggtcaggaactgctccacgcgctcagtgcgcttgggctgcctcccactgcgccgcagggacaggcccagctgctgctgtgggggtggcggctccagtgggtcagcctccgcgtcccctgcgccctctcgcttggcratagtggtccttcgaaaaccccatgttttcctgaactctttgctggtgggtttgatggccttaggtgcctcctcattgctcgggtcgcctttgtcgtccatacctagcggtaaagtgtaagcacatagtgaccaactgaccacagaacaaaaggtgacattgccgccaaacacgcgcagcaggggccacctccctacaaacagtggagctctacataaagcaagtccttctgaccagtgtttcctaatgtgtgctatgtgagatgattcaagatgatttgtaaagataattttaatatag

SEQ ID NO: 66157 - DNA, 601 bp, Human
gccaagatgacaggaggagtgcggcaatgaaccaaatgagccaaatgagaggaaaggcctgcgcgcgaggctgtgcccaacgccgagggttcaaaaggaccagccttaaaaattaagtcattcaaaggctaaataatcatttgaaaataatcaagaaaactccctgaacagtgctagttgcgctttgctggtcacaaacataaccggggcagtgacacagccaccgccgcctgagcctcacaagggccttcaagtctaagacaagagtttgcgatctctaaacattccaaataacacggagttctttccaaataacacggagtacaaacatgagacaactctgagagccgggtcttaaatgaagaccacagccttgccccgaacccgcctcccactcctacctgcctgcaagtctacgctctacaaactccaccgggtggttaccaactcttctcacaagacagcagggtgtgtcctgaagtcttatgccccccgtacactgccattgtcagcatttgctttactgcacttgtgttaattaacccctcagctaacgggcagagaagggaaaactggtgggaaggtggaagacaaaggtcaa

SEQ ID NO: 66158 - DNA, 601 bp, Human
ggctgccaagatgacaggaggagtgcggcaatgaaccaaatgagccaaatgagaggaaaggcctgcgcgcgaggctgtgcccaacgccgagggttcaaaaggaccagccttaaaaattaagtcattcaaaggctaaataatcatttgaaaataatcaagaaaactccctgaacagtgctagttgcgctttgctggtcacaaacataaccggggcagtgacacagccaccgccgcctgagcctcacaagggccttcaagtctaagacaagagtttgcgatctctaaacattccaaataacayggagttctttccaaataacacggagtacaaacatgagacaactctgagagccgggtcttaaatgaagaccacagccttgccccgaacccgcctcccactcctacctgcctgcaagtctacgctctacaaactccaccgggtggttaccaactcttctcacaagacagcagggtgtgtcctgaagtcttatgccccccgtacactgccattgtcagcatttgctttactgcacttgtgttaattaacccctcagctaacgggcagagaagggaaaactggtgggaaggtggaagacaaagg

SEQ ID NO: 66159 - DNA, 601 bp, Human
gccactggacaggctgccaagatgacaggaggagtgcggcaatgaaccaaatgagccaaatgagaggaaaggcctgcgcgcgaggctgtgcccaacgccgagggttcaaaaggaccagccttaaaaattaagtcattcaaaggctaaataatcatttgaaaataatcaagaaaactccctgaacagtgctagttgcgctttgctggtcacaaacataaccggggcagtgacacagccaccgccgcctgagcctcacaagggccttcaagtctaagacaagagtttgcgatctctaaacattccaaataacacggagttctttccaaataacacggagtacaaacatgagacaactctgagagccgggtcttaaatgaagaccacagccttgccccgaacccgcctcccactcctacctgcctgcaagtctacgctctacaaactccaccgggtggttaccaactcttctcacaagacagcagggtgtgtcctgaagtcttatgccccccgtacactgccattgtcagcatttgctttactgcacttgtgttaattaacccctcagctaacgggcagagaagggaaaactggtgggaaggtg

SEQ ID NO: 66160 - DNA, 601 bp, Human
ccttcgaagttcgaatgtgttcatgtgggtgtgtagcgtgtgaatcggacatggaaaaaaaaaaatcccctatctgcccagtcaaaaataaatgtacacctgaaaatcagatgcaacactaacttgcaaagattcccacaacataaaaaagaagtgatgctttcatgtgctggccgtggacaatgtggaaaaactgaagcgtatacagcgctgttgtcagaacaactcatgtgcagacaggggtggatgtggcgtgccgggcagtgtggctatgcaatcagactgggatgaagagaatacraatacttaccagagcctgagagtgaaaacagagattaaagaatcaatcattaaggtgaacgttcaccagtgaggtttacagctttggaaaacagtgacaggaagtcctgacagactagggatggacacagggcagcaggaggcatcctggacatgggctctgcttcccgctgatggtgcagccggtgtctgtgatcagcttaacacaaagctgcaactcccagtcctggacaggcccaggggatggctatccagaaagaacgggaggggtccaggaggccaacccctaggtgatacatac

SEQ ID NO: 66161 - DNA, 601 bp, Human; identical to SEQ ID NO: 32231

SEQ ID NO: 66162 - DNA, 601 bp, Human
aaagacaacagtttttgttttatttttcctcctgtagtgtccttcacctaagcatgtgatagcaccttggaaagaaagacttttattatttgacatttgcatctgggaaacctgaagcaggtggaaaatttaagtgaatttcccaatgtctgtcatattaactgtgcttagtaattccaatatgatgcactcaaatgtggaaatatgcagtcagattgcttattttatctatatgctggtctgatttatttttggcttttctttcatgcagctgaccaatttgacctactcttttgacatygtacacaggccacagtgtctgtaaaatctggcttctaaatctggatttctttgccctacttttacagcacaccttctaaaactgctgaatacccaaactcaggaacaaaatcatgtattctttttccaaatgagctgactagagtcatcccaccctgaactaaaatttttcttttccatttgcttttgtttttaaggtctagtctaacagtacttttgctgacctcatgctacctcctggtaaagattcctctccttttgttgctgttgtgctttcatattcccaggataaaatttcaac

SEQ ID NO: 66163 - DNA, 601 bp, Human
tctggatttctttgccctacttttacagcacaccttctaaaactgctgaatacccaaactcaggaacaaaatcatgtattctttttccaaatgagctgactagagtcatcccaccctgaactaaaatttttcttttccatttgcttttgtttttaaggtctagtctaacagtacttttgctgacctcatgctacctcctggtaaagattcctctccttttgttgctgttgtgctttcatattcccaggataaaatttcaactatgtgaaaaatagaatcacatgtttaaaggatcatcatmtatagcagcactatttccactaagttttttatagagaataaatttaatttaaatgtgagaaaaaagatccctgtagactttataagatataagatttgagcatatcatttgcaggggagatttcatcaacactattttattatttaaatcatctgtcaaggtaagagttgttatcctcattttctagctaatgaaactaagagcttagtaaggtgcaccctgtccatctgaaattttagcaaggtttggcagaagtttagcacattttatcagggttttgcttgctctccatggctctgg

SEQ ID NO: 66164 - DNA, 601 bp, Human
ctggatttctttgccctacttttacagcacaccttctaaaactgctgaatacccaaactcaggaacaaaatcatgtattctttttccaaatgagctgactagagtcatcccaccctgaactaaaatttttcttttccatttgcttttgtttttaaggtctagtctaacagtacttttgctgacctcatgctacctcctggtaaagattcctctccttttgttgctgttgtgctttcatattcccaggataaaatttcaactatgtgaaaaatagaatcacatgtttaaaggatcatcatatatagcagcactatttccactaagttttttatagagaataaatttaatttaaatgtgagaaaaaagatccctgtagactttataagatataagatttgagcatatcatttgcaggggagatttcatcaacactattttattatttaaatcatctgtcaaggtaagagttgttatcctcattttctagctaatgaaactaagagcttagtaaggtgcaccctgtccatctgaaattttagcaaggtttggcagaagtttagcacattttatcagggttttgcttgctctccatggctctgga

SEQ ID NO: 66165 - DNA, 601 bp, Human
tcaaatcttggttttaccacttattatgtgatactgggcaagtgtcttattgcactgtgtcttggttatataatctgtaaaataaataccataataaaaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagyaattgaatatataatctattacttgttataaacactaaaagatacaagttgcaattaaaatgtaaactgaggtgggagtagggcaaaggatcagagggcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgt

SEQ ID NO: 66166 - DNA, 601 bp, Human
tgtgtcttggttatataatctgtaaaataaataccataataaaaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaaktaaaatgtaaactgaggtgggagtagggcaaaggatcagagggcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttaca

SEQ ID NO: 66167 - DNA, 601 bp, Human
atataatctgtaaaataaataccataataaaaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaattaaaatgtaaaytgaggtgggagtagggcaaaggatcagagggcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttacagtatgatctatg

SEQ ID NO: 66168 - DNA, 601 bp, Human
aaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaattaaaatgtaaactgaggtgggagtagggcaaaggatcagagrgcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttacagtatgatctatgagaagccattgaaatgttctaaacagagga

SEQ ID NO: 66169 - DNA, 601 bp, Human
ttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaattaaaatgtaaactgaggtgggagtagggcaaaggatcagagggcttgggaaatcttctttatgggaacrtatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttacagtatgatctatgagaagccattgaaatgttctaaacagaggaagagtatgattaattagagtatagtct

SEQ ID NO: 66170 - DNA, 601 bp, Human
tctaatgtcttttccagatccaaaagtctgagttttaggaaatccatctcttgaaacccagtttggggtagttgagacagacattaatatatataaataaggagaagatttacataaatgaatgactttttttttcaaattaagacttttttaatggtcgtagttataacacaaatgcaattgatggtttatgaaattttctcagaaaaggaatcctaaaagaatctcaagatacagtaaagtttgacctttgaattgacttcagttcatacaaagtagatagataatagactttaagtcrttactctcatggcaacttgagaagtctactaataacttgagattattaaaaagtggtaaaacatttggaggtagaaaaatgcattgtgtgctagaatggtgataataaggagggtaagaataaatttatagttatgttagaagatatttttcttacacttagatacatttagtattcacatactttggaaatagaggaattaaagtgaattttaaaataatttattattggctgttttgtcacttcagaaatatttgtagatttttattatgcagctctttttcaagtcttgctttttat

SEQ ID NO: 66171 - DNA, 601 bp, Human
aatttattattggctgttttgtcacttcagaaatatttgtagatttttattatgcagctctttttcaagtcttgctttttatctacttgaaagagataaaacgtaaaaaacataaaaagatgataagtcttgaaagtagctttggaattgatatatctcctctgaattcctaggtgaggtagaaattacatattaaattaaagcttttaattaggatttgctgtgtgcaaatttgctgcttatttctagtatgcttgtctaaaatgtaatttttttccttttatgtttttcaaaaggagtwttaatgatattctaaattcagatatttctgatcctacatataaactgtctattaaaaatatggttccttaaataatactccatttatattctgatattttgatggataaaaatgattcgatagagaagaaagtgattttgttagttcataaaccagtgttcatattcatataacatatgtatgtattatactgtcatttccaggaaatatacttacttaatcattaataataataaatatcattttaaattcctaggcataggattaaagcatcaactgcaaacttttatgctagctgaa

SEQ ID NO: 66172 - DNA, 601 bp, Human
ggtagaaattacatattaaattaaagcttttaattaggatttgctgtgtgcaaatttgctgcttatttctagtatgcttgtctaaaatgtaatttttttccttttatgtttttcaaaaggagtattaatgatattctaaattcagatatttctgatcctacatataaactgtctattaaaaatatggttccttaaataatactccatttatattctgatattttgatggataaaaatgattcgatagagaagaaagtgattttgttagttcataaaccagtgttcatattcatataacatwtgtatgtattatactgtcatttccaggaaatatacttacttaatcattaataataataaatatcattttaaattcctaggcataggattaaagcatcaactgcaaacttttatgctagctgaaatttatatattagaatataaaataccagctatcttgtaatgttaactagttaaaatgaataagtggttaatagtagctgggatttctctagggggtagcacacactgattaatgagaacattatcatgtaatattcactgactatttacatatccttggatatatctactgatctta

SEQ ID NO: 66173 - DNA, 601 bp, Human
gattcgatagagaagaaagtgattttgttagttcataaaccagtgttcatattcatataacatatgtatgtattatactgtcatttccaggaaatatacttacttaatcattaataataataaatatcattttaaattcctaggcataggattaaagcatcaactgcaaacttttatgctagctgaaatttatatattagaatataaaataccagctatcttgtaatgttaactagttaaaatgaataagtggttaatagtagctgggatttctctagggggtagcacacactgattaatragaacattatcatgtaatattcactgactatttacatatccttggatatatctactgatcttatagaaaatactctttgcagtcctattaggtttttgaataatggctggcaccatggagcagttttgtgaccaacattcaaaaaagacagcaaaacagtcatgaagatcttatcgtctttctttacaaaaagtttctttagccattgttgcctattgtacattaaatatacacatttcatttttattttagatcttttgttatttttgctcatgaaccaaatattgccaatttgttatt

SEQ ID NO: 66174 - DNA, 601 bp, Human
tagaatataaaataccagctatcttgtaatgttaactagttaaaatgaataagtggttaatagtagctgggatttctctagggggtagcacacactgattaatgagaacattatcatgtaatattcactgactatttacatatccttggatatatctactgatcttatagaaaatactctttgcagtcctattaggtttttgaataatggctggcaccatggagcagttttgtgaccaacattcaaaaaagacagcaaaacagtcatgaagatcttatcgtctttctttacaaaaagtttmtttagccattgttgcctattgtacattaaatatacacatttcatttttattttagatcttttgttatttttgctcatgaaccaaatattgccaatttgttatttaactatgcccttagggtatattagaacatgaaatgcatatataaataaatcttggggaaatttttaattgtcattatgagcaaacagcatgttattacattaacagtcctggattatggcagccacccattattcaaatacattaggcatattctactacttttataattattgatggactttttaagaatattat

SEQ ID NO: 66175 - DNA, 601 bp, Human
atgagggagaatgcactgtcatggaaaatagtcatttgtgtattcagcaaacatttaagtagtcaagcatagtggctaaaagcatgcactctgaacctaaattgccaaagagccaagttcctctaccctcgaattgggtgacctgaggcaagttacttaatctacacatctgtttcattatctgtaaaatggatataataatagcacccacttcacagttttcttgagaagactcaatacatgaatacatgtaaaatgcttagaacagtacttgacatataataagaactcaactgttaartatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgaaatcccaccattgagctataatgttttaacataaagcaactagccacaatattta

SEQ ID NO: 66176 - DNA, 601 bp, Human
tgaatacatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcarctgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaat

SEQ ID NO: 66177 - DNA, 601 bp, Human
gaatacatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaamtgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatg

SEQ ID NO: 66178 - DNA, 601 bp, Human
tacatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgwaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctg

SEQ ID NO: 66179 - DNA, 601 bp, Human
acatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgatatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctga

SEQ ID NO: 66180 - DNA, 601 bp, Human
catgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgaattcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctgag

SEQ ID NO: 66181 - DNA, 601 bp, Human
catatttctgggaggaatacactgatgtgtatgtgtatgcatgttgattatagttgcctggcaaaagatttcaggcaactgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcacyggtcaggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaattcagctacttttatat

SEQ ID NO: 66182 - DNA, 601 bp, Human
gcatgttgattatagttgcctggcaaaagatttcaggcaactgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttawtgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaattcagctacttttatattatatttttttgaaaaaaatactgttgataatattaat

SEQ ID NO: 66183 - DNA, 601 bp, Human
aaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatrtttacctttgtatgacttttacttgagaaagtgtaattatttctacacagcctgttcttaagaatttgccatggataaattcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgt

SEQ ID NO: 66184 - DNA, 601 bp, Human
tttacggaccagcaccggtcaggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaatwcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgttttttcttcatttgaggtagtacatttcaactataaagtatgtaatagtctgtttttgccaaaaaaaactcacctttcaga

SEQ ID NO: 66185 - DNA, 601 bp, Human
aggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaattcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgttttttcttcatttgaggtagtacatttcaactataaagtatgtaatagtctgtttttgccaaaaaaaactcacctttcagagctataaaatatacagaatt

SEQ ID NO: 66186 - DNA, 601 bp, Human
acagaattgaaagctgacacctaatatatttttcattagatacagatgttcaatgtaaaattctttttacaagtattcatgaaaaacaggataactaaaaagatataatgtataaaaagtaaaaatcatactttttggtaaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaaygtagaaaatcttgcaaataatttgtaaagaaataattcaacaatttagagtaaagtttatcttctttatcttaaaatttaaacttatttgaataacattataattaagagaattatttctaatatttactttctgtaattttgtgaaataattttcttattagaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaa

SEQ ID NO: 66187 - DNA, 601 bp, Human
aatcatactttttggtaaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaacgtagaaaatcttgcaaataatttgtaaagaaataattcaacaatttagagtaaagtttatcttctttatcttaaaatttaaacttatttgaataacattataattaagagaattatttctaayatttactttctgtaattttgtgaaataattttcttattagaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctg

SEQ ID NO: 66188 - DNA, 601 bp, Human
taaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaacgtagaaaatcttgcaaataatttgtaaagaaataattcaacaatttagagtaaagtttatcttctttatcttaaaatttaaacttatttgaataacattataattaagagaattatttctaatatttactttctgtarttttgtgaaataattttcttattagaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttc

SEQ ID NO: 66189 - DNA, 601 bp, Human
agaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttctgctaaaaaaaaaaaaaaaaaggaaaaaaaaaaagagaaaatgcaggccaatatgatgaatacacaatacaaattctgttacactgggttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtt

SEQ ID NO: 66190 - DNA, 601 bp, Human
gcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttctgctaaaaaaaaaaaaaaaaaggaaaaaaaaaaagagaaaatgcaggccaatatgatgaatacacaatacaaattctgttacactggsttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagt

SEQ ID NO: 66191 - DNA, 601 bp, Human
aggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttctgctaaaaaaaaaaaaaaaaaggaaaaaaaaaaagagaaaatgcaggccaatatgatgaatacacaatacaaattctgttacactgggttttttgtattttgggcatgctactttcatttytgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacag

SEQ ID NO: 66192 - DNA, 601 bp, Human
ctttctgctaaaaaaaaaaaaaaaaaggaaaaaaaaaaagagaaaatgcaggccaatatgatgaatacacaatacaaattctgttacactgggttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccaccatacctggctaatttttgtatttttagtagaggcagggtttcacc

SEQ ID NO: 66193 - DNA, 601 bp, Human
acactgggttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgttkttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagcca

SEQ ID NO: 66194 - DNA, 601 bp, Human
gggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctggrattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttca

SEQ ID NO: 66195 - DNA, 601 bp, Human
atatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcrtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataat

SEQ ID NO: 66196 - DNA, 601 bp, Human
acttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccacmatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgtt

SEQ ID NO: 66197 - DNA, 601 bp, Human
gtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctccyaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactaggtgcctagtatgtgaataacattatgcttacctctg

SEQ ID NO: 66198 - DNA, 601 bp, Human
cgcctcccaggttcaagccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaaytttaaaataatttctttttttttttttgcttttgacttaactgtgtttcacaaaaataatattaatgttttctcaaagttttctagcagcttatttcttcatttgttcattcacatgctcactgagcacatttactaggtgcctagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaag

SEQ ID NO: 66199 - DNA, 601 bp, Human
agccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactaggtgcctagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagta

SEQ ID NO: 66200 - DNA, 601 bp, Human
actcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactrggtgcctagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagtatgacatacggaaaacagatcaatgtgtactggatgaatctccctctggaactctgattaaagatagaacttgtccaaggaggtagaaggtagggcattgaagttgggggccataccaggaac

SEQ ID NO: 66201 - DNA, 601 bp, Human
gatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactaggtgcytagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagtatgacatacggaaaacagatcaatgtgtactggatgaatctccctctggaactctgattaaagatagaacttgtccaaggaggtagaaggtagggcattgaagttgggggccataccaggaacaaaagc

SEQ ID NO: 66202 - DNA, 601 bp, Human
aataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagtatgacatacggaaaacagatcaatgtgtactggatgaatctccctctggaactctgattaaagatagaacttgtccaaggaggtagaaggtagggcattgaagttgggggccataccaggaacaaaagcatagcagcakaaatagaaaggtctgcaaggggaatctgtgaaggcagcctatagatagatcacggagtagggtgtagggatgttagatgggaaagatgggttagaggaatacagggagacctttggatattgggttaaagtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttg

SEQ ID NO: 66203 - DNA, 601 bp, Human
agtaagtgatattcatgagtatgacatacggaaaacagatcaatgtgtactggatgaatctccctctggaactctgattaaagatagaacttgtccaaggaggtagaaggtagggcattgaagttgggggccataccaggaacaaaagcatagcagcagaaatagaaaggtctgcaaggggaatctgtgaaggcagcctatagatagatcacggagtagggtgtagggatgttagatgggaaagatgggttagaggaatacagggagacctttggatattgggttaaagtgcttagttttyatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacacaaaaaattaaggcaggaaaatggaatcttctgaaacttgg

SEQ ID NO: 66204 - DNA, 601 bp, Human
cagggagacctttggatattgggttaaagtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacasaaaaaattaaggcaggaaaatggaatcttctgaaacttggattaataggaaacaaaaaaaggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaag

SEQ ID NO: 66205 - DNA, 601 bp, Human
agtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacacaaaaaattaaggcaggaaaatggaatmttctgaaacttggattaataggaaacaaaaaaaggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaagcaatccacctacctccggcttccaaaa

SEQ ID NO: 66206 - DNA, 601 bp, Human
aggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaagcaatccacctacctccggcttccaaaattctgggattacaggcctgagctactgtgcccmgcctacctgtattattttaatcaggaaaaccatttcaatagaatctagagatatggttttatacattggccatgttattcaagttcccaatggtggtttttaaaaaatacatacatggttctattttaaattaaagaaaattgatctggctgggtgcaccctagattacatgactgtaatcccagtacttttggaggccgaggctggaggattgcttgagcccaaggagctcaaaactgcagtgagctatgatcctgccactgcactccagattgcgtgacagagtacaatcctgtagag

SEQ ID NO: 66207 - DNA, 601 bp, Human
taactcacgagctcaagcaatccacctacctccggcttccaaaattctgggattacaggcctgagctactgtgccccgcctacctgtattattttaatcaggaaaaccatttcaatagaatctagagatatggttttatacattggccatgttattcaagttcccaatggtggtttttaaaaaatacatacatggttctattttaaattaaagaaaattgatctggctgggtgcaccctagattacatgactgtaatcccagtacttttggaggccgaggctggaggattgcttgagcccwaggagctcaaaactgcagtgagctatgatcctgccactgcactccagattgcgtgacagagtacaatcctgtagagagagagagagagcgagagacctacggcgttcttgtagtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttggttagttttcattccccttgattactaaatgatg

SEQ ID NO: 66208 - DNA, 601 bp, Human
ttggaggccgaggctggaggattgcttgagcccaaggagctcaaaactgcagtgagctatgatcctgccactgcactccagattgcgtgacagagtacaatcctgtagagagagagagagagcgagagacctacggcgttcttgtagtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttgrttagttttcattccccttgattactaaatgatggaactctttcacccaggatatcattttgccaccttttatttgaaataaaactgttatgcagttagcactatgttatgaaaatattaaatgttgagattcttgcaaccaaaggaagatagaaaattccaaagaaatgactatttctggtaagctcctatcccagttatgtaactcagctagaatagcaattttagtgataaaactgtgtcaaatattttatttagtgtgaatctgacatttgattttccttttataatgcttcttttt

SEQ ID NO: 66209 - DNA, 601 bp, Human
agtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttggttagttttcattccccttgattactaaatgatggaactctttcacccaggatatcattttgccaccttttatttgaaataaaactgttatgcagttagcactatgttatgaaaatattaaatgttgagattcttgcaaccaaagraagatagaaaattccaaagaaatgactatttctggtaagctcctatcccagttatgtaactcagctagaatagcaattttagtgataaaactgtgtcaaatattttatttagtgtgaatctgacatttgattttccttttataatgcttctttttgttatttcagggaaggagattacagcagaaacttttatggagaagttggacaatggtgccttgctctgtcaacttgcagaaactatgcaggagaaattcaaggagagcatggatgctaacaagcccacaaaggtaaaagatccca

SEQ ID NO: 66210 - DNA, 601 bp, Human
gtgggtcaaagtaattgaatgggccactggggatgagaatggaatgattaatggaggccaaattgtgaaatcactggtaaagctggttctttgagttttgttggttagttttcattccccttgattactaaatgatggaactctttcacccaggatatcattttgccaccttttatttgaaataaaactgttatgcagttagcactatgttatgaaaatattaaatgttgagattcttgcaaccaaaggaagatagaaaattccaaagaaatgactatttctggtaagctcctatcccagytatgtaactcagctagaatagcaattttagtgataaaactgtgtcaaatattttatttagtgtgaatctgacatttgattttccttttataatgcttctttttgttatttcagggaaggagattacagcagaaacttttatggagaagttggacaatggtgccttgctctgtcaacttgcagaaactatgcaggagaaattcaaggagagcatggatgctaacaagcccacaaaggtaaaagatcccaatgcaaaaatcactcttaggtggtagattacatttataattgcttataaatt

SEQ ID NO: 66211 - DNA, 601 bp, Human
gcaactctgacagaaaaaataaaaggggtgtatgtgtgtattaccactgaatttattttttaaatattttatattactccgtaaagtattgtataatatacaaaacctccctctatttttttatttcttaaaagcagctctgtgaaggtattaattaattcagtggctcccaaactttgctgcacattggaattacctgagcatcttttaaaaaaatgctgagagctgggctggatgtggtggctcgtgactgtaatctcagcactttgcgggggtcaaggcaggcagattgcttgagctygggagtcgagatcaacctgggcaacatgacaaagcaccatctgtaagaaaaacacaaaaaagttagcagggaatggtggtgtgttcctgtagccccaggtatttgggaaactgaggcggcaggttcaattgagcccaggaggttgaggttgcagtgagccaagatcacaacactgcactccagcctagaagacggaatgagaccatttctcaaaagtaataataaaataaaataatactgagacctcgatcccatgcctgaacattctgatttaatcccatagggtgaaacctgggtact

SEQ ID NO: 66212 - DNA, 601 bp, Human
ttggtaaccattaatttcttttaattttctccttaattggatggttgaagactgtaagtaatttgtacaagattggctagtaagtgaccaagcaagaatttgacacagacaactttgcaagtttaatgctctctcatttttgttcattatgtcattatgggtagcccaggtgtgaggagactgtttatgaaaatgctttgtgtcaagcttaatgttaggacaccaatttttcttctgctctcatttccgtcgtgatgtaactggcctctacatcagctactgatgaaaaaatataatgccrataagaggacaacttgtatagaaggtttacagtaaagcaatgaacagagggaaataagctgtggtgcccagactcttgaaagcattaccttcacattacgaagttcctgaaacttgtattgcttattgttgaggatggagagccgaatgcctcagtgtaaagaatccttgaatcctccagagtagtaaagattaaccaactctattaaggctgttgtgcagttctggttttgctttgtttataagcctttgcttttttaaaacagaagcaaagattcccaaatagatttgtaattgtaag

SEQ ID NO: 66213 - DNA, 601 bp, Human
ttgcttttttaaaacagaagcaaagattcccaaatagatttgtaattgtaagactcaatgtaagataaccctaaagcattagcctataggtcaaaggctttgacattaagtgcattttgcttgggttctagttttatttattaattggacgtgtctgagccgtactttccttatctgtgaaataggattaataattacatatgtatagcttccatagagcattgcacaaaatagggctcttgataaaatctctttttgataaaatctcttttccttacgtgaaagataagagacccttgtwagtattttcgattaactataagaaaataaatactttatagtctacggccataccaccctgaacatgcccagtctcgtctgatctcggaagctaagcggggtcgggcctggttaggacttggaagggagaaaataaatgctttataaatgtttgtatttagcatgagagctgctatgtgcaaatatgtatacatttgccccaatctccatgataatatggaatattgagaatatttattgatcaaaagttatgtaagtactttccttttaaacagccatttcaatattataatttttataa

SEQ ID NO: 66214 - DNA, 601 bp, Human
gagaatatttattgatcaaaagttatgtaagtactttccttttaaacagccatttcaatattataatttttataataaaactataaaacaaaaagaaaagaatttttttcagttagtaaaactgcagcaagttattaaacttgaaatagttccgtgaacctgagcaaatttttaactgaatataaagctaaatttttttctgattgtgataaaggttttagtataaaaccttaaatgtgttacttgaacaagtggaggtttaaaaatacttattatcatctcaccaaaaagtcacatgcamctgtatgttcatagcagcactattcactactgcaaagacatgaaatcaacctagatactcatcaacggtggactggctaagaaaatatggtccctatataccatggaataccttgcagccataagaaaccaaaatcatgtcctttgcagaaacatgggggcagctgaaggccattatcttaagcaagttaatgcaggaacagaaccaaatggtctcacatataagtgggagctaaacactgagtacacatggacacaaacaggagaacaaaagacactggggcctacttgagcaggaagg

SEQ ID NO: 66215 - DNA, 601 bp, Human
gacacagttgctcttgactgaattgccttctctgttcttggcagcatttatatattcacgactgactgccagtaatatgcagcttaaatcaataataacttgtgccttactgtatgaaaagtgcaaagatgactacattttattttttgccttttatagtaaaattttaaaagatgaaaggccagagggttagtatgtatatcttcatggctactattgttcataaatatacttctgttaaactcaagatttttcagtccattgttggtctagaaacaaaaaagacttatgagattgtaarcatgttgatgttgttaaatctaaatacaagtttaaacaataatggattcactacaacccaggtaattaggattacagtgaatatttcccatgggaaaaaatgaggctttcaaattgagtataaatagtctggaggttacaatattaagtctgattttacacgtgtgtacactcatgtgttcatgtatgtgtttgtagagaactatttctcattttggcattttggagttcagaaaaaatggtggcgaaaatggatgaattagtcaatacattctttgaattaatgaaactgtgcataggg

SEQ ID NO: 66216 - DNA, 601 bp, Human
tctgttcttggcagcatttatatattcacgactgactgccagtaatatgcagcttaaatcaataataacttgtgccttactgtatgaaaagtgcaaagatgactacattttattttttgccttttatagtaaaattttaaaagatgaaaggccagagggttagtatgtatatcttcatggctactattgttcataaatatacttctgttaaactcaagatttttcagtccattgttggtctagaaacaaaaaagacttatgagattgtaagcatgttgatgttgttaaatctaaatacaartttaaacaataatggattcactacaacccaggtaattaggattacagtgaatatttcccatgggaaaaaatgaggctttcaaattgagtataaatagtctggaggttacaatattaagtctgattttacacgtgtgtacactcatgtgttcatgtatgtgtttgtagagaactatttctcattttggcattttggagttcagaaaaaatggtggcgaaaatggatgaattagtcaatacattctttgaattaatgaaactgtgcatagggagatgttgaaacagaattacttttaaaaaa

SEQ ID NO: 66217 - DNA, 601 bp, Human
tgtgtaaacaaatttgaacgagtaagttatgcctggtatgtgtgaagtatgtctgtattaaggatgatttaaatgctcttaaatctttaataaatgttagttcgcatatttaatattttagatatttagatatttctaaatttaatatttagatataaatccatgactcttttatatccagctttggtttgataaaatactctgaatggaaataattctgtcctatgattctttcttcccagacatcaataggtcaatttaaaaatagcttctttacgtgtgtgagctctaagtagttaaycttagcctttgtgtagtgggccattttctaactctgcatgggagcaatgcagagacttcacagactagggcagtagatgggtggaagcatttgagaccagtgtgcagccatttaatgtgtaattttatttaattcatttatacatactataatattatgaattcactgtaattacaaatcttaatatttctggagttgaggatgtttaaaggcaaaaatataaatgaaatgaatctttcaatattgttttaggatgagaaaaccaaaccaaatgacaggtttaaggttaggttttatgtc

SEQ ID NO: 66218 - DNA, 601 bp, Human
tatttaattcatttatacatactataatattatgaattcactgtaattacaaatcttaatatttctggagttgaggatgtttaaaggcaaaaatataaatgaaatgaatctttcaatattgttttaggatgagaaaaccaaaccaaatgacaggtttaaggttaggttttatgtcttttgactctcagctacccgatcggaattggcatctctaatcaagacaggggaattgttacatttatgcgtgaactttcttttcccggtccaaatagtgttccacagtacaaaccccttcctattrtatatttgctctctttcccccacccccaccaatcacaagtttgctgatttgtgcaaaagactctctcaaccacggggcatcagcgtggggcaagacattcaaaaggtttaacctctctttttctactaactttcctttgcatttgtctcatttattttgagtctcttcttcagacatcagagtttctctgggtttagagcttcctctgacttcaaagagccctgggtggttagatcaagtttgaagcagatgaaggagggggcggggggaaaagaagttctgttacctagtagaatgctg

SEQ ID NO: 66219 - DNA, 601 bp, Human
tctcatcaagatttaattctgagaaatccagatatttgtgtttattgctgatctctctgccagaacaagaaagtatggtagatgcaataaaaggttttgtatgaaaaagaaaataaaatctcagctgtgattaatctggagtcattcattgctggctatacagctaaatgattttatatcccttaaaatttattgttctaaattgcaaacataatgctagaattaaacagagaatatattatgatgagatgggaagaatataagtggcatgatgtagaaagaaataatttttttataggtrtgttgctgcctgagactaaaggaaaaagaaaagttagtggtaaagtccacttcctcaggatttgtaaaatataggtaaaatatatttaagctttaaatacactaatttttttatttactttgtaattgcttcctgaggttgaattatttctcagtataaaattaaatccccctgtcactattttttaagtctctgaccaaatagccaaattattcacctccaaatcagagacaatgaaatgtcttgcttaatgttttttgtttttttttccactgagagtttctgttctatactatcttc

SEQ ID NO: 66220 - DNA, 601 bp, Human
aattaaatccccctgtcactattttttaagtctctgaccaaatagccaaattattcacctccaaatcagagacaatgaaatgtcttgcttaatgttttttgtttttttttccactgagagtttctgttctatactatcttccagagatatgcctaaatcgggcttcaatgccatagcaatacatgttggtaaatcatatagaataaaaagaatggtatgtaaaggagcttgacttttatttttcaaataaaactcatcacaggagacttgatatgggctacatttgcagatgggggtgggsgagcggaaagcagcaatgtgaaaaattgggcaagatagggagtgagtgatgtgcctatggaacttatctagatcttcatgtctaattgagcccatcccatacatggcacttgtacttgtaaacccagaaaatcggagacaagtctcagttaatttagaaagtttattttgccaagactgaggacgtgcgcccatgatacagcctcaggcagtcctgatgacatgtgcccaaggtggtaggggcacagcttagttttatacattttatggagacatgagacatccatcaatatatgtaaga

SEQ ID NO: 66221 - DNA, 601 bp, Human
aaaaaatctaactgtcacctgattcctcacaaagcatttcccttttctgaatgcatagtaaacagatcaggtccctttggagattggaaggaagctttatataaagacttgagatcattactgccttcattcagtgagctctgggtctataatttggctctagtctgggaattgggcaatcagaaaatttgttgctctttttgttatacaaagaaacccaaatactgcatgttctcacttataagtggtatctaaatgatgagaacccatggacacatacaggggaacaacacacactggkgtctttcagagggtagcgggaaggaggagggagaggatcaggaaaaataactaatgggtactaggcttaatacctgggtgattaaataatctgcacaacaaaccctctgacacaagtttacctatataacaaacctgcacttgtacccctgaacttaaaataaaagttaaaaaaataagaatttagggaattgactttcaatttacttcccaaggccccatgattaataaaccataatcagatttcctgtgctttaggtcattctaggagatctgattggcctctccagattgtattctg

SEQ ID NO: 66222 - DNA, 601 bp, Human
aaaatgaggaagctcatttcaataacagctcctgagactttctgaagaataatgtcaccttaaaaatttttggagctttcttcatcaacttattcttcaccctttagtgaaaaatagagccacttgggtcccactgagtgacatagtgaaaagtatgcttatgtgaggaattaattacaggtcgaatagaatgtggaattttttcttgaagttctaattcctttatctatatcataccaagtgattcctggctttttgtgccatttagtgtgagctattgttgaatatatctttgtgttarcaaatctagcaaactttaatagggtcattttatgctagcccattgaatttgggacatcttattagtccagtacaagtaaattaattttgctgaatctaaaattacatcctgctctcctcagactaataccctcaaaatctattgcaaagacagcaacaaacaaacaaacaaaaaacttctgccataatatatttagtggcactcaacattttaaatgtatattgaggctttgtaactagttagccaggaattcctgagccttactatgggatgtatctaaattcatcctcagccaggctg

SEQ ID NO: 66223 - DNA, 601 bp, Human
aagtaaattaattttgctgaatctaaaattacatcctgctctcctcagactaataccctcaaaatctattgcaaagacagcaacaaacaaacaaacaaaaaacttctgccataatatatttagtggcactcaacattttaaatgtatattgaggctttgtaactagttagccaggaattcctgagccttactatgggatgtatctaaattcatcctcagccaggctgcagtattttgacgcctggtagaggttgtcagcaatggcttaaaaaagtgtgggttcggctgggtgcggtggctyacccctgtattcccaatactttgggaggctgaggcgggtggatcacttgaggtcaggagtttgagaccagcctggccaacatggtaaaacgctgtctctaccaaaaataaaaaaaattagctgggtgtggtggcatgcacctgtaatcccagcacttgggaggctgaggcaggagaatcacttgaacctgggaggcggaggttgcagttagccaagatcacgccactgcactccagcctgggtgacagagtgagactccttctcaaaaagaaaaaaaaaagactctttattctgtggcta

SEQ ID NO: 66224 - DNA, 601 bp, Human
aagtgtgggttcggctgggtgcggtggcttacccctgtattcccaatactttgggaggctgaggcgggtggatcacttgaggtcaggagtttgagaccagcctggccaacatggtaaaacgctgtctctaccaaaaataaaaaaaattagctgggtgtggtggcatgcacctgtaatcccagcacttgggaggctgaggcaggagaatcacttgaacctgggaggcggaggttgcagttagccaagatcacgccactgcactccagcctgggtgacagagtgagactccttctcaaaaagaaaaaaaaaagactctttattctgtggctagctgagatttaaggacagagccattgtttcagaactgtccaaattaattgatatacttttcttaacctggtccaggagcataccgggtgtagaggaatccaccatgtaccctccctgtttcctgggagggtatgcttgctattttcttacccaacctgctcattcttttcatgtctctgcctctcttcccaagataagaatgttaatcccttctcatctgagaccaggatctggcaaggggacaggattttagcaaaggacaggagccaat

SEQ ID NO: 66225 - DNA, 601 bp, Human
cacgccactgcactccagcctgggtgacagagtgagactccttctcaaaaagaaaaaaaaaagactctttattctgtggctagctgagatttaaggacagagccattgtttcagaactgtccaaattaattgatatacttttcttaacctggtccaggagcataccgggtgtagaggaatccaccatgtaccctccctgtttcctgggagggtatgcttgctattttcttacccaacctgctcattcttttcatgtctctgcctctcttcccaagataagaatgttaatcccttctcatcygagaccaggatctggcaaggggacaggattttagcaaaggacaggagccaatagcaaatgcaagtcatattattctgtaaattccatatatcacagctattcagtggaaaattcttccatattcaacagctcacaaatgaaagaaagttggtagatttctctaaatttgacaacagaatatttgtcaaacaaatttgaaataaagaaaaaatttcaaaatttgtaatattcaccaataatgagctgtgaggttgaaagtgattttcctgaattattagaaattgtgtcctgattaatcat

SEQ ID NO: 66226 - DNA, 601 bp, Human
tgagagagggcatcccctgtcttgtgccagttttcaaagggaatgcttccagtttttgcccattcagtatgatattggctatggagctgggtttttgaaaggatcagcaaaattgatagaccgctagcaagactaataaagaagaaaagagagaagaatcaaatagatgcaataaaaaatgataaaggggatatcaccacccatcccacagaaatacaaactaccatcagagaatactacaaacacctctatgcaaataaactagaaaatcttgaagaaatggataaattcctcaacacartcaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttga

SEQ ID NO: 66227 - DNA, 601 bp, Human
caaataaactagaaaatcttgaagaaatggataaattcctcaacacagtcaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagcsgggcagagacacaaccaaaaaagagaattttagaccaatatccttgatgaatattgatgcaaaaatcctcaataaaatactggcaaaccgaatccagcagcacatccaaaagcttatccaccatgatcaagtgggcttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagtta

SEQ ID NO: 66228 - DNA, 601 bp, Human
cctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttgatgaayattgatgcaaaaatcctcaataaaatactggcaaaccgaatccagcagcacatccaaaagcttatccaccatgatcaagtgggcttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagttaattaataagaaatattatgttgtttttctgtgctttgtgatggttctagtgt

SEQ ID NO: 66229 - DNA, 601 bp, Human
tctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttgatgaatattgatgcaaaaatcctcaataaaatactggcaaaccgaatccagcagcacatcmaaaagcttatccaccatgatcaagtgggcttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagttaattaataagaaatattatgttgtttttctgtgctttgtgatggttctagtgtttaccatcttttaaaagttattaatttcttgtgctttattttattaggctaaaat

SEQ ID NO: 66230 - DNA, 601 bp, Human
accaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttgatgaatattgatgcaaaaatcctcaataaaatactggcaaaccgaatccagcagcacatccaaaagcttatccaccatgatcaagtgggyttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagttaattaataagaaatattatgttgtttttctgtgctttgtgatggttctagtgtttaccatcttttaaaagttattaatttcttgtgctttattttattaggctaaaatgtttaattccatatcttattttgtgttta

SEQ ID NO: 66231 - DNA, 601 bp, Human
gcattcagggaagagaaatgccttgtggggaatcaggtgacaggtagattttttaaatctgaaattattggaaaagatgaatttactgccaaaagaatgtattggaaagatatgggggtactgcttagagaaaaaagacatgtgaaggaaagtgaaactggatttggagggcttaagaattagactatttgcaaggattatgcagcatagatacacagtcatttcacagtaccactgttagggtgaataatttcagacatttttagagagggcagctgaacagaaatggttaatagtgtawactcagtagtcatactacctgggttgaaatcataactcctcctctgtgcgttagttttctcatttgtaaaatgtagtaataattgtagctacctcatttggttattatggggactaagtaagttagtatacacaagcactgagtggtacctagtacatatgggtgctcattaacatttagctgttaactttattgtatcattcctctcaagattaacatttcagcaagaaagagcctgatggacagccaactttctgactagatcatggcttcataccttgattgctcagtctgaataaa

SEQ ID NO: 66232 - DNA, 601 bp, Human
catactacctgggttgaaatcataactcctcctctgtgcgttagttttctcatttgtaaaatgtagtaataattgtagctacctcatttggttattatggggactaagtaagttagtatacacaagcactgagtggtacctagtacatatgggtgctcattaacatttagctgttaactttattgtatcattcctctcaagattaacatttcagcaagaaagagcctgatggacagccaactttctgactagatcatggcttcataccttgattgctcagtctgaataaaatgaaagaacyatagtgtccctatggaaaattaatatgctcttacctaagaagggaaaaggatactggaagtgtagagatgcccttgcagtctctacactctgtatctgtagatctggcctctttcttacggtttgtccatctgcatgttaacccctctttcttgtaccatactgttgtacttagttgtttcctagtctttatccctttgctagactctaagatccttgagtacatagtttatgttctattcatctgtgagtctaacataatacctagcatatagatgctcagtagacatggtgttggatg

SEQ ID NO: 66233 - DNA, 601 bp, Human
tagctgttaactttattgtatcattcctctcaagattaacatttcagcaagaaagagcctgatggacagccaactttctgactagatcatggcttcataccttgattgctcagtctgaataaaatgaaagaaccatagtgtccctatggaaaattaatatgctcttacctaagaagggaaaaggatactggaagtgtagagatgcccttgcagtctctacactctgtatctgtagatctggcctctttcttacggtttgtccatctgcatgttaacccctctttcttgtaccatactgttktacttagttgtttcctagtctttatccctttgctagactctaagatccttgagtacatagtttatgttctattcatctgtgagtctaacataatacctagcatatagatgctcagtagacatggtgttggatgaatgaataaataaatgccccaagatggatatttacctttagatccagaatactgttatccgtgggttttagccatctttgctttttaatcctgaagactttattctcattaagtttgaaattcccccctctgcctgtttgcttagctcaaaagcctttgatgtgaca

SEQ ID NO: 66234 - DNA, 601 bp, Human
atacctagcatatagatgctcagtagacatggtgttggatgaatgaataaataaatgccccaagatggatatttacctttagatccagaatactgttatccgtgggttttagccatctttgctttttaatcctgaagactttattctcattaagtttgaaattcccccctctgcctgtttgcttagctcaaaagcctttgatgtgacaaagcatgaggagcaaatctgacttttccagtcgtaaagacggaagatttgagaattttagaatggtctagggaaacaataaggatctgaggaygttaaaagcactgacaagagattggctgaagtaacagaccatggggatttaaactagttaagaaaaagtggatcttggaggaggataatcatttagttaattgtaaatgttattatatagtgacatgatgtattatttgagttcagagcattatataaaggtaaaaattatgataaaaatgagcatatttatatccaatggttcattcagtttgaggatttcttttcaaggcctgattatactgcttgcagtataaaataagcatcagatgagcgatagctaatggtttcatgaatttgc

SEQ ID NO: 66235 - DNA, 601 bp, Human
gataaataaaagaagactaaagcattattgggtcctccccaagaacttgcagtctagttaggtacataaaatatgaacatataataatatagatatcaatggaagtgctaaataagtgatacccaccagtggttctcaactttcgtttaaccataacatacattacaatgaaaacattcaattgattattcaacacatgtatactgaacacctaacatatacagggcaaaatattggatgctcacatgcttcatgcctttgtggattagcaagggataataacattaagctggtaattaawaagtatgcaaacagtgaatttcaactgctgtgtataaatacaagaaagtgtacatacatgacctcctttaagaggaggacctaaattagtcatgtacaaaggatattttagattattctgaagcagaatgggaataagcaaggcagagagggaatatagagtgtgccaaatacagtaaattgcacacgtgaaagccctcagatgtaaaggtgcatgatgactttgaggaagtaaaggaaagcaagtatgtctggagactagcacataactcaagagaatcaagagatgagaccaaagcta

SEQ ID NO: 66236 - DNA, 601 bp, Human
aagcattattgggtcctccccaagaacttgcagtctagttaggtacataaaatatgaacatataataatatagatatcaatggaagtgctaaataagtgatacccaccagtggttctcaactttcgtttaaccataacatacattacaatgaaaacattcaattgattattcaacacatgtatactgaacacctaacatatacagggcaaaatattggatgctcacatgcttcatgcctttgtggattagcaagggataataacattaagctggtaattaaaaagtatgcaaacagtgaawttcaactgctgtgtataaatacaagaaagtgtacatacatgacctcctttaagaggaggacctaaattagtcatgtacaaaggatattttagattattctgaagcagaatgggaataagcaaggcagagagggaatatagagtgtgccaaatacagtaaattgcacacgtgaaagccctcagatgtaaaggtgcatgatgactttgaggaagtaaaggaaagcaagtatgtctggagactagcacataactcaagagaatcaagagatgagaccaaagctaagtcttgttggatgctggc

SEQ ID NO: 66237 - DNA, 601 bp, Human
taagcaaggcagagagggaatatagagtgtgccaaatacagtaaattgcacacgtgaaagccctcagatgtaaaggtgcatgatgactttgaggaagtaaaggaaagcaagtatgtctggagactagcacataactcaagagaatcaagagatgagaccaaagctaagtcttgttggatgctggcatttatcttaagtataacaatatgccattgaactattaacattttaaacagaagcatgatagactcctttaaaatgacaacattagcagtgtagagaatggattggaaaggagaartgaaggtggaaataaccacccaagtcaggaggctattgcctagctcaggtgacagataatgaccacttatcctagggtagtggcagtggaatgggaaagaagtagacggtttttttttttcttttattattatactttaagttttagggtacatgtgcacattgtgcaggttagttacatatgtatacatgtgccacgctggtgcactgcacccactaactcgtcatctagcattaggtatatctcccaatgctatccctccccgctccccccaccccacaacagtccccggagtgtgat

SEQ ID NO: 66238 - DNA, 601 bp, Human
ttttttgtccttgcgatagtttactgagaatgatggtttccaatttcatccatgtccctacaaaggacatgaactcatcattttttatggctgcatagtattccatggtgcatatgtgccacattttcttaatccagtctatcactgttggacatttgggttggttccaagtctttgctattgtgaatagtgctgcaataaacatacgtgtgcatgtgtctttatagcagcatgatttataatcctttgggtatatacccagtaataggatggctgggtcaaatggtatttctagttctaratccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttctctgatggttttgagatatattgagaccaggtggacttggcagagcttggtgataaattgtatagaatgggtaagggagattggtctggagtttcctacttgaggacacagatggat

SEQ ID NO: 66239 - DNA, 601 bp, Human
cacacatgtgcattgtaccttcatgagtacctgagggttatgagccttgttggctccctgtcatgccacacctttcatttctgctcaaggaaacataaacaaatgagtaaggaagtgctttagagataaccttgaattttctttgacctagtccttaaaaaatatttcagttgtaagctgttaagatccatacttttaaaagtcacaaatgtttatagacttgactctcagctgatctagacataccattgtttagacagacctctgctgatatacttagtaggttcttgtaagggttcakgaaacagtttgtctaagtgctcggggaagtttgcatgtcagcagtggaatttaaattgtccaaacatggtgcaaaaaaatgtacagagaaattggtggcaaatgcaatataaatatgtggtgagtgaaccaaatattaatgctggaaaaatgcaagcatgtaccaggaatagtgaatagaaaaacatggttgatgtggatcatatatggagagaacgtttggcacatggactggtgaagctcacatctcataaccacaagacttaagtatttgaactttgttttgtaaacattgagctgg

SEQ ID NO: 66240 - DNA, 601 bp, Human
gtccaaacatggtgcaaaaaaatgtacagagaaattggtggcaaatgcaatataaatatgtggtgagtgaaccaaatattaatgctggaaaaatgcaagcatgtaccaggaatagtgaatagaaaaacatggttgatgtggatcatatatggagagaacgtttggcacatggactggtgaagctcacatctcataaccacaagacttaagtatttgaactttgttttgtaaacattgagctggagaatgagaacattaaatttaggaagattaatctgaggttgatgtgtatgcatattargttggagaaatttgagacaggaaacaggaagatcgttgggtaaagtttctacatttgtttagatctgagatgttaaagggtctgaggtgagtgtgtcaatattttattaaaaggttcagggtaattgaagagatattcattggaaaacaacaatgagctagattgatgatttactgggcacaaaaagaagggatgaaggaagaatcaaagctaccataatttttacaatttgagacaatatgatgattaggggacagaacaaaagaaggaaattctgtttttgtgggagacatataatga

SEQ ID NO: 66241 - DNA, 601 bp, Human
tattaaaatccccaaattttcattggcaccccggactaaattttatttaaattagtttaaatgtccttttcttcagttttctaacaaacatgcacttaaattttaccatatgccagtcattatttcaagaacttctgtttaaacttatataaccctcatagcaacgtcatgatgtagttgctattattatgccatttcacagatgaagttaatatgcctcatgtcaacacaactagtaactaaaaatccagcattcaaactcaggcagtctggttccaaatgtacttatgaccactccatwctgctgcccgtgactatatatggaatatatgcctcggctacaatcatatttgtatttattcaataaatgtttcataagtaatatttgataggtattacactaggtgctaggaataaggtggtgaacaaaaccagtcactgttccattcctcataaagcctacagcctaaaaggaaagatagttgttaatcagttaatcatatgaaggaacttgatagcaggagcacttaaacagtgtggattttacccaggtaaactgaagtgtaaggggtgggacttgcaattatttgggcaaagaaat

SEQ ID NO: 66242 - DNA, 601 bp, Human
caggtaaactgaagtgtaaggggtgggacttgcaattatttgggcaaagaaatatgggaagagcagagaggacacttaatgtgcaagaagcctgtggtgggaggcaggatggagaacatgcaggcattggaacaaatgctagcatggctacaggagacagagggcccatggtagtagagtagacagtgtgcgggctaatacaaaccatggaagccacatcatagggagctttctttatcctaaaagcactgggaagtcattgaagatttttaagcagagaaaaactcaatcaaattttccrtttgaaaaccctaatttgattagactgtagaactcagaggtgaatgcacagcatggtaatgaaaaaaaaaaaacacagaagacattgtaattaaatcaccatagaaaggtaaagcatttgtcttaaatgtttattttttcctgtgtatatgttggcttactacagtaattacagatgtggtgatacaactaatagtcaactctcctcaggacattctttgtaaatgtaattgaaagtagacatgtatttgaaaaaaaattaaattaattgaagataagctattatctaggattggtatta

SEQ ID NO: 66243 - DNA, 601 bp, Human
gcagagaggacacttaatgtgcaagaagcctgtggtgggaggcaggatggagaacatgcaggcattggaacaaatgctagcatggctacaggagacagagggcccatggtagtagagtagacagtgtgcgggctaatacaaaccatggaagccacatcatagggagctttctttatcctaaaagcactgggaagtcattgaagatttttaagcagagaaaaactcaatcaaattttccgtttgaaaaccctaatttgattagactgtagaactcagaggtgaatgcacagcatggtaatgaaaaaaaaaaaacacagaagacattgtaattaaatcaccatagaaaggtaaagcatttgtcttaaatgtttattttttcctgtgtatatgttggcttactacagtaattacagatgtggtgatacaactaatagtcaactctcctcaggacattctttgtaaatgtaattgaaagtagacatgtatttgaaaaaaaattaaattaattgaagataagctattatctaggattggtattaggtgctttctaggacatcttatttaattctcaaaacatgttacaaatgttaggccttcagtt

SEQ ID NO: 66244 - DNA, 601 bp, Human
cattaattttttttcctttagtccatccttgacagcaatgtcataattatttttcccaaagtctatgttaattcttagtttaaaatgttaaaatctacaattcaagtaggaaaagtggcagataagagacaggactaacaagcagctcccacttagatggacagaacagtgtctggagactcacattgtgaacttttgctccaagaacatcacaggaacaaatcaggaaaacagaaataattcacagaccctttgaaacaagcagcttgcttctgcaaatgccattagacagctgaaaaawctatgagttcccaaagtgtgaggggggaaaagtcaccctctaaacacatatccccactgtgaactgaaaaatcctgatcatgggagaaggatttaactttacttagagccaaaacagatttaggaagccaaatgaaagataaaagtagaagcagcagccagaagagtcccataggcacttccagtcttcaagtgaagtccagggaagccatttctggccttatctcacagaggtccttggggaaaggaaagcagctggtggaatttgggaggtgcacagggtgaggtaagctcctaggtg

SEQ ID NO: 66245 - DNA, 601 bp, Human
atgagattaaccaagaaaagaagagatacgttccaaataagcttaattagaaacaggccaggtgccacaggtgtggtggcttacacctgtaatccagcactttgggaggccaaggcaggcggatcaccaggtgaggagttcaagaccaccatgaacaacattttgaaaccctgtctctactaaaaaatacaaaaattagccaagtgtggtggcacgtgcctgtagtcccagctactcagaaggccgaggcaggagaatcacttgaacccgggaggcggaggttgcagtgagctgagatcaygccattgcactccagtctgggtgacagagcaagactctgtctcaaaaaaaaaaaaaaaaaaaaaaaaggaaagaaaagaaaagaaacaaaacaagagatattacattcgataacacagaaatacgaaagaccatttaaggctactatgaacaagtttatgcacacaaactagaaaacctacaggagacggataaattcctggaaatatacaacccttgtagattaaaccaggaagaaatagaaactctgaagagaccaataacaagtagcaagattgaaatagtaatttttaaaaatgcc

SEQ ID NO: 66246 - DNA, 601 bp, Human
cattgggtacattgtacactgctcaagtgatgggtgcaccaaaatctcagaaattatacctaaagaacttagccatgtaatggaacaccacctgtttccccaaaactattgaaataataataataataataaatattaaaatctttctattactcctcattatgaacactgagatttctatttaaattttttagataggctcaccaattgacttaattttaaagtgtagaactagatttttggaggttttaagaaattaatctcagtctgttcatatgcaaacgattagttgggagaaaagaagctgttcgtagttgatgatgattcccatgtggatgtatatataaattaggcacacagtatataaaaatggaaggaatgcatttgttgtcaaacttcctatactttcccctttgcgaagcatttgatacttctcaaactatcaatgacatagtaatctttttgtagacattattttaaagctttgttaaggtataattaacatgtaacaaaaattacatatatttatggtgtatttgtgatgttttcatatatgcatacattatgaaatgattaaatcaaggtaattaaaatattcatc

SEQ ID NO: 66247 - DNA, 601 bp, Human
agtttcactgacctaacaattctgtgtgctctaccttttcatccatccctccctgctaaaccctgatctttttactgtcttcatggtttgccttttccagattgtcatgtagttggaatcatacagcctgtagtatttttttagattggcttctttcacttagtaatatgcatttaaacttccaccttgtgttttcatgacttgatagctctttatttttagcaccgaataatccattgtctgactttaccatcgtttctttattattcatctactaaaggacatcttggttgtttccaaygaacagaactgctgtaagcatccatgggcaggtttttagtagatatgttttcaacttatttacatagtaacttttattgtccatcttgtaagcctgaggtttgaggactaggtttgaccttcatttcaaacattagtttatattactccagagatgatttcagataattcaaagtgctgtacttatttgccaactttgttagttaagtgattaatttcatgattttagaggaagaaaggtgtactaaaactctgctctgagaaacttgttttatatttcctttttgtgtatgtgaatatt

SEQ ID NO: 66248 - DNA, 601 bp, Human
tctttttactgtcttcatggtttgccttttccagattgtcatgtagttggaatcatacagcctgtagtatttttttagattggcttctttcacttagtaatatgcatttaaacttccaccttgtgttttcatgacttgatagctctttatttttagcaccgaataatccattgtctgactttaccatcgtttctttattattcatctactaaaggacatcttggttgtttccaacgaacagaactgctgtaagcatccatgggcaggtttttagtagatatgttttcaacttatttacatrgtaacttttattgtccatcttgtaagcctgaggtttgaggactaggtttgaccttcatttcaaacattagtttatattactccagagatgatttcagataattcaaagtgctgtacttatttgccaactttgttagttaagtgattaatttcatgattttagaggaagaaaggtgtactaaaactctgctctgagaaacttgttttatatttcctttttgtgtatgtgaatattcctatggcattacagcatgaatattgcactaaaattttgatctaagatctgttctatataaagtgg

SEQ ID NO: 66249 - DNA, 601 bp, Human
agcctgaggtttgaggactaggtttgaccttcatttcaaacattagtttatattactccagagatgatttcagataattcaaagtgctgtacttatttgccaactttgttagttaagtgattaatttcatgattttagaggaagaaaggtgtactaaaactctgctctgagaaacttgttttatatttcctttttgtgtatgtgaatattcctatggcattacagcatgaatattgcactaaaattttgatctaagatctgttctatataaagtggaatttatcttggagagggagaaagsagaaagggtcaattttggattcaagcttagtgtgttcaactgtcctaaatcatagctcactgcttgaggcacagggtcttactgcagagtccccaggagagggttaagataccacaaagttttttttccctttttaaacatttctataatttttatcttaaagactatattttcatcatttttcaagccacttggttgttatagttagataccttgatactatgaatgttcaaggaaataattttattgaaagagattattttttctattaaatatacagtgaaactaaaagtagcaagg

SEQ ID NO: 66250 - DNA, 601 bp, Human
cagcatatatgtacaatttttgaaaatgactttcatgtttgtatgtcttagtaactacacccagggtaactactggatttgatgggagttgagagacatggagatgatttaggagggaagctagtcatgtagtcaaacaccacactttataaaactccaaattataaattcacttctcccactatgaatgtactatctaatatgatagccactatccacatgtggctatttaaatttaagttgataaatgaaataaatgcttaaaagttcaactattcaatagccacatgtggctaatggstagctaccatattggttagcacagatataggacatttttatcaatgtagaaagttatattagaaaactattcagaagctaaggttcaaatttagggtaaagataggaagaagtaaattatttggcagtctatttctgaattcttgtacccataacggaaataatgcaatgttggcaagaaaatatgagagaaggaaatcatagatattcagtattttttacttgcatttatgaccttttttgaatgcttactaatacactttaattaatttgcacccccatacacatagtcaatgggtta

SEQ ID NO: 66251 - DNA, 601 bp, Human
ggctagctaccatattggttagcacagatataggacatttttatcaatgtagaaagttatattagaaaactattcagaagctaaggttcaaatttagggtaaagataggaagaagtaaattatttggcagtctatttctgaattcttgtacccataacggaaataatgcaatgttggcaagaaaatatgagagaaggaaatcatagatattcagtattttttacttgcatttatgaccttttttgaatgcttactaatacactttaattaatttgcacccccatacacatagtcaatgggktatacatcttgttttatgaacatcgtatagcagaggacactgaaatacagattttaagtacatttcctaatcatagcatgaagggaaatatagctgaatttgaactcaagtaattggactccagagccctacctagaaactaatctgaaaggcagtgggttgaattagtaataacagcctttagaggaaaatttaatttttttctgtttattgccaccaatcttggttgtttcctgatgggaattggaagggcacttttggaatgcataactgttctcttatagggtcaatcaaccaatg

SEQ ID NO: 66252 - DNA, 601 bp, Human
tttcattttatttgtcttaaaatgacttacctgtcttccaatatgattgcactgaattttaagtaaattctgagatgctggcatatgataggtacgtgactttgtaaagggaaaataaatgctattttcatttatacgctcagtggttgtccttgtaatttcttcaagagtgggctgaatgatatttgagggcttgtcacttgtgcatattctttcaaaatgtatcccttagtggattaagtgtcaaatcaatctcttgcttcttcagtgcaaaatggatattttgttcctttttgccacrtagatcatgtacctcatgtcatttagcaaggctgtagctatgtgaattattttatagttcctagattatagtttttacatgcaaactcgtatattgatttgaagtggtagttttttctgcccgccagggatataggtggtagatcttaaagtggctcattgtttggatttaattttgttcttttcctaaacatagcttttaccttattcatgtcataaaaaagttttaccatcatctcttggagattttattcagcatattatttttataatatgttttggctgacataacttgcctact

SEQ ID NO: 66253 - DNA, 601 bp, Human
caatattatggcattgactttaggattagtcagagaaaggaaacagctgtgctcataaatgttcatgataatcaggaggaaggacaataagaagttccatttccacaagtggaaccgtttctccttttttttttttttaattattcattgtgggtgaggaagagattgagccgctgctgatggctttggactctacttgcagaattgactttcttgcaacaataacactgtgtcctctgcttgatgtcttttcacacttcacttttgaaaggaaatttggggcaaggctttttttttttawcctcaagatttcatttcagtggcacagaagatgaagcacatcctttgtgtcctagtgttttgaacagcaaataaaatgaaaagatgctctgatgaacgggaaaaatgtgtttgaatgataaagtagatcactgtactgagtgtgtatgaagaggcttctgtgtttagctgttcaaaggtctttgcctgcataaagcatccttatccttgtggcaactgatatgctaccctctgttgcagtgcttttttgtacaattatttgtcagaggatcttgattcacaactcactgttctcttttca

SEQ ID NO: 66254 - DNA, 601 bp, Human
atctattaacaaacttaagatagtgaagaattatggcatgtaatctgaaacatgaacaattgatttatattatgatgcaattggaccaattagcctagatatttattgacataaaattttatacatcagtatattaaaaggatttttcacattgttgaagttaaactgatactttaagtgattacagaattctatgttgtatcataacaaaggtttttgtgtggtctgcagagcatgttgtaaccataaaggtctacatataatactcactctgacccctgctgttcaaaccatgttgacrtataagtgacaagagaaacatttcttttcattactctgatatattaagatcaataacattttcattagattcctttaaaatatttaggattgtgctttaagttaaaaagatgaacttaagtattttcttgaattcaaaagtatgtagttgatcagtctataaacaaaatagaccccaataattattttataagaaattaacttttagttgtagagttaaaaatatatatagctatagaaggctctaggtgtgaaagtatttatattttcagtttcaccgaaatgtaaaagttattggact

SEQ ID NO: 66255 - DNA, 601 bp, Human
ttgtatcataacaaaggtttttgtgtggtctgcagagcatgttgtaaccataaaggtctacatataatactcactctgacccctgctgttcaaaccatgttgacgtataagtgacaagagaaacatttcttttcattactctgatatattaagatcaataacattttcattagattcctttaaaatatttaggattgtgctttaagttaaaaagatgaacttaagtattttcttgaattcaaaagtatgtagttgatcagtctataaacaaaatagaccccaataattattttataagaarttaacttttagttgtagagttaaaaatatatatagctatagaaggctctaggtgtgaaagtatttatattttcagtttcaccgaaatgtaaaagttattggactgtattaatcaataatcttcctaacagtaaatttagtaatttttcaaatgttcatttaaataaataatttaaccacgttttctaaaatgatgttgagtgtttttatggggctaagttttacaatttaaattaagatcagaaatctatactttgttttcaagcttaaaaagagttttcaattatgaatcatgaaattg

SEQ ID NO: 66256 - DNA, 601 bp, Human
aacttttagttgtagagttaaaaatatatatagctatagaaggctctaggtgtgaaagtatttatattttcagtttcaccgaaatgtaaaagttattggactgtattaatcaataatcttcctaacagtaaatttagtaatttttcaaatgttcatttaaataaataatttaaccacgttttctaaaatgatgttgagtgtttttatggggctaagttttacaatttaaattaagatcagaaatctatactttgttttcaagcttaaaaagagttttcaattatgaatcatgaaattgatkcttttatgtcattttttactaagatattttaagtaactaaccattttcttaaattactgctagtcttgctgtacagtttattatttgtaatttgcattggcctatcaatttagaaattgtcaagttaactttttttcctagaaatttgtttattttgttttatttatacacattctggtgagctgggagatggcgaaaaaagggatggggaagtattttaaaaatacacactttttttgcttgctataattgtgtcaatatcattatgttattggataattataggatttggaggccagt

SEQ ID NO: 66257 - DNA, 601 bp, Human
attgtctacctgaagtaaaaaggtttgtgtgtggatttttaaatattagcattttccatttcatttcttaaagtcacgtgttgcatcagaaaaagaatctatgcctgcctttaagtgtttgataaatcattccttattcttgtttttgtctatattgaagactataagagtatttttgtgggaaaaaagctatattacttttatgagtattaatttatgataataatttcaggatactcattcagccctggattatttatattaatttctttcccaggatcattttattttagactttttrttttttaacacatttttgttttatgaagtacatacttcattagtatttcaattcacttttactctggaactcagaaaacccttttcaaatctggccctctcccctatgtcagggaagatgcaggagggagcagttaaatcccttacgcaatgttacacaacttttaaatggcccagctacagtttgaattcagctccattcaccttcagaaatcatgccccatctgttatagaaagatgtactttgtctgcgttcattttagatgttattagaattatttcaagcaaaaggaaaaaatat

SEQ ID NO: 66258 - DNA, 601 bp, Human
tttgttttatgaagtacatacttcattagtatttcaattcacttttactctggaactcagaaaacccttttcaaatctggccctctcccctatgtcagggaagatgcaggagggagcagttaaatcccttacgcaatgttacacaacttttaaatggcccagctacagtttgaattcagctccattcaccttcagaaatcatgccccatctgttatagaaagatgtactttgtctgcgttcattttagatgttattagaattatttcaagcaaaaggaaaaaatatataccaacttagaaragactcacctctgattgctattctgagtgatagtggcttaatccattattttaacctgggtgctgggtgctagaggaaaaaagagcgctcttttttccaggatatttctcaactctggggcaaaggcaatgaaattcattcaattctgtagggcttccattactgatgagattatgaatggacactccttgttcaaatgatttatatggatgccatattctattttaaatcattcttactggtgattctgagaaatgtggatactcacacacatcattattgagcttgtgagattcttct

SEQ ID NO: 66259 - DNA, 601 bp, Human
taatagaatctaggttatgagagtgagtctcttgccacatatttttgaatggaaacctgtgttacttttcccagaggtgttttacattatgcttttcttgaaatgcttttgattatttaaaaagaagccgccaatgataaaaccatttgtgtaataatcaccattgactagagagctctttatttgttttgaagagaatttgttcagaagaaagctacagcaatcctctcttctaccccaactcaaagcaaaagaccttgttaatgttacaatgatcaagtggggaaaatgtctcctactrtaagttttaatgtaactagatgttcttttgaaaaagataaatgatgacatgtgcttaaaatgagtagtacatatgactgcatgctagggctttagtacaaacacagtacaatgatagttgcctgtctaattatcttgacaaaggtatacattcagttattttatcttctaaaatagacaatacatgattacataaataattattaaaagtgaactctactaaattattttaatcacaaaagaaaattaaaggcaaggtatttggtgtttcaaaaactgacatatgtcctaatgcaattgt

SEQ ID NO: 66260 - DNA, 601 bp, Human
ctctacagatttatcttagtcattgcttgctggtcaccaatcattcttttttttttttttttttttggtccattagtggccaggcttggtatattcgtatttgaaaaactattaacatatgaggtaatattacagatgtgctttaaaagcaattttattgctttataaaaaggcaatatttacacaaagaagtgaaagtaaaacaccatttttctgttagcattttcctaagaaatgatgctggggaagaggtttatctgtcttaaattttaacgggctgattctgttaatgaaataaaawgaagaatcatgcagtttcttctcagtttgccaaattgcttttctaatgagtctgtgatagagttgatattgagttttggcatgcaaaagctgttttaaattggcaaatgaagaagcaaagaaatacacaatattgatgcatcctacatgtgaaattgtctttcttacagcactcacattattatttttcttcagaatgaatttgattttccaaattagtactcagaatatgtacagtaagttggttaaagaaccattattatcaggtattatcttttatagttggttattagctgcacat

SEQ ID NO: 66261 - DNA, 601 bp, Human
ttttttttttttggtccattagtggccaggcttggtatattcgtatttgaaaaactattaacatatgaggtaatattacagatgtgctttaaaagcaattttattgctttataaaaaggcaatatttacacaaagaagtgaaagtaaaacaccatttttctgttagcattttcctaagaaatgatgctggggaagaggtttatctgtcttaaattttaacgggctgattctgttaatgaaataaaatgaagaatcatgcagtttcttctcagtttgccaaattgcttttctaatgagtctrtgatagagttgatattgagttttggcatgcaaaagctgttttaaattggcaaatgaagaagcaaagaaatacacaatattgatgcatcctacatgtgaaattgtctttcttacagcactcacattattatttttcttcagaatgaatttgattttccaaattagtactcagaatatgtacagtaagttggttaaagaaccattattatcaggtattatcttttatagttggttattagctgcacattgacacaatttagtcagttaactaatagtttttatattttgacactcttgtcat

SEQ ID NO: 66262 - DNA, 601 bp, Human
agcaaagaaatacacaatattgatgcatcctacatgtgaaattgtctttcttacagcactcacattattatttttcttcagaatgaatttgattttccaaattagtactcagaatatgtacagtaagttggttaaagaaccattattatcaggtattatcttttatagttggttattagctgcacattgacacaatttagtcagttaactaatagtttttatattttgacactcttgtcatcaagaaatgcatgacattgtatcaaaagctcttgatgctatagccactgcttcacacagmttttacttaggatgagggcattagctttaaaagtcctcctctcctcagtttttacatacttctttctcccactcaaaactcctttttgttattttgtaccatggatatgttaaaaaaaaaaaaaaaagtctgaatcagaaaaaaattgatgatctatacaggaagatccattttcacttgtttatttctgtttcgtaatatgtgttattgttctctgtatgaaattgatgcctgtgtggcattacagcccttatgttactttgtgctggaatttatttaatatactaaaccttatgaagt

SEQ ID NO: 66263 - DNA, 601 bp, Human
aatatgtacagtaagttggttaaagaaccattattatcaggtattatcttttatagttggttattagctgcacattgacacaatttagtcagttaactaatagtttttatattttgacactcttgtcatcaagaaatgcatgacattgtatcaaaagctcttgatgctatagccactgcttcacacagattttacttaggatgagggcattagctttaaaagtcctcctctcctcagtttttacatacttctttctcccactcaaaactcctttttgttattttgtaccatggatatgttaaaaaaaaaaaaaaaagtctgaatcagaaaaaaattgatgatctatacaggaagatccattttcacttgtttatttctgtttcgtaatatgtgttattgttctctgtatgaaattgatgcctgtgtggcattacagcccttatgttactttgtgctggaatttatttaatatactaaaccttatgaagttgatatcattctagccacagtcaacttgtagtagatttgaaactggaggtagtaaatatcttcattttaagcccttttaattaaaagcaattaaaaattccctaactaggac

SEQ ID NO: 66264 - DNA, 601 bp, Human
gaatatttaagtgaatagaataatactggaaagttaaattattacggaattctgtgtttaagaataaaagcaatattgctctttttcttaaaatctatcaataaacaatcaataagctaatattttccttttttagaatactatgtgtcagtgtaagactgttctcagtgcaaattttttccaatctctcttatctttattcagtgctgaataaaagaacattgtaaaaatccccacattttgcttaaaaaagagaatagtatgctcttttacatgctcttcttgtaggcttgacaaaagmaagtatgatttgtcacattactgaatgtctatcagtaaagcaaatgcactaattaatcacattatattataatagaaatatcaattcaaagtatagccttctaatttgcttctgtgatgggcaaaacttgctaatggtgcattggtacatatttccaaaattcagtcagttgaaattgtttctttctaaaatattatttaatcagatttgattagaagggcacatgaagtgacagggtctcactttgacattcatctttggaggataacaaaggaatgtagtataaaatgtttatcctta

SEQ ID NO: 66265 - DNA, 601 bp, Human
aattgtttctttctaaaatattatttaatcagatttgattagaagggcacatgaagtgacagggtctcactttgacattcatctttggaggataacaaaggaatgtagtataaaatgtttatccttatttcattttttttcctgctaaaatcactgttggaggtaggcccatgatattaaaatggctagcccttgctccatagttgtgatttgtgtttttaaatatcaattattgacaggtatcataattacagctacataggcatccaatattgatgtaccagtattaattaattgaataaaacatttttagggtgagatttcctgagggtttcctgagatttccggggtgagagttcctgagacgaatagctttcaagaggaagcataggcagagttttgagaactaatttaagcctttagtagagctagatgtattgaggtatgggatgggttctatgactgtcagaatgaagactagatcctttcctgggagcacgaggaatgagggtcattggcaagcctgtgctgttgagctgcttattccttctattgtaaaggtgttcgcctctgtcttgtctttcagtcctccacaagcaac

SEQ ID NO: 66266 - DNA, 601 bp, Human
gccgggcgctgtggctcatgcctgtaatcccagcactttgggaggccgaggcgggcggatcacgaggtcaggagatcgagaccatcctgactaacagaatgaaaccctgtctatactaaaaatacaaaaaattagccgggtgtggtggtgggcgcctgttgtcccagctatcgggaggctgaggcaggaaaatggcgtgaacctgggaggcggagcttgcagtgagcctagattgcaccactgcaccccagcctgggcgacagagcaagattcgctctcaaaaaaaaaaaaaaaaaaaaargaaaggggaagttaaaaatacaaggggtaggaaatcaaactaaataaaatttcaataaatgaactgctgccaaggaaatgttcaagtaaaagaaatatggattgtctagagttcctacttaaagagagaacagacaaaaaacttttttttagttgactatcacattagaatactctaaaatgccagatataatcttgttacttaaatattctaaatatttcatcagataagcctcttgcttctgaaagttgtgatacagaagtaaagagacggggttatactgtctctagaattaggtgg

SEQ ID NO: 66267 - DNA, 601 bp, Human
tatgaattttattttttagtatttctttgatttggagcaaaatttatgatcatttaaaagaaaaatactttcggaacattttctttaatctgtgatttttattcattaccttttaaaaggaaatgttacttaaaagaaaaaaatattcttatacaaagatgattaactgacccatcctatttaaagcacttgaactaactgctgagaacatcatatactttcacatggttgaaatttccttccaaatctaaatcaatctttaaattgctttaaaacagaagataaatgaggaaaaaattawcttgcaggaatctataaactgtctgttatatgccttaaaaaggacagtttctcgcactaggctgtaaaatttgtccctctaaccctagtaaaataggatccagatgtcttttgtttgaaaactctagactactaaatagtttgagtaaattttctagtttaggcctcagtttggggtcttagtaattttacctagagctcaaaaactgtgtcaagtgccagaaaaatgagaaatccattcctaaaacctcatcataaagtcattaaccataagacctgttccctatcactttaaaaaaaa

SEQ ID NO: 66268 - DNA, 601 bp, Human
atataataatattactttgtattttaacaccttaattttgaagttaacatgatgtcattcagtggtataatatattctaaaaaccaagaattttagcaacagaaccttagtgctgcagtttccagattgtacaacacttaatttgtcaattaacttatcaacaatctcagatgttgtgccatgtgtcagagactatactgggcacatgaagtacactatttaattccttctaataatactaaaacatagaaattagaatttccattttatatttaaataaaactgagtttcagaaataatrtatgtcaagatatccagcaatgtcagatgcattgaagatgctcagtagcagttgcttttctaagattcttcctcttgcctccctccctccactgctacaacagaccttgagaacaggccattttcatttctacttttctgatggaaaatagactcatcgaagttaagtgatttgtgaaattttagaagtaggttataaaggaaatagaagaataagaacaaactaacccaaagctagcagaagaaaagaaataactaaaatcagagcataactgaagaaaattgagaccccaaaatccat

SEQ ID NO: 66269 - DNA, 601 bp, Human
gatccaaagaagctcagtcaggaatgacaaggatgacactgtgattgatcccgaagaaatacaaaagatcctcagagactattatgaacaccctaggtacacaaactagaaactctagaggaatggataaaatcctggaaacatacaacctcaaaagattggatcaggaaaaagttgaaaccctgaacagaccaatattgaattctgaaattgaatcggtagtaaaaagcctaccaccaccaccaacaacaaaaaagccctgggccagatgagttcacagctaaattctaccagacatacraagaagagctggtacctattctactgaaactattccaaaatttaaggaatagggacacctcccaagttcattctgtaaaaccagcatcaccctgattccaaaatctggcaaagacacaatgaaaaaagaaaactacaggccaatatttctgctgaacacaggtgcaaaaattcttaacaaaatactagcaaactgaatttaacagcacatcgaaaagttaattccccatgatccagtaggttttattcctagaatacaagattggttcaacatatgcaaatcaataaatgtaatttacca

SEQ ID NO: 66270 - DNA, 601 bp, Human
aacagacacttaaaaaaacatacaagtggccccaaaacatacaaaaatattctcagtatcactaatcatcagagaaatgtgaatcaaaaccacaatgaagccaggcacaatggctgacacctgtaatgccagcactttgggaggccaaggcagacagatcactggaccccagtttgagacgagctccacctctatgaaaaattacaaaaactccacctttacaaaaaaatacacacaaaaaatttagccaggcatggtggcatctgcctgtagtcccagctactcagagggctgaggttgraggatcacttgagcccaggaggtcaaggctgcagtgagccatgatcacaccactgcacatcagcctaggtgacagagcaagatcatgtctcaaaaacaaacaaacaaacaaacaaaaaacccatcagttactggtgaagctgctgagacaagggaagacttatacactgttggtgggaatgtgaattagttcagccactgaggaaagcagtttggagattttgtgaagagctgagaaccactattcaacccatcaatcgcgttactaggtatatacccaaaggaaaataaatcattctac

SEQ ID NO: 66271 - DNA, 601 bp, Human
attaacttggtcaagcatttttgtacatttaatacttacatgctttattaaagccttatatgcagttagggattcaaaaccataagactgaatttatattaagaaccttatttttatatgagaatagagaatttttttacattcaaatggtagctgttaggttattgccctgtgccaagatcttatgtgagatgcttgtgattcttggaaggagacagacagtgatctctaccactatgtttgcagtctagcagtttccaccattgtcctgtcccataaactggtacctatgtacaaaagwttagaaatatgttcaatggtgcctacagtcttttagcaagtgatatctatgtaagtaaacattaatctgtgaactagagtctgttctaaaagcagtaattgttcagtagaattgggctcactagactgttttgtttaaattttccatctctcaaagggctcctaacacatagcacccctctttactatctgaattctgaaaaaaatagaaaataaaagacttgcatgtcacctttacagctaaaaagatccaagccaatagacatgcttggtgtctttaacagagctccagaattaggcc

SEQ ID NO: 66272 - DNA, 601 bp, Human; identical to SEQ ID NO: 32232

SEQ ID NO: 66273 - DNA, 601 bp, Human; identical to SEQ ID NO: 32233

SEQ ID NO: 66274 - DNA, 601 bp, Human; identical to SEQ ID NO: 32234

SEQ ID NO: 66275 - DNA, 601 bp, Human; identical to SEQ ID NO: 32235

SEQ ID NO: 66276 - DNA, 601 bp, Human
aattaagacaaatgaatgtgcctgctcttctatttcaggtgaaacgaatttctgaagatcctccttgcaaatgcccaaacaagttctgtgtggagcggctctcccaaggaagataccgagtgggagaaaagatcctcttcattagggtaaagttttacttttcacttatcttgtttttatgggaagattcagaatttgagttaggggaaatatgacagataagagcaggaacttccatatggtgcttacgtttaaagatacatggtatgaatttttttaaagtaacatacattataatgtrctactgaaggctaaatacaactgttttctctttgtacatataccaaaacgcatatacaccaaagacaccatggagatcaaatagatgaagaaggctttccacttgtgttatgttttgctaagaatcaagataatttaatctctcaaagtaagtttgtggcttttactaagaccaataattctttttttaaaaaaaagaaaagaaaagaaaatgaaaaatagagatacattcctagaaatctgcagttgtaaataaaagtaatttgctgctttatggtttagtcatttctaaaggaacaga

SEQ ID NO: 66277 - DNA, 601 bp, Human
cagagagagtcatttgtttaaacagttattcctttttgtaataaaagtgttaataaagcacatgattaataaattatatacttctccctgcaatgtaacctaatatcttcagtcaaaaatatatattacatatgtttatttgcatctgtgatttcagatgcaaatttagtcatttgtcaaggattttaatgtccacatttgtgaataacatgtttttatagtccttactatataaggcaggttttttgatattccatttttcttttcaagaaatagttatcttttgattaaatctattcaygcattatttatagagaaattgagatttgctgtactgaaaaaattgtatcaaatttcttagggatattaatttaatatcaactaatacataagaacatattgtgcacactcagtttcttacttctaatgttccaggtgaacctgcaataagagagttaactgtgatgtggttattcactgattagtccagcaagtaatggcatcatgctattatgacatgttttagaatagtgtcttaacgaacgttaatcatttattctcttgatttttatactatccacatacaattttactattttta

SEQ ID NO: 66278 - DNA, 601 bp, Human
tttgaatttggacagcgatgataaaaccttctgatttctgcagtaacagagatttggattaacagagatttggattattcccattcaaccataatacgtatctttgaaatgtaaataggtggatctcaggactaatgtcttgatttcagggaggagagaattttctcttgttcatttgtttattcagtcagttggtatctacataggcttcaagtatcaagaagtcacttggcaattgaaatccgaatgagcctgtaaaaagggacttcagaaatatgtcttagatgcaataataatgtcyatggtatttgacttatcaattccaatttgatggctatgttctacctaagtactccaagttggagtgcagtgctgcggctcactgcaacctccatctcccaggttcaagcgattcttgtgacacagcctcccaagtaactgggattacagtgtgtaccatcacacccaactaatttttaatttttaatttttttttttttttgtattttaagtagagacaggaattcatcatattggccaggctggcttcaaactcttggcctcaggtgatccgcctgccttggcctcccaaagtgctggg

SEQ ID NO: 66279 - DNA, 601 bp, Human
ttgaatttggacagcgatgataaaaccttctgatttctgcagtaacagagatttggattaacagagatttggattattcccattcaaccataatacgtatctttgaaatgtaaataggtggatctcaggactaatgtcttgatttcagggaggagagaattttctcttgttcatttgtttattcagtcagttggtatctacataggcttcaagtatcaagaagtcacttggcaattgaaatccgaatgagcctgtaaaaagggacttcagaaatatgtcttagatgcaataataatgtccrtggtatttgacttatcaattccaatttgatggctatgttctacctaagtactccaagttggagtgcagtgctgcggctcactgcaacctccatctcccaggttcaagcgattcttgtgacacagcctcccaagtaactgggattacagtgtgtaccatcacacccaactaatttttaatttttaatttttttttttttttgtattttaagtagagacaggaattcatcatattggccaggctggcttcaaactcttggcctcaggtgatccgcctgccttggcctcccaaagtgctggga

SEQ ID NO: 66280 - DNA, 601 bp, Human
tcagttggtatctacataggcttcaagtatcaagaagtcacttggcaattgaaatccgaatgagcctgtaaaaagggacttcagaaatatgtcttagatgcaataataatgtccatggtatttgacttatcaattccaatttgatggctatgttctacctaagtactccaagttggagtgcagtgctgcggctcactgcaacctccatctcccaggttcaagcgattcttgtgacacagcctcccaagtaactgggattacagtgtgtaccatcacacccaactaatttttaatttttaatttttttttttttttgtattttaagtagagacaggaattcatcatattggccaggctggcttcaaactcttggcctcaggtgatccgcctgccttggcctcccaaagtgctgggattacaggcatgagccaccgcacacagtgtcttccaacagtaatttttaaaatggccaaagattagcagcatcagcatcatttggaaacttgttagaaatgcaaattcttggggctcccccaagacttactaaatcagaaactctgagggtagggcccagcctcctgtgttttaataagtcctccag

SEQ ID NO: 66281 - DNA, 601 bp, Human
attttgaagacttctatgtattgttggaaggaaatgcttaagacgtcattgtaagtgaaaaaaagaggcttttaaattatatttacatataaaatagctctgtgtagaaatgattaggataaagacaaagaaaatgggaataatagaaaatagtttttatttgtcaaggacacagaattatgagtgtgtgattttttttctgttcttcaaatttctgatgatcattttaaaaatatgaactctttaaggtaaaccagcaaacagatacagttaaaaatttgagaataaattaaaagccctytgaaagttgtcaggttaattagcagactgctcatttgaatcgcccttttgctgagcttcctatcttccggaaaatggtggggaggttttttggagtcatggtattatttagactacagagaatttttgcatattgttgtgaacttatagcatatttttcgttagatgaagctgtcttcctttactattttctctctccattttggaaattgatattgtttaggattagcacctggaaatatgcaaatgtttatctactgtctggataatatgccttgtctttccttatctttgcagaccc

SEQ ID NO: 66282 - DNA, 601 bp, Human
tccatactgatgctccagtggcttaagggtatttttctagtttaagaaatatgagtacttgaggggcctaaagaaaagacaatgaataatttaattggaagtcagcaaagggatttgaaatgttatggcgttacttcctttgtactacttttaaattaaatcatcacagatcaatagaaaggtcacacacattgttattgactctgtgtaatttcttccttagcataaaaattcttcaggattatgcctgtgtggtaaaaatcaactctctgaaacaaaccaagcaagagaggcaccaaarctctgttgctatagcaactgaacttggcaatgtcttctgggacttgctctaaggaaaggtccatgatagtgggtgatattacgttcttttttgctcttatggcacatactgatttactgtgagtaaaaagtagcatggttcaaatttcatatttttcctagtgatgaaaaatgggctgttgtgtgaaaatgtaaaggagttttaaacaactagcaaagaagttaaaacctccatttatccttagtggaaatgctgcagaagcagccattactcagcagctgaaagtcaacaattcattta

SEQ ID NO: 66283 - DNA, 601 bp, Human
gatcatgcctgtaatcccagcactttgggaggccgaggcgggcggatcacgaggtcaggagatcgagaccatcctggctaacatggtgaaaccccgtctctactaaaaatacaaaaaattagccgagcgttgtggcaggcgactgtagtccccgctactccggaggctgagtcaggagaatggcgtgagcccgggagacggagcttgcagtgagtggggagatctcgccgctgcactccagcctggatgacagagcaagactccgtctcaaaaaaaaaaaaaaaaaaagaacaaaaaagcmgaaagacaatgaaatttggtatttattacaataattaaaagtaaagacaaaatccgcaaatacttttgcaccaaccgaataatacatctgggcagttttctatattctaatttaagttagagagctcatttcttcttccactgacattaaatgtgaaaaacaataaataaatagaagctcaaaaccaaaaattattcttcattaaaaacttaccactattggccatttagcaatgagtagatttttcaatagtgtctaccttcacttgacctaataagcattcttactcatctccaactc

SEQ ID NO: 66284 - DNA, 601 bp, Human
cggtgaaagtaggaacaagagagagtgggaggggaggtgccacacactttaaaatgaccaaatctgtgaactcactcagtgcgagagctcacttatcaccaaagggatggcccaagccattcatgaggtatctgccctcatcatccaaacacctcccaccatgccccaccttcaacattgcggattacatttcaacatgagacatgggtaggagacaaatatctaaactgtatcatatactatttaatactcaccaaatgctttctgtgtatctgttgtctaagtgctttcctcggattcttttttttttttttcaaccctcacaactctttgaggtaggcactgttgttatcctcatagtaacaataaggaaattaagtgttagagagcaaattgcttgtcagagattacacagtaagtgtcaaagcctttatttgaatttaatgtatctgatttcagagcccacggttttaattatatgctattcattccatttcagaccatatagacatttggcatgtcattttgtaagtattactgttcaacttttaaaatccattagtaatttacctatactcaatgcatagctcctagtttgctt

SEQ ID NO: 66285 - DNA, 601 bp, Human
atttactacaattataaacttatatttatggcctttggtcagttaagattaaatcctcttaatttcaataggtatggaaggattttctgagcatgctatggtatggcagagagatgaatttgcattttgtatcattttttacttttattaaagggtctaaactaaacatatgaccaagtgcaaactgaaaacgttggcatagcaactaatgctttgaaagcaagtttcctaaaattgtcaagtaatttttacataacattttttcttaactgtttttgtcttgtttcttgatagcagtacrgatatctttcttttatattgtttgtaaagtactttcattttatacattatctcattttagcttaattattactgtatgacaaaaatgagtgtgattgttaatttataaaacttatcgatgaagaaactgcagctaatagaaatttagtaattttcctaaagtaatcctgttagtgattgatccaggttaaattatattatgaaaatttatatctaaattttatatgatttaaacttcacacagcaaaatttccttttgaagtttttttttaaaaaactttgtataaatgaaaatagttct

SEQ ID NO: 66286 - DNA, 601 bp, Human
agcactcatagatctgatagataacatgtatacatatatcaactagaggaaaagtgaagatgaaatattctaaagataaaagagaaagtagccttaaataaattttaaaaattacagctataatactatctaatcatgggaggggaaacagttttcccaaagatgacttgactttgtcatcctgatgcttagtcagagaatctgaaacatatcctttgattcctattgaaagcctttcaacaaattacctttcagataaactgtctccttgtgagtttggaatctctaattttgagttaayctctctaattgtgagcttaagatgctacataaattacattttttaattacaaccaaagaaagtggtagagtagaaaagagtgtctcctgtgtcatgtaactttctgagggtaaatattaggttggtgcaaaagtaattgcggtttttgccatggaaatgaatggtaggcatggaatattatgcagccagataaaaggaatgtggtcatatcctttgcagggacatggatgaaactggaagccatcatcctcagcaaactaacacaggaacagaaaaccaaacaccgcatgttctcactca

SEQ ID NO: 66287 - DNA, 601 bp, Human
aaagatgacttgactttgtcatcctgatgcttagtcagagaatctgaaacatatcctttgattcctattgaaagcctttcaacaaattacctttcagataaactgtctccttgtgagtttggaatctctaattttgagttaatctctctaattgtgagcttaagatgctacataaattacattttttaattacaaccaaagaaagtggtagagtagaaaagagtgtctcctgtgtcatgtaactttctgagggtaaatattaggttggtgcaaaagtaattgcggtttttgccatggaaaygaatggtaggcatggaatattatgcagccagataaaaggaatgtggtcatatcctttgcagggacatggatgaaactggaagccatcatcctcagcaaactaacacaggaacagaaaaccaaacaccgcatgttctcactcataagtaggagttgaacaatgaaaacatatggacaagggcaggggaacaacacacactggggcctgtgggagtaggggaggtgaggtgaggaagagcatcagaacagatagctaatgcatgcagggtttaaaacctaggtgacagcttgataggtgcag

SEQ ID NO: 66288 - DNA, 601 bp, Human
tttgcatttttaggtggcgttcatgtacctttcttcattgaagacggagagcattttatgaacttcatatcttcttgtttcagtagggtcttcatggttgtgactatatctccacagccaaagcaaagcagacatttaaggtaattacttagataattagtgggcaaatctccactttgctttcactgtggtgccttggccttcaatcagttgagggaagttgggcactcagaagttaatattttacttttttttttttcatgaggtactaaaacactgtttcttcttttgtttttcccaygatacttttgaaaaatggcaatctcagatctattgtgggtggctagaagacagtaacctagtaatacaatatttgttattttgttagtgtaattcttgtgctccaggaatgttgagcttattgttaaaaattgcttgtatgaacctgggttttagcttctgtatgcaatatcatcttggcctttgctttcaaatatttggaacaatacatttatagaataaaaaatgaaacaccatataatttcagaatgtctcaattctactcccatttgtagtttaatgcaaaaggaacctcatggac

SEQ ID NO: 66289 - DNA, 601 bp, Human
caaagcagacatttaaggtaattacttagataattagtgggcaaatctccactttgctttcactgtggtgccttggccttcaatcagttgagggaagttgggcactcagaagttaatattttacttttttttttttcatgaggtactaaaacactgtttcttcttttgtttttcccatgatacttttgaaaaatggcaatctcagatctattgtgggtggctagaagacagtaacctagtaatacaatatttgttattttgttagtgtaattcttgtgctccaggaatgttgagcttattrttaaaaattgcttgtatgaacctgggttttagcttctgtatgcaatatcatcttggcctttgctttcaaatatttggaacaatacatttatagaataaaaaatgaaacaccatataatttcagaatgtctcaattctactcccatttgtagtttaatgcaaaaggaacctcatggacctccaccacatcttttgctcctgacaccataccaaacttccagatgtatcagtcatgttttaacacttcagtatgatgaaagttagagaggatggaaatggaatgggacttgattttgaggta

SEQ ID NO: 66290 - DNA, 601 bp, Human
aaaatggcaatctcagatctattgtgggtggctagaagacagtaacctagtaatacaatatttgttattttgttagtgtaattcttgtgctccaggaatgttgagcttattgttaaaaattgcttgtatgaacctgggttttagcttctgtatgcaatatcatcttggcctttgctttcaaatatttggaacaatacatttatagaataaaaaatgaaacaccatataatttcagaatgtctcaattctactcccatttgtagtttaatgcaaaaggaacctcatggacctccaccacatyttttgctcctgacaccataccaaacttccagatgtatcagtcatgttttaacacttcagtatgatgaaagttagagaggatggaaatggaatgggacttgattttgaggtactgaggttgcattgcacataggaaaactggctcatttttagtttttaaatattaataattatatctagaaagcacagcttacttaagtcttgtctgttatacataaatgcaaaataattataagagaaaccccatattataaattctacttaaaactagatgaacatatcttgaaactacattatgaga

SEQ ID NO: 66291 - DNA, 601 bp, Human
accatataatttcagaatgtctcaattctactcccatttgtagtttaatgcaaaaggaacctcatggacctccaccacatcttttgctcctgacaccataccaaacttccagatgtatcagtcatgttttaacacttcagtatgatgaaagttagagaggatggaaatggaatgggacttgattttgaggtactgaggttgcattgcacataggaaaactggctcatttttagtttttaaatattaataattatatctagaaagcacagcttacttaagtcttgtctgttatacataaatrcaaaataattataagagaaaccccatattataaattctacttaaaactagatgaacatatcttgaaactacattatgagaatttttagatttctaaaagagcacagttaaatgtatttccttaaccatcatttattctatcattcattcactacatacaagagggtgtgctatttgaaagaactgttagaaagcttgaggatttaatttctttgtagcttctgtttcctggtaaagataatgcttaataatgtaaatattggtcatatactattaattattctgacagttcaatataatt

SEQ ID NO: 66292 - DNA, 601 bp, Human
ctggctcatttttagtttttaaatattaataattatatctagaaagcacagcttacttaagtcttgtctgttatacataaatgcaaaataattataagagaaaccccatattataaattctacttaaaactagatgaacatatcttgaaactacattatgagaatttttagatttctaaaagagcacagttaaatgtatttccttaaccatcatttattctatcattcattcactacatacaagagggtgtgctatttgaaagaactgttagaaagcttgaggatttaatttctttgtagsttctgtttcctggtaaagataatgcttaataatgtaaatattggtcatatactattaattattctgacagttcaatataatttaatttattatccccattaataattgacagagacaggatgtgagtttctgaaaatctacttctaaaattccttcaacagacgtgcaaatgtgtcatacaagatacaagtataactcagttgtgtggcagaaacaccagacataacttttcttggagctgttgaaaggcattgtatagacttatgaagcaagttacttgtaaatgaacatgaaacctaa

SEQ ID NO: 66293 - DNA, 601 bp, Human
gttcaatataatttaatttattatccccattaataattgacagagacaggatgtgagtttctgaaaatctacttctaaaattccttcaacagacgtgcaaatgtgtcatacaagatacaagtataactcagttgtgtggcagaaacaccagacataacttttcttggagctgttgaaaggcattgtatagacttatgaagcaagttacttgtaaatgaacatgaaacctaagtctgtggagctaatctgaccatgacagccctgacccccatttatcaccaaagtcgattgaacccctctkcctggctggtgttaagtttcccctttcactatccaggtgtcacttggttcaagaggaagatgttggcggacaggttttcttcaaataatatgagtacctctgttattttcactacttaaattgccacaattctccttgcatcttataaaagtattgttttttggtttttgttttttgttttacttttcatcagtatcttttaaaggggtgtgtgtattggactagagagatggtgtggcattttctaaaaaccctaggaataattcttattttggaataaattttttttaaaaatcgctg

SEQ ID NO: 66294 - DNA, 601 bp, Human
caaatgtgtcatacaagatacaagtataactcagttgtgtggcagaaacaccagacataacttttcttggagctgttgaaaggcattgtatagacttatgaagcaagttacttgtaaatgaacatgaaacctaagtctgtggagctaatctgaccatgacagccctgacccccatttatcaccaaagtcgattgaacccctctgcctggctggtgttaagtttcccctttcactatccaggtgtcacttggttcaagaggaagatgttggcggacaggttttcttcaaataatatgagtayctctgttattttcactacttaaattgccacaattctccttgcatcttataaaagtattgttttttggtttttgttttttgttttacttttcatcagtatcttttaaaggggtgtgtgtattggactagagagatggtgtggcattttctaaaaaccctaggaataattcttattttggaataaattttttttaaaaatcgctgaagttagtatgatttccataggcatcatggattttatgttggaggtttgtaatggagtttgtgtgatagttttttgaaggcagttcaggtctccatt

SEQ ID NO: 66295 - DNA, 601 bp, Human
ggtcgcggttcattttcccagtattccccagagtaacttcagtcctctggctcttctgacttttggtaaggaggcttgccaagctgtcttcattcctgaatctcattacctacatctgggcccggttttccctgcctaatttcaagcacttttccaaggatgggacttatgctccagtcatctttgctctttatgtccaatgtcacacctcaatctttttttttttttttttttttgagacagagtctcgctctgttgcccagtcttgagtgcagtggtgtgatctcggctcactgcaagstccgcctcccggattcacgccattctcctgcctcagcctcccgagtaggtgggactgcaggcgcccgccaccatgcccggctaatattttgtatttttagtagagacggggtttcaccgtgtcacacctcagtcttaatctctcctctttagaacaccgtcaagtcttccaagatctttgcagggctggaattggcactctccttggggcttatttgctatgaaatgttttctctctgaagcaagatggccctttctacttgtttttgtttgcatttctcagatcagtttctttcacttg

SEQ ID NO: 66296 - DNA, 601 bp, Human
caagtagctgagattacaggagcatgccaccacacccggctaatttttgtatttttagtggagatggggtttcaccatgttggtcaggctgttctcgaactcctgacctcaggtgatcggcccgcctcagcctcccaaagtcctgggattacaggcatgagccactgcgcctggccttttgtgcaattttatgttcagtgatctccaaatttatttattctgttacaagtatttctctaaaataacccagagctctctcaacttactaggtgttagagctactacaaatgacttatcttcraacatgatctctttctgattttcttaaagtgaagggctttctaaacaagacctatgtttcatgaaaatgtggttagtatgacattttaaacaaggcattttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtaca

SEQ ID NO: 66297 - DNA, 601 bp, Human
tttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtacatttcttctggttaaatttggggttgaagttgccagtagagtttacctatcgtgattttttttttttctgttaatctggatttcaagagtcaagaaaggrtatctgcagaaagtcatgtctgagatgagactcaaagaataagcacatgttggctaaacaaagtagaagtgaaagtgtttcaaccagaatcagaaagaaaggagacagcatacaaaaaggcccagaagtaacagaggaggagatgaggggaagagagagagagagagagacctcatcagaactgtagaagtgcagccttgagagttgaggacaaaaggaggagtgggcaacgagaggctggtgtagcaagggagacatgatgccaggcagacacacagagccagctcatggagagctacc

SEQ ID NO: 66298 - DNA, 601 bp, Human
ggttatttaaaattgaaacaccgttaagtttatctttgtcctgcaaacgataacagaaaagcaacatgttgattttggcttattctgatacatctgcctggcatggaggaattggtcgggtttcaaaatgtcagaatttctgcttgttaatgagtggtttctttggtgagaattttatgtagaataaaattgtgggctactcacagaaactaaaagagaatgatgggaaatagtcttttaacattttaccactgtaatgagtttttgtttgtttgtttgttatttaaaaaaaaaacctccrggtaatatcaattgacaagagtcaaataaattaataaaaagcacagactagtgctcctatcaacaagtttttagaaatttgttaccctaagctcttattctccagatgttattcagattctcagttccaggtctgcctagtaatttagtacatggcttgtttagcatagaagaactgtaaaaaatatagagctctgcccacaataagcctttcatagagactaagacattatattaaaactgttccttgggccaagatccttccagagcattctttggccatttacaaatttctttacat

SEQ ID NO: 66299 - DNA, 601 bp, Human
tgaaacaccgttaagtttatctttgtcctgcaaacgataacagaaaagcaacatgttgattttggcttattctgatacatctgcctggcatggaggaattggtcgggtttcaaaatgtcagaatttctgcttgttaatgagtggtttctttggtgagaattttatgtagaataaaattgtgggctactcacagaaactaaaagagaatgatgggaaatagtcttttaacattttaccactgtaatgagtttttgtttgtttgtttgttatttaaaaaaaaaacctccaggtaatatcaatkgacaagagtcaaataaattaataaaaagcacagactagtgctcctatcaacaagtttttagaaatttgttaccctaagctcttattctccagatgttattcagattctcagttccaggtctgcctagtaatttagtacatggcttgtttagcatagaagaactgtaaaaaatatagagctctgcccacaataagcctttcatagagactaagacattatattaaaactgttccttgggccaagatccttccagagcattctttggccatttacaaatttctttacatgagttcattacaa

SEQ ID NO: 66300 - DNA, 601 bp, Human
atcatctatttacctttctgttaaaattttatataaagctaagaaaattaagttacatattatacatttataggaggtaggaaccatatagaacatgctgacatgtacctggactcaacaattgttgccctgtagttgaagagagtttcagaaaatatctttctcaaaagttccagccttctttaattcatactttcctctgaatttctatggcatttattaaatgatgagattcacttagccttgagaaaatgtaacattggttagtgtatgttttttgtatgctgacctgaagtgtgtrgacagtgttatatgttagtttctaaactggcctctcagcttggcattcttctgtagctggcatgtcataactattgaattaccattttatgaggatcaggaaagttaaaagagagtgcagctaggagtccaacaggaggtggctcagattgataatttgctttcacaatgcataaaaacttcctatatggaaaacattagctgaaggaaaaggagaggcgtacttgtgaatctcaagtgatctctctaagatttgtaagacgagttgttttatgtgtactgtagttgttgttaaatccta

SEQ ID NO: 66301 - DNA, 601 bp, Human
agaaaatatctttctcaaaagttccagccttctttaattcatactttcctctgaatttctatggcatttattaaatgatgagattcacttagccttgagaaaatgtaacattggttagtgtatgttttttgtatgctgacctgaagtgtgtggacagtgttatatgttagtttctaaactggcctctcagcttggcattcttctgtagctggcatgtcataactattgaattaccattttatgaggatcaggaaagttaaaagagagtgcagctaggagtccaacaggaggtggctcagaytgataatttgctttcacaatgcataaaaacttcctatatggaaaacattagctgaaggaaaaggagaggcgtacttgtgaatctcaagtgatctctctaagatttgtaagacgagttgttttatgtgtactgtagttgttgttaaatcctaagccatacaacaaattaaagagtacaagtttatcaacaatactctgtgccatttggctcccttggttgatgcatgtggaataatctgtcagacaataggcattacctcttgtatataaggaactggatagaagccatggcttcagacct

SEQ ID NO: 66302 - DNA, 601 bp, Human
ggttgggggcaattgttggagggccttgataaatccaaaaactttggcattttaacctgaaggcattacacggcaattggagatactgagcaatagcatggtacattgaagtttaagccaattaatctggcagaggtttgtatatacaattgtaggtggagcagaaagaaaccaaaggcaattctgccaattaggaggctatttcagttgttcatatgctatgtgcattcacaaaaatggtagagagaatgggaaaatgatgaacaatgttagtggtattttgggggtagacttaattggstattaatggaatagagggaagaggcgaagaagaaactagaattttgaaaataatgatttcttaaaacaaattactcctcccctagaaaaaaatttagttgaaaagtaatctttccagcttaaaagagttttctcaggtcaaatgattctgctgtccacttgctatataaccttgatcaagttatttaaaatctctgtgactcatctataatgtgaattataatgctactcatttttagagggctgattattcattcagccgatattccataaattattttctagctcctgggaatagggt

SEQ ID NO: 66303 - DNA, 601 bp, Human
tttgggggtagacttaattggctattaatggaatagagggaagaggcgaagaagaaactagaattttgaaaataatgatttcttaaaacaaattactcctcccctagaaaaaaatttagttgaaaagtaatctttccagcttaaaagagttttctcaggtcaaatgattctgctgtccacttgctatataaccttgatcaagttatttaaaatctctgtgactcatctataatgtgaattataatgctactcatttttagagggctgattattcattcagccgatattccataaattattktctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatacggttcaggaggggttactttgggtaaagcttgaagagatggcctctccaaggaagtgatatttgaagtgagatgtaaataatgagaaggagccaggcttgcgaagagcgggaaaagcagtttagaggtaacaggaagag

SEQ ID NO: 66304 - DNA, 601 bp, Human
aaatgattctgctgtccacttgctatataaccttgatcaagttatttaaaatctctgtgactcatctataatgtgaattataatgctactcatttttagagggctgattattcattcagccgatattccataaattattttctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatasggttcaggaggggttactttgggtaaagcttgaagagatggcctctccaaggaagtgatatttgaagtgagatgtaaataatgagaaggagccaggcttgcgaagagcgggaaaagcagtttagaggtaacaggaagagcaagtgcaaaagttggcttatttgaggagcagtatagcagattttttaggaaatgcacacctacaaatgtaatacttaattgtcagtctgtaggtagaaatcatcgcagatttaaaagggtcacatgccctctagtgtcctctatgccttatttaatcctg

SEQ ID NO: 66305 - DNA, 601 bp, Human
taatgctactcatttttagagggctgattattcattcagccgatattccataaattattttctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatacggttcaggaggggttactttgggtaaagcttgaagagatggcctctccaaggaagtgatatttgaagtgagatgtaaatratgagaaggagccaggcttgcgaagagcgggaaaagcagtttagaggtaacaggaagagcaagtgcaaaagttggcttatttgaggagcagtatagcagattttttaggaaatgcacacctacaaatgtaatacttaattgtcagtctgtaggtagaaatcatcgcagatttaaaagggtcacatgccctctagtgtcctctatgccttatttaatcctgttaataggcttttccaagtgccatgaagaatgttgaaactgtgtatgtgtgcatttgttctgtgaaatgcattaatattt

SEQ ID NO: 66306 - DNA, 601 bp, Human
tactttgattctgttgtgtgggttgaaattctatctctccacccacaaaaaaattctgaaaaatgggtcttggaatttttttcttcatgagtcctagtcatcgccctcattttgtgcccatctccctagttttggagatgatggagagacaatagagaatagagtgaaaatgtggggatggtgcccacctccacacctatgtctgagttcttgtttgttctgtagccatattggtcttcccttctttcaacacagtgtgttgtttcttgttcaagggccttttgaaatacaatgcctcagstgggcgtggtggctcacgcctgtaatcccagcactttgggaggccaaggcaggcacatcacttgaggtcaggagatccagaccagtctggccaacatggtgaaaccccatctctactaaaaatataaaaattagtcaggtgtggtggcatgcacctgtaatcccagctacttgggaggctgagacaggaaaattgcttgaacctgggaggtggaggttgctgtaagccaagatcgtgccactgcagtccagcctgggcaacaaagagtgaaactccgtgtcaaaaaacaaaaaacaaaaa

SEQ ID NO: 66307 - DNA, 601 bp, Human
aacctgggaggtggaggttgctgtaagccaagatcgtgccactgcagtccagcctgggcaacaaagagtgaaactccgtgtcaaaaaacaaaaaacaaaaaaaaaaccaaacaaacaaaaagaaagcattacagtaactctttctggaatgtacctcctttctctatccattttctaacatctcattttaattttttttagtggttactcccaatgtcctgtcctacaaccaaccaaccttcctccccaaattaggccactgttagattaggtctcccttttaagggatactgatcccaarcaccctgtaattttctttcatgacattcatgatgtcataatctttgctgtgttttcttccattctttacgcttttgaccttaagagttgactcggagttgattgttgctctcttcccagtgtggtgtactctctagtacattgcgtagtatatacgagttgcttaatatttatttatcaaatgaattgagctaaaacaaacaggtactgtttagacataatacaggattttgggaagttggggaactctgaaaaatagaaaagtaatttcactagctagggttgagattagctatgaggg

SEQ ID NO: 66308 - DNA, 601 bp, Human
tgttttagaaagacaatggaacttgaacctttaccaatggctatgttgcatggactcaccagataccatgctttcggccaaattaatataaaaattgtttctttatactaatcagttgatggtctgcatttcatgtatatgttttttattagttaaaatggggaccaagttatttactaatgaataacatttgctgataaagtctttcagcactgtgtgtgtgaaaaataatgcaaatattggaaggaattgtaagatggaaccctggtactgactgttttgtcactttgagtaagttatrcaactattgtgggaatgaattccctcatctatataaaggggattaatagtattaattagacagatttgttgtgagagctagagaggacagcctcttaatgatggagagttatcatcagcaacagaagcagtagtagcatcattatcattatttttctttcgaaaccagaagtttaaaagaaaaataaagttaaggggttccttagttgtgaaccaattggaaagtactgtgttttttctttctttttcaacttttattttagaatcagagagtatatgtgtaggtttgttacaaagctat

SEQ ID NO: 66309 - DNA, 601 bp, Human
gtctacgtaccatggtatatatgtaccatattttctttatccaatctacaactgatggccacctaggttgattccacgtctttgctcttgtgaatagtgctgcaatgaacatacacatgcatgtgttcctttggtagaatgatttattttcctttaggtacatacccagtcttgggattgctgggtcaaatagtggttcaattcttagttcattgagaaatctccaaactggtctttacagaggctggactaatttacatacctcaccaacagtgtgtaaatgtccccttttctctgcagscttgccaacgtccttttctttttgacataacaaagccattctgactggtacaagatagcatctcattgtggctttgatttgtatttctctgatgattagtgatgatgagcattttttcatgtttgttagccattgtttgtcttcttttgagaggtgtctattcatgtcttttgttcactttttaatggggctatttgttttttgcctgttgaattctttaagttctttatagattctggatatcacacttttatcagaggcataacttgtgaatgttttctcccattctgtagcatgtct

SEQ ID NO: 66310 - DNA, 601 bp, Human
tgctcttgtgaatagtgctgcaatgaacatacacatgcatgtgttcctttggtagaatgatttattttcctttaggtacatacccagtcttgggattgctgggtcaaatagtggttcaattcttagttcattgagaaatctccaaactggtctttacagaggctggactaatttacatacctcaccaacagtgtgtaaatgtccccttttctctgcaggcttgccaacgtccttttctttttgacataacaaagccattctgactggtacaagatagcatctcattgtggctttgatttgyatttctctgatgattagtgatgatgagcattttttcatgtttgttagccattgtttgtcttcttttgagaggtgtctattcatgtcttttgttcactttttaatggggctatttgttttttgcctgttgaattctttaagttctttatagattctggatatcacacttttatcagaggcataacttgtgaatgttttctcccattctgtagcatgtctgtttacttccttgatagtttctcttctttcgtagaagctctttagtttaatttggttccacttatcaattttcgcttttatt

SEQ ID NO: 66311 - DNA, 601 bp, Human
gtagaatgatttattttcctttaggtacatacccagtcttgggattgctgggtcaaatagtggttcaattcttagttcattgagaaatctccaaactggtctttacagaggctggactaatttacatacctcaccaacagtgtgtaaatgtccccttttctctgcaggcttgccaacgtccttttctttttgacataacaaagccattctgactggtacaagatagcatctcattgtggctttgatttgtatttctctgatgattagtgatgatgagcattttttcatgtttgttagccactgtttgtcttcttttgagaggtgtctattcatgtcttttgttcactttttaatggggctatttgttttttgcctgttgaattctttaagttctttatagattctggatatcacacttttatcagaggcataacttgtgaatgttttctcccattctgtagcatgtctgtttacttccttgatagtttctcttctttcgtagaagctctttagtttaatttggttccacttatcaattttcgcttttattgcaatgctcttgaggacttagccataatttctttgcaaaggctccttatga

SEQ ID NO: 66312 - DNA, 601 bp, Human
tttcatttctgagacatttctcctgtctctctttctacctggtttccccaactcattgttgcttttaactataagatctgaggtcatggtttagattcatttgaagaccactttgcgtcttctggcatggctacagaaggttccagtaaacctgacacaggcaatcctgtggttaaattgcaaggacaccttcagtcttagaggacaaaaagaggaaaagggatagcaaaaattccagtgttcctccatcacactcgacatattccaaatgtagagattctgaatgccaagaacagcttgyttggtctgtgtgagtcgtggatgttttgtcatctaagcccgatgtactctcccacactttgcatcattactgagggataaaaaacaaaaacaaaaatccccccatagcactcagaaagtgcatctttatagtccgcatggaaaaagaaggtcagtggcacaaagcatttgatgccctaccacctcctcttttttccattcatcctgggtgaaggaagagtgtgtcttttctcccactcctacctagcctgtctgattcactctgttgcattgtcctcattggaaactgctttcctggact

SEQ ID NO: 66313 - DNA, 601 bp, Human
atcaggaaatgcccttgtcacctccacagctgtgccttgacaatttatgcagattacaagttttgtgggggactctttgctaagcatgtttctaccttttttttaaactatatcttcagcacttggttttttgctctaagctgcttgccattcaaagtcctagatatatgctactttcgttgaaaagattgttttctagtgtcctcttccttgtcgctctcttcaggattataagtctataagggagtataggacaaaaactgtaaacatagatagctgtacttttttcggggaactggcttaattctggaagatgtcaacatattggcacattcaggaattaccttcatgatgctatggactgtgagtaatatgtagttatctgaaacagtttctgaacatgaaaggatataataaattcaaggcatacttcttggataaatccttctaaaagacttagttttctaaggggagttttggttaaaatccaaagcaaaccaagcagagaactacccttttattgttctatctgtccacaaacagattctgcttctgcggtatccacctcagaatagcttaaaatgttcttaattatgtccct

SEQ ID NO: 66314 - DNA, 601 bp, Human
caaagtcctagatatatgctactttcgttgaaaagattgttttctagtgtcctcttccttgtcgctctcttcaggattataagtctataagggagtataggacaaaaactgtaaacatagatagctgtacttttttcggggaactggcataattctggaagatgtcaacatattggcacattcaggaattaccttcatgatgctatggactgtgagtaatatgtagttatctgaaacagtttctgaacatgaaaggatataataaattcaaggcatacttcttggataaatccttctaaargacttagttttctaaggggagttttggttaaaatccaaagcaaaccaagcagagaactacccttttattgttctatctgtccacaaacagattctgcttctgcggtatccacctcagaatagcttaaaatgttcttaattatgtcccttagttctgttaaaacaatcacaaagcttaccaggcttttatttttgaaaatagatttacatttacatgagttggataaaaaaaaattgtgaaaatgaacttcatccgagctgtcaccatcaatctttattatttttgaaaacaattggccag

SEQ ID NO: 66315 - DNA, 601 bp, Human
ttttctaaggggagttttggttaaaatccaaagcaaaccaagcagagaactacccttttattgttctatctgtccacaaacagattctgcttctgcggtatccacctcagaatagcttaaaatgttcttaattatgtcccttagttctgttaaaacaatcacaaagcttaccaggcttttatttttgaaaatagatttacatttacatgagttggataaaaaaaaattgtgaaaatgaacttcatccgagctgtcaccatcaatctttattatttttgaaaacaattggccagatagaaawactggtaaaaattactgagaatgtcttgaagtgggtttttgaagattaaccaataagatcagctgcatatctcattacctaacaagtcctcctatgtccattaatctacttatgtatggatagataagcgtttatccacttattcatgcagaaagaacttatcactgtccactatgcaaggactggttttcagtaatagtaatataggatagtattagtaataagtcatatctcaagacgtgtcttgaacaatttgctgaatttctagaagataatcggcaatgtagtacagaaatgatt

SEQ ID NO: 66316 - DNA, 601 bp, Human
aatgattgtaattgtatctaccgtttacttctatgaatgttggccttgtgtggaaatagacaaaaatagatacctgtctctgacaatgaagttacaaaattgaccacaaaagtagatgcaaatgggtaggacattgtcagtgttggtgagtgcaaacttgtatctccttcagtgctaaatatcacactgttaggtattttcagttttatttttgaggacttttcagaaagaagtgagaaaggcttctactacttcttaaaatctcattctcatagtcactaccctatagattctgaacaaygcatattagaatcacatggataacttctagaaaactacctccataagaaattctgatttcatttgtctgaagtgaggcctgataatccacatcttaacatgcatcccaataatcactttcatttccccacatgaattctttttcttcaccaccatgaaaatacacaattgttcttaaaactgatataatacatttttgagcatttgtctatatttggtgagagagaatagatactaatgaaacaagattcctgctctcaaaaagctcccagacttggagttttctgaaatgtatgacgta

SEQ ID NO: 66317 - DNA, 601 bp, Human
actacctccataagaaattctgatttcatttgtctgaagtgaggcctgataatccacatcttaacatgcatcccaataatcactttcatttccccacatgaattctttttcttcaccaccatgaaaatacacaattgttcttaaaactgatataatacatttttgagcatttgtctatatttggtgagagagaatagatactaatgaaacaagattcctgctctcaaaaagctcccagacttggagttttctgaaatgtatgacgtaaatccaggctctgtagctatttatgctgtgtgascctggacaggttgctcaatctctctgatccttggcaattaaactgcaaagggagaaagcaaatatttttcttcataaggttactagaagcattaaatgagataaagtgctcagtagaaagtaatgttgttcctattattcagtatttattatcaatttaatgtgcataacatacaattatatgcgatatatgcagtgcatgtacatatacatagttatgtatacataattgttgtgtgtatgtgtgtatacatacacacatacacattaaatatttgttactttcacacagagaaacata

SEQ ID NO: 66318 - DNA, 601 bp, Human
cgccttggcctcccaaagtcccgggattagaggcgtgagccaccgcgcccggccatgatatgtatttttaatgtagtctttgaaactagcagaaaagaaatatatatctctctatatagagagatatacggatatatattttacttcagaatgctgaccgagttataaaacaagtaaatggttccttataacacattagctatgagaaagtatgtttatttttctaacatggtatgatacataaacatggctctccgggtctgttctggaagtcattagaaagagacaacatatttggtawgcacattttccttctgtctcccttttctcctctgttaaatgggttatgtgtacccctacctactctacctacctaacacatgttacagccaatggcatgatctccatctgtgaatcagcagtgcatcccggaaaaaagagagcaaaaatctggtgggaaattggatgagagtgaggtaattggaacactgagagaaggattctaacatccacaccacccctggtgcagtcaaccctctttagcctggaccactgcaatagcgttcagacgggcctctcctatccctctcgcatttgtgta

SEQ ID NO: 66319 - DNA, 601 bp, Human
ctgccctcaagtgatccgcccatcttggcctcccaaagtgctgggattacaggcgtgagccaccacacccagctttcagtatgttttcttagcatcctttattagaataagcttaacaaagatatattattaaatatagatagataatatagattattaaaattgcattgtaataagaaatttgaaatgtagcatatgcagagaagacctgttttttgcttcagagtgtcaaagataattgggaaataaaacagctatataaatggacatcagaggagaaataaaaataacactgagagcrtagataacaaaaccacaaaggtgaagaaattctagcaaaaatagctgctatcagagatcaaatactcaaaatgaaaaagaatagattaggcaagattaaatccccttcctgaagacctgtttgggtaatggatagacagagaagaaaaaaatggtaaatttgagatttgagaatgaatttatggtgaagatactgagtgactggataatggaatttcttgtgaaactgagttaaagatctagaaaaggtgtagaggggatgggggtgtctctaaatggagaaatagacaaaaataaaata

SEQ ID NO: 66320 - DNA, 601 bp, Human
tcttaaaatctggaggccactaatgtgactttaacattaattaattttctttttctgatctcactataataaactggctagatactagggagaatgaatcacaaagtggcagaaaagagatatgggtgaacttaaaagatattggaaccaagaaaagagggcttttaagacaaatgaaggaatgaacagaatcagaatgagttacactattgccagctttgcctccctacacatatactatagataaggcgatgacttcatgaaaccaaagtgttggcaacttaggaatggttctgtataygaggcccttctacaaacaagcacatcactggaggctgagctgaattgaaaacaattaggaaatataagttagacttatcaatgaggagtgaatattggtgttcctttaacatcattttttagcttaaaatacaaaaggcacaggaaggtgtttatcagaaaactcatagtttctcactgacatgaagtgatatggatatgcaggtaagattctgaaatactaaagatatttgtgcaagcaggaacatatcattgcacacagtgggttactggagaaagaaaaggaagtggctgagggatc

SEQ ID NO: 66321 - DNA, 601 bp, Human
ttctttttctgatctcactataataaactggctagatactagggagaatgaatcacaaagtggcagaaaagagatatgggtgaacttaaaagatattggaaccaagaaaagagggcttttaagacaaatgaaggaatgaacagaatcagaatgagttacactattgccagctttgcctccctacacatatactatagataaggcgatgacttcatgaaaccaaagtgttggcaacttaggaatggttctgtatatgaggcccttctacaaacaagcacatcactggaggctgagctgaatwgaaaacaattaggaaatataagttagacttatcaatgaggagtgaatattggtgttcctttaacatcattttttagcttaaaatacaaaaggcacaggaaggtgtttatcagaaaactcatagtttctcactgacatgaagtgatatggatatgcaggtaagattctgaaatactaaagatatttgtgcaagcaggaacatatcattgcacacagtgggttactggagaaagaaaaggaagtggctgagggatccacatagctgaagatttgtgccatagtttgtcataagaaaacacat

SEQ ID NO: 66322 - DNA, 601 bp, Human
gaatgaatcacaaagtggcagaaaagagatatgggtgaacttaaaagatattggaaccaagaaaagagggcttttaagacaaatgaaggaatgaacagaatcagaatgagttacactattgccagctttgcctccctacacatatactatagataaggcgatgacttcatgaaaccaaagtgttggcaacttaggaatggttctgtatatgaggcccttctacaaacaagcacatcactggaggctgagctgaattgaaaacaattaggaaatataagttagacttatcaatgaggagtgratattggtgttcctttaacatcattttttagcttaaaatacaaaaggcacaggaaggtgtttatcagaaaactcatagtttctcactgacatgaagtgatatggatatgcaggtaagattctgaaatactaaagatatttgtgcaagcaggaacatatcattgcacacagtgggttactggagaaagaaaaggaagtggctgagggatccacatagctgaagatttgtgccatagtttgtcataagaaaacacatatcatttgagagaggtggactaaacaaatagaaagtagttctagt

SEQ ID NO: 66323 - DNA, 601 bp, Human
ggtgggtggatcacctgaggtcaggagttcaacaccagcctgaccaacatggtgaaaccccatctctactaaaaatataaaagttagtcaggtgtggtgccacacacctgtaatcccagctactagagagcctgaggcgggagaattgcttgaacccaggaggcagagattgcagtgaactgagatcgtgccactgcactccagcctggatgacaagagtgaaactccatctcaaaaaaaataaataaattaaaaattaaaaaaattttaaaaagaacataattacaaaagtgagttttaygtatagataatgaaattggtttataattttcttctatgttcattaactgttcagatagtaggaaaactttatgaacattaaagctttgaaagaagtcaactagtatagtctgggcaaaaaatgattgagaaacacagagttaaagaaagaagaagactttgtgccccagagaaaatgtttggagcctattagatttatagagaacacaatgatgaagctatggaaagtgtgaagagaaataggaagaacagggaatgatgatcttggggagaaagtttctgagagagaaatatgaaggct

SEQ ID NO: 66324 - DNA, 601 bp, Human
aattgcttgaacccaggaggcagagattgcagtgaactgagatcgtgccactgcactccagcctggatgacaagagtgaaactccatctcaaaaaaaataaataaattaaaaattaaaaaaattttaaaaagaacataattacaaaagtgagttttacgtatagataatgaaattggtttataattttcttctatgttcattaactgttcagatagtaggaaaactttatgaacattaaagctttgaaagaagtcaactagtatagtctgggcaaaaaatgattgagaaacacagagttaragaaagaagaagactttgtgccccagagaaaatgtttggagcctattagatttatagagaacacaatgatgaagctatggaaagtgtgaagagaaataggaagaacagggaatgatgatcttggggagaaagtttctgagagagaaatatgaaggcttataattattcagaagtatgttatagaaaggggaagataaaacaaaggaaaagcaatataaatagcaaagctttgagtcctaattcagtcatggccttgtctgaggatattatgatggttgtgttttgtgatcagaggagttc

SEQ ID NO: 66325 - DNA, 601 bp, Human
gatgaaaaggcccttaccaggtccccttagagaagggtaaaaccctcacaataatgtcacaggcaaacatgccagtgaatttatccgtttgatttctggccccctacatttccctagccaggtctgtctcacagtgtcaccctgaaacttctctaccttgttctgttggatccactatttactggatcagagtcttgtgtagattactccctcaatttccagagctcatcctgagaaaatcagtaattcattcatccaacatatatttattcaacatctattatgaaacaaaaagggttcyaggaaataaggatgtatcagggaacaaaacaggagatccatgactctctaaaggacttcatatttatgtgtgtagtgtgtagcctagccatatacaatacagagtgctctattccatttgaacttcagacaatgaatacttttcagtaggaatattttctaaatattgtaaaggatatacttatactaagaaaatgttcattgtttatctggattccaatttgactgtgtgtcctggtatttttatatgctaaatatgacaaccctagctgggagggattagactgtaccagaaaaccta

SEQ ID NO: 66326 - DNA, 601 bp, Human
gggggcatgggatagtttttttttttattatttaatgttaggaaaataaaattaaaaggtctcaaaaatgtgtattcaattcagtaaaacatagatagtgacttacgtgacatgatgtaataaatcactgctgtatcaatatattaaatgatacacggaccattaaatattgcattcattattaggaaaataatttttgaaataacacagctccttaattctaaggtcatatgctagatggggaataaagatgtggtttctagcctggctctggtgaaccacctatgtgacctctcagacygtgcatctgtgcaacattgccagtgacctcgatgtttctttttaatcctcttaatttcaacagggcatattcgtagattacttggcacatagtaagcactctactattgtatgactctatgtcattcaaggaaacactttccctcttactgtcacatatgaagaggttttctaattaaaacacataattaagcatcacagtaagacaaagtcatgaaacaaaatgctcttgattaagaatgggagtgtttcttctcattactgagagaaaatataaaaaaaaaagcaaaaagacaacttt

SEQ ID NO: 66327 - DNA, 601 bp, Human
ctatcacaaggacagaaaaccaaacactgcatgttctcactcacaggtgggaattgaacaatgagaacgcttggacacagggtggggaacatcacacatgggggcctgttgtggggtggagggaggagggagggatagcattaggagatatacctaatgtaaatggggagttaatgggtgcagcacaccaacatggcacatgtatacatatgtaacaaccctgcaggttgtgcacatgtaccctagaacttaaagtattaaaaaaaaaaaaaacccaagctgagctaagattttggtcacrgtcttttttttcccccttcagaattgagaaatgttgcttaagtcagtaatggatcgccttgactttgctatgatcagaggcacagtaaggaatgaagccaattgttaaaaatgatgacagccataataaaacctaacatgcaaaaactactgctttgcaacttatagtgttggaggctatttgtagcaactcttttatttcttatcaacaacaaaaataaagaaaaataacaaacaccaacataggactaaatactcgatattcaatatagtcatgtactctataacaatgtttcagtca

SEQ ID NO: 66328 - DNA, 601 bp, Human
tatgaccctaatatcttaatcccaagcttgaaaccttcaaacagcttagccactggctttcttagcaaattataggttactaattagcaaggtctaactgagacgtcagcaagaataactcagaattgaaaatctgtttactagagtatatccccagacagggccacctatttcatggagagaggttgtaaggtttgctgtggaaacctcataatattgacctaaaacccttccatctcccaagagtagccaaaatgaggcatgaggaaaggtaatggattccacaattactcctcatcartatgaaatcaatattcttctttgaagatgtagaaagtcctttctgttttaagtattatgggtaagtacatgaatcatggatgcttacacccttgtcaaatacagcatcaaggaagcattcagtgaaaggcaatagtgtatttatgtatgttttcatttttttcagtgtagcttagaaacagaaaagcaaagaaaaaagaaaaaacgactccttcaaagcaagagagaagcattttacagttctgataaatttataaggacccaagctgcagagcactgactaggtccatagagaagatca

SEQ ID NO: 66329 - DNA, 601 bp, Human
tttactagagtatatccccagacagggccacctatttcatggagagaggttgtaaggtttgctgtggaaacctcataatattgacctaaaacccttccatctcccaagagtagccaaaatgaggcatgaggaaaggtaatggattccacaattactcctcatcaatatgaaatcaatattcttctttgaagatgtagaaagtcctttctgttttaagtattatgggtaagtacatgaatcatggatgcttacacccttgtcaaatacagcatcaaggaagcattcagtgaaaggcaatagkgtatttatgtatgttttcatttttttcagtgtagcttagaaacagaaaagcaaagaaaaaagaaaaaacgactccttcaaagcaagagagaagcattttacagttctgataaatttataaggacccaagctgcagagcactgactaggtccatagagaagatcaggaaaaatataaaactgtctttgcaataattggaaaatccaaacaaactactaaggctgatacctaggagaaatcttccaagagaaagaaacctctgatatctgattttactattagtaatgtcccattcttaagg

SEQ ID NO: 66330 - DNA, 601 bp, Human
tggcatttaattgtctggtgtcatctgttccttgcctaaaggtcagtttgctgaggaagaaactcagataagaccaatttaagtttcaagtttaagacaagggagggtcaatttccatatttatttattattattattatcattattatttgagatggagtctcactctgtcacccaggctggagtgcagtggcacgatctcagctcactgccacctctgcctcccaggttcaagcaattctcctgtctcagcctcccgagtagctgagactacaggcgcctgccaccatgcccagctaattttttttttttttttttcagtagagatggggtttcaccatattggtcaggatggtctcaaactcctgacctcaggtgatccacccacctcggcctcccaaagtgttgagattacaggcatgagccaccacgcccgaccatatttatttttaaaagtaaatattagttctatgcgacacttgagccaatttcagtactactgggagggccaggaaaggcaaagtagttacaagctaaatcctctttttatctgctttatatttcaggggttctcattgagattttgtttaatgagtatgtt

SEQ ID NO: 66331 - DNA, 601 bp, Human
tgaaaacaggaattagggaagggtaaggaagaggaattggtcaacaggaagcacatggtctattaggcgatcacaacagatgaggggtctcatgtctcattgtccagatgcggtgttctggtaagtttcagctccttgatactatctgggaggcctgatggttggtttcctgagaagggaactcaaataagacaactgtaattttcccaaattttaagactgggagggtcaatttctatatttattcaaaagaaaccacaaacatcatttctatgggacagtagtgctggtttcactttcygttctaaatttctcatactctaaatgagaataaccagtagaaatacatttaattcttataaatcaaatagctttaattactatttttcattaaatttttattagttggtacaatatttgattttgaaaactgcttcatgtcaaccacataaatgaagttctgtgaaacccccaaatacacatggagaaattttagatacaggcatatagaaagcaggtccaaaacctttatcaaaacctacatgaaagtggtaagaacaagtggtaagaatacaagtcatctcccactggctgggagtca

SEQ ID NO: 66332 - DNA, 601 bp, Human; identical to SEQ ID NO: 32236

SEQ ID NO: 66333 - DNA, 601 bp, Human
acgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacaggtaggaargagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtc

SEQ ID NO: 66334 - DNA, 601 bp, Human
ccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacgcgcgcacacacacatgcagacacacatgcatacgctctctctctctctctctcwcacacacacacacacacacacacacacacacacacacacacacactgactttagaaacagcgggccttcctatcagaccagagatcctaatgcacctgttccactttggtttgcccgaaggcattcgagacaaacacttctgacgtgaaatatttatgtaaacatgtaagatggtttactgagaaacacgtttaagacgaactcctgtgaactagataaacggaggtacacgctcttcaaaaaaagaaggcaaacaatataagttatgaattgaaatgcagtaattaatttggggaagag

SEQ ID NO: 66335 - DNA, 601 bp, Human
gacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacgcgcgcacacacacatgcagacacacatgcatacgctctctctctctctctctcacwcacacacacacacacacacacacacacacacacacacacacactgactttagaaacagcgggccttcctatcagaccagagatcctaatgcacctgttccactttggtttgcccgaaggcattcgagacaaacacttctgacgtgaaatatttatgtaaacatgtaagatggtttactgagaaacacgtttaagacgaactcctgtgaactagataaacggaggtacacgctcttcaaaaaaagaaggcaaacaatataagttatgaattgaaatgcagtaattaatttggggaagagaa

SEQ ID NO: 66336 - DNA, 601 bp, Human
tatatctttctgtatcttgttgataaaacagtgatgttgactgtatgtggccttattttaaatcacaactatggaggagcgctgttgtttataattaacaaagaagaattgacaagaattagctttgtccatgccatctttagacaatcatcaccttttgaatccagggcaaatcattcagcagagtgtcctattttctcatttttgccctgtcttttgtaatcatcagccatttgtcactgatattattatgaatgttggcatgcctggcggatgtcatggtatgaccgattctcagaaygactacaaaaaaggacttctagcagcatgagtataaaggagaagttacctgtctgaatggctgtgggttgcagtagcattttagcttgcgaaaatattgaaaatagaaaagagactcatgcagattgcaaaccatatttgttatatttatagggtccgattaaaggaagatttgtagggtatgttttaagaaatatcaaaacctaaagtagtcttcgtggttagaggaaacgcttttatggtgtgtgtgtgtgtgtatgtgcatgtgtgtgtgtgtgtgtgttcttgtgcatacacacgt

SEQ ID NO: 66337 - DNA, 601 bp, Human
ccaggcgtggtggctcacacctgtaatcctagcactttgggaggccgaggcgggtggatcatttgaggtcaggagtttgagaccagcctggccaatgtggtgaaaccccgtctctactaaaaatacacaaaaaaattagccgggtgtggtggtgcatgcctgtggtcccagcttcttgggaggctgaggcaggagaattgcttgaacccaggagatagaggtggcagtgagcggagatcgtgccactgcactccagcctgggcgacagagtgagaccctgtctcaagaaaaaaaaaaaaaagttgattagcagcttacaccagtaacagctgatttatgttaatccaaatgcaaggcactgaatgagttgaaatgaaaaaaaaaaagctttctccatccagatataaccagaattttacacacctagtgcagaatgaccatgctcacaagctgggatggaggcaaaccttttgcttttgaattaaaaacctcttcaaagggcttccagcaagagtagaatccactgcagttccccttagtgactgagatggggtgtgacagtggcacctgtcctgtccccatgtgccctctggggtagcgc

SEQ ID NO: 66338 - DNA, 601 bp, Human
gtctcaagaaaaaaaaaaaaaagttgattagcagcttacaccagtaacagctgatttatgttaatccaaatgcaaggcactgaatgagttgaaatgaaaaaaaaaaagctttctccatccagatataaccagaattttacacacctagtgcagaatgaccatgctcacaagctgggatggaggcaaaccttttgcttttgaattaaaaacctcttcaaagggcttccagcaagagtagaatccactgcagttccccttagtgactgagatggggtgtgacagtggcacctgtcctgtcccyatgtgccctctggggtagcgcctttgagtctgaggattcagtttaaagatagtcaataggtttttcttctgagtccaaggaggactcaggtcagtggaaataaggaatgttgcttgcatgtgaaatgaggttgataataaataaagtaactgcgtgttgctgtgcactttaggtggcgccatatctaacatgtatgccatgatgatcgcacgctttaagatgttcccagaagtcaaggagaaaggaatggctgctcttcccaggctcattgccttcacgtctgaacatgtatgtgtttct

SEQ ID NO: 66339 - DNA, 601 bp, Human
tgaaatgggtttggacccctaaatagttacatgttattacattctcagcctcaaaaagtccagatgatcttttattgggcgtctttttcttttggcttccaagctgcgtccacaagttaaaatgagtttggtccagcagcaagccactctgtgctctctgccaggcatctctggtttgggcatgagcttctcagcctcatgctttatgtaaattgactgagacttgatcaggccatgtggtctgaggatctaaaaataacaattttgctctaccttcttttcctgatactgtaaactcagwctactttttttttttttttttttttttgagtcagagtctagccctgtcgcccaggctggagtgctgtggcgtgatctctggagtgcagtggtgcagtctcggctcactgcaacctccatctctggggttcaagagattcctcctgcctcagcctctggagtagagtagctgggactacaggcacgtgccgccacacctggctaatttttgtatttttagtagagacagggtttcaccatgttggccacgctggtcttaaacttctgacctcaggtgatccatccgccttcacctcccaaa

SEQ ID NO: 66340 - DNA, 601 bp, Human
tggctcacgcctgtaatcccagcactttgggaggctgaggcaggaggattacttgaggtcaggagtttgagaccagcctggccaacatggtgaaaccccgtctctactgaaaatacaaaaattagccaggtatgttggttggcgcctgtaatcccagctactcgggaggctgaggcaggagaatcactggaacccgggaggcagaggttgcagtaagccaagatcgcaccactgcactccagcctgggcaacagagtgagtgagactccgtcaaaaaaaaaagacaaaaaaaaaaaaaaaatcccaccttgttttacagatgaagacaccaagccccagaggtgggggatactttgcccatggtgtcacagccagtcaatggcagagcaagattcgaagcctcagtaatttctcaataataccaacactgctctttataaactttttttgcattcagtgtattttattgaattgaaaaatcattcctttgatgtgtcatctaaggataggctctggaatcagacaaacacaggttgaaatgtttggttttatcatgtactagttgtgtgacactggacaagttacttaatctcgctatgcc

SEQ ID NO: 66341 - DNA, 601 bp, Human
gatgaagacaccaagccccagaggtgggggatactttgcccatggtgtcacagccagtcaatggcagagcaagattcgaagcctcagtaatttctcaataataccaacactgctctttataaactttttttgcattcagtgtattttattgaattgaaaaatcattcctttgatgtgtcatctaaggataggctctggaatcagacaaacacaggttgaaatgtttggttttatcatgtactagttgtgtgacactggacaagttacttaatctcgctatgcctcagttttctgatctggsaaaggaaagtcatattaatgctcctctcataagactgttgggagggttcaattagacaccatcactgaagagattagcatagtggccagcccaagactgctctttcaactactgggttggatgtcctaaacgcttctctctggctagctgctctaaattcacttgtagcatcctttcttaaatcccattttccccatgttgattattcttttttttttgagatggaatctctctctgttacccaggctagagtgcagtggcgccatctcagctcactgcaatctctgcctccctggttca

SEQ ID NO: 66342 - DNA, 601 bp, Human
tgcctgtaatcccagcactttgggatgctgaagcaggtggatcacctgaggtcaggagtttgggaccagcctggccaacatggtgagaccccacctctacaaaaaatacaaaaattagcagggtgtaatggcggcacctgtaatcccagctacttgggaggctgaggcaggagaatcacttgaacccgggaagcaaaggttgcagtgagctgagatcgcaccactgcacttcaggtgacagggcgagactccatcacacagacacacacacacacacacacacacacacacacacacacacacaagaaaagaaagggattgacatgaattttgttcgaagatttcacaatgccacttgaggtaaggagggagacctgaggacagtatcacattaggtagaaggatgggaggataggaaaggctaccctttttggggatagcccaaaaaatgatatgtaaggcacctcacatgccacagctacacttctcacatcaattctgccaagagaggacttcatcattgcacctgagcaaatcatggctcagcatgagaaagtaatttgcctaaatagaagcaggtgtcaaaccctcatcattgtgc

SEQ ID NO: 66343 - DNA, 601 bp, Human
atcctgggtaattgctcctcatttaagaacccctattctttctcattaaagactagacaagaatacgtcctcccattgaccaggtgcaccagatctcttacttatccccagttcgcctttttgcagtttagtgcttaagagctcattcacagaggggtgtaatttgagtggcttgcatgtacttagttggggcagctggctgtctcttcccttctggctgtaagagacttagcttgcctctgagctccttctctttggggtcgcccagggctctgccaaatgcacaaaaaacccccccccyttttttggtgggggaggtcatgcatctttacaaaccttgatctaattaagctttctcctctagttcctaggtatcacggtaatgactgtccactttgtcattcttaggttgtaaaatgaagctaatggccctttctcattgcttctagctgcactgagcttgtcaaactccacagctccaggtctccttgattggtcatcattatttgctgctgttataaatgtgatttcttcttggtgattagacataccccctaaaaatacatgtgttaagagttcctgtgctgtgtgtttgagaatt

SEQ ID NO: 66344 - DNA, 601 bp, Human
ctagtagctgggactacaggcactcgcaacacgcctggctagtttttgtatttttagtagagacggggtttcatcatattggtcaggctggtcttgaactcctgacctgagatgatccgtccgcctcggcctctcaaagtgctgggagctgcctcatatttttaaggctaccagtgttcctcagtagccggtacttaagaactgagatttgaagagaaaactggagtttaaaaatgtgaagaataaatgtttagatgactttaaaactttcttaatctgtagttgatctgttatgggtgargagcctggagttgagggaagaatcacctagagggccgtggcccgctggcctaggcagtcttccttgctagccttggtagctggcgttctccagtgaaccccagggggctgagaggtgactggcagagcagtaggggctcttgactctactcttcaaagcatcggcatcactgctcctactcctgtgaaaatcaggtgtgaccgcagaagtggtcttggatgagtccaccaggccagctaggcggctcatcatgggaacaaggggcctgcctgaggacatctgcccatctaaaggcaacac

SEQ ID NO: 66345 - DNA, 601 bp, Human
aagcacagaaatttgttgggttttttttccttttttttttttttttttttgagacagagtcttgctctgtcgcccaggctggagtgcagtggtgtgatctcagctcactgcaagctccgcttcctggattcacgccattctcccgcctcagcctcccaagtagctgggactacaggcgtccaccaccatgcccggcattttttttttgcttttttttttttttttgtattttttagtagagatggggtttcactgttagccaggatggtcttgatctcctgatctcgtgatccacccaccycggcctcccaaagtgctaggattataggcgtgcaccaccatgcccagcctcatctttctttttctaattagacatgataacatgagtatttttccacatgattacaaacacaaacacacttaactgtataacattttacatatgaatatgtcagaaagcattacagtacatttagagagctggctttggagctggctttggagctggattatttaaattccaatctcagctccagcactagcctgggcaaatgcctctctgtgcctcagtttctttatctgaaaaaacaaaaaagtaatg

SEQ ID NO: 66346 - DNA, 601 bp, Human
gtatataaaatccaatattacatattgagtgtaatattgtatgtattaattatatatgtatgtatatatgcatattatatatatatagagagagagaaccatttgcaagctccttgcagacatcacgctgttttaccccttaatatctcaatgtatgtttcctaaaaacaaggatattcacttacacaatcacaggccaattatgaaaatcaggaaatgtgacatagatagaatactattattaaatgtacataccttattcgtttcttcagttgtcccaatagtatccattatagctatytttcccagtccgggatcacacgtggcatttagttgtcatgtctctttggtcccctttaatctgcaatgtttcctctgcctgcctttgtctctcatgacattgatgttttttatgagtagagaccatttagtttgcaggtgatttggattcatctggtgttttcccatgattagattcaagtgatgcatttggcttaggactttcaggaggtgaagtttggctttcttgagtgcatctcatctggaggttggtctcattatcagtaatatcaactttgattttttggtgaaggcagtgtct

SEQ ID NO: 66347 - DNA, 601 bp, Human
ctctcatttattatcagtatggactcaaaactatttttagaaattaatatgctcggctgggtgcggtggctcatgtctgtaatgcagcagtttaggaggctgaggcaggcatatcacctgaggtcaggagttcaagaccagcctaaccaacgtggtgaaaccccatctctaccaaaaatacaaaaattagccaggcatggtggtgggcacctgtaatcccagctacttgggaggctgaggcaggaaaatcacttgaacccgggaggcagaggttgcagtgagccaagattgcaccactgcmctccagcctgggagacagagcgagattccgtctcaagaaaagaacaaattaatatgctctagcaccttcttccactcattctccctgctctcttccattcacctctttctcctcccctcagggtacccctgccattatctgaattactcataatttgttgtaaaaccttacagaaaataaatctgaccaagacgcatgatacctagtggcataggactacaagagtcattggctttcctagctcccatgtaacacaagaaatctgttagccattttgattaatacttttatacctactac

SEQ ID NO: 66348 - DNA, 601 bp, Human
tgaatttccttcaggattataatttctaatattatatttaggattattatagctacatttgtaaaatgtatctataggtttctctgggctatctctgacacgttttgctttcagaattatctagcttcagaaaattcattctgcagctttccattgtcttctctataagagtttaaagagcattatatgttattagtaaacttgctaaaatttactatctgggcctggcattttgaggtgggggcagatttttggtaacttttctcccacttatttcttggttattagtttttttttttttcaatttttctatatattattgaatcaattcttgtaatttacctttcccagggaaaaattatttattttctcaaaaactttaagattattataaagctttacatagaatgctttaaaatattaaaatatctttattcataacatctctttcatttcaaatgttacgttttctctcttttatttattggactaatcagatatttgtgtatctgttgatattttcaatgtcccatcttttgaatttattaagtttactttttatttagttttctaattcactaaaaaaaaattccttgtttct

SEQ ID NO: 66349 - DNA, 601 bp, Human
gaagagggacggtagtttggggagaaggaggagtaatgtgaggtggtcagcacaccttcttgcccatacatatacctccctgtcagctctaatactacccttcaagggcagcagtaaggaggtttcatatacaaaagaaaatatctccttaccatatcatgattggagtctcagttgcacatcacttgcattgttgtatagtcatagtatgtgtgctaagtaaatgcttttggagaaagtcaatgggaagaataaatattactagaattatacacaaaaaatcacccaaaatatccttctyttataacctgaaaataatgctaagtgattcaattgtgcacattggaaaacaaatcctaaaagagaaaaatatcattaatcattatagttaaagttctttttccaaatccaactatgtatttggattcactatttatagcaaataggaagttcactatttataattatggtaaaattctttgcaaagggcctggttttgtaatacaagtacttcttaaatggtcagttttgacttttgttagtttatttatcttaggggcctaagacaggctacccatgttggtatcagctatgtaaagac

SEQ ID NO: 66350 - DNA, 601 bp, Human
attatggtaaaattctttgcaaagggcctggttttgtaatacaagtacttcttaaatggtcagttttgacttttgttagtttatttatcttaggggcctaagacaggctacccatgttggtatcagctatgtaaagacacggggagctcttttccccaggagaaatctctggtaatttttactgctcctgtgcaattcatcttcaacaattttttccccaagtcagtctatgcagtttctgtagtcactacgcagtctgtgcaatttgaaaattcacctgcatccattaactctccttgcyatcttgataggatagttttgcctagcactgactagttaaaaagcaaatataaacaaacaactagcaggttttttttactgctattgcgtttgaatgctacactaggtagaacaacatcctcaaatatgttttagggtgaggttacgtgcttttattatttactagccaatgctgatagcagtaattggggtcactggaccgctcaatccagggggcttccagaaaaccacatggacattttgcatatgtcattacaatcctagaagtcaacctgaaaagtttttttgttaagtcggggta

SEQ ID NO: 66351 - DNA, 601 bp, Human
ctcttttccccaggagaaatctctggtaatttttactgctcctgtgcaattcatcttcaacaattttttccccaagtcagtctatgcagtttctgtagtcactacgcagtctgtgcaatttgaaaattcacctgcatccattaactctccttgccatcttgataggatagttttgcctagcactgactagttaaaaagcaaatataaacaaacaactagcaggttttttttactgctattgcgtttgaatgctacactaggtagaacaacatcctcaaatatgttttagggtgaggttacrtgcttttattatttactagccaatgctgatagcagtaattggggtcactggaccgctcaatccagggggcttccagaaaaccacatggacattttgcatatgtcattacaatcctagaagtcaacctgaaaagtttttttgttaagtcggggtagttgtacagtgccaagaatctaggttttgttatcagacagctctagatttgaaatctgcctcctgctagctgtgtgacattctgcaagtcatataatgctaataacaacaataacaatactactgctaataacaatgtaacaatgt

SEQ ID NO: 66352 - DNA, 601 bp, Human
gagacagagtctcgctctgtcgcccaggctggacagtggcgcgatctctactcactgcaagctctgccttcgtgttcagaccattctcctgcctcagcctccagagtagctgggactacaggtgcccaccaccacgcccggctgattttttgtatttttttagtagagacggggtttcactgtgttagccaggatggtctcgatctcctgacctggtgatctgccggcctcagcctcccaaagtgctgggataacaggcgtggagccaccatgcccggcccagatttcaagcttttaaccrtagtcaactgcctctctgaacctcggtttcctaatctgcactgtaagtgcaaaataactctcttgtagggtcgggaggaggagcagggatcgcacagttactgcttctaaaactggtcatttatcgttgctgctgatagtgctgctattatgtaaacttagtcaatttctagcaggaaggatgtacgcatactttcttctttgcactcacgtttttaggaatagagctaagccctactcacttaggaaaggctgatagtatctctagtttcagcagggccaatgaacggggtcaactagt

SEQ ID NO: 66353 - DNA, 601 bp, Human
tttccaaaaagccttttaaaaacctagatcaatgaccctgatgcaaagttggctatgttagcaacctccagagagctattttgacttaaagaatgtttctctgggccgggcacggtggcttacgcctgtaatcccagcactttgggaggccgaggcaggcagatcacaaggtcaggagatcgagaccatcctcgctaacacggtgaaaccccgtctctactaaaaatacaaaaaattagccaggcatggtggcgggcgcctgtagtcccagctactcgggaggctgaggcaggagaatggygtgaacccgggaggcggagcttgcagtgagccaagattgtgccactgcactccagcctgggcgacagagccagactctgtctcaaaaaaaaaaaaaaaaaatgtttctctgtctctcgtaccatgattattataatattaagcaaagcagtatctgtgtttttattttaggaaagaagcatttttagggttgaaaggatgtttgaaacttgagcccatgaatttttggccttctttacgcttttagcacttggaatgtcattaggtagctatttcacttagtatcttcatccagatattt

SEQ ID NO: 66354 - DNA, 601 bp, Human
tgggccgggcacggtggcttacgcctgtaatcccagcactttgggaggccgaggcaggcagatcacaaggtcaggagatcgagaccatcctcgctaacacggtgaaaccccgtctctactaaaaatacaaaaaattagccaggcatggtggcgggcgcctgtagtcccagctactcgggaggctgaggcaggagaatggtgtgaacccgggaggcggagcttgcagtgagccaagattgtgccactgcactccagcctgggcgacagagccagactctgtctcaaaaaaaaaaaaaaaaaatgtttctctgtctctcgtaccatgattattataatattaagcaaagcagtatctgtgtttttattttaggaaagaagcatttttagggttgaaaggatgtttgaaacttgagcccatgaatttttggccttctttacgcttttagcacttggaatgtcattaggtagctatttcacttagtatcttcatccagatatttcagaatggattttctcttcctgctgtttcattggtatgtgaaattgcaggtcggtttattcaaaggtttggaataaaaaggtttctctgaactctcctttc

SEQ ID NO: 66355 - DNA, 601 bp, Human
tgtttttattttaggaaagaagcatttttagggttgaaaggatgtttgaaacttgagcccatgaatttttggccttctttacgcttttagcacttggaatgtcattaggtagctatttcacttagtatcttcatccagatatttcagaatggattttctcttcctgctgtttcattggtatgtgaaattgcaggtcggtttattcaaaggtttggaataaaaaggtttctctgaactctcctttcattgccaaacattttgctccaaatcaggcttgttttaactgaattaagaggatgamttaataagaagcttctgtgcacagcagagggtcatggtaatcgttctatagggaacaacacaatacggtcacaagtctgcaaaacgtgccagaaatgatagtcatgcctcatccaggcaagtaaatgcatccttcctggaagcagtcaaggagttgttttctccgagtattgttatcaacagtttggggttggactttaccctcctgcggccacttacgttgtaaagacgatgaagcaaattattcaaagcaaatctatatttctttttccttccagagggaaaatgattccatctgatc

SEQ ID NO: 66356 - DNA, 601 bp, Human
tcaggtgatccacctgccttggcctcccaaaatgctgggattacaggcaggagccaccacacctggcctcattaatgttcttttctttaggggcagaaaatttccacaggcttagctgggtgcatttccattattccagagtattcctgcagagcaatcaccaatgttctttatcctccctgattcacagtgtgagtcgttcattaggctaccagagcccctttcattttacacatgaagacactgagaaaagactgaactatccgatatcattagtgacctgggcctcaggactggaaaycctggtagaccttgctggctgattcaggaagaggattacccggcaacttcaaaaatgagaatgtctgtgtgtcctgagccagcagaagctatgggttgttcctctgggcctcctacttaaattagaactagggaatcttttaaccagttttattagcttttctttgaaacataccaagtttaccacttactcttattagctttaacattcatacattctataaagtagaaagaatcttaaaatagtacacgtttggaaaatcataatttttcaaagtgcaaaagaactgggccaggtgca

SEQ ID NO: 66357 - DNA, 601 bp, Human
tacaggcaggagccaccacacctggcctcattaatgttcttttctttaggggcagaaaatttccacaggcttagctgggtgcatttccattattccagagtattcctgcagagcaatcaccaatgttctttatcctccctgattcacagtgtgagtcgttcattaggctaccagagcccctttcattttacacatgaagacactgagaaaagactgaactatccgatatcattagtgacctgggcctcaggactggaaatcctggtagaccttgctggctgattcaggaagaggattaccyggcaacttcaaaaatgagaatgtctgtgtgtcctgagccagcagaagctatgggttgttcctctgggcctcctacttaaattagaactagggaatcttttaaccagttttattagcttttctttgaaacataccaagtttaccacttactcttattagctttaacattcatacattctataaagtagaaagaatcttaaaatagtacacgtttggaaaatcataatttttcaaagtgcaaaagaactgggccaggtgcagtgtctcacgcctgtaatcccagcactttgggaggctgagg

SEQ ID NO: 66358 - DNA, 601 bp, Human
ttcatgtgctttcaagagaggtggcctatgtacagtactttctcttctgtgagtttctgactggcacaaaaagtctgttactttacctttgatgccacttgcaactgtaagtgctgaaagtcctggcacatcctccacttaaaaactcactaaattacctaccctgagccttagaaaaataaacacccacacgattctgtaccaaagactattatttgagagcaaagcttagaacgttcatcagggaacacagagtttcctcttattgccgcaattcttgaaactgtactgtaactaaacktttcaaatggaataaccatatatgaagtcctaaaaatgagggggctgctggtgttccactctgagcagaatcccctttagccacccatttaactgaggatacccctctctcactgacttattagcaaaaggcatactttctaagtgaatacagttggaagaccagtggaaaccacataatgtgtatggccacaagtttaggaaagaaatgtgtctcacttagggaatgacatttttccaagctccgcaaaccaaagtttagaactcaccctaaaagtagaagaaatccgtagtcaattct

SEQ ID NO: 66359 - DNA, 601 bp, Human
taggcacagagaggttaagtaacttgctcaaagtcacacagccaggaagtgatgaaacctgaacgcaaacccatactatctggctcctgagggcttcccccttaactattatgtctgctttatagcccagggtcctgactccagggtcattctacaaagcaaggaggtatttttttggagggaactttccaatacctcaatgctgttattactcattaagtcctttagtcttctctccaggggtagttatctgaccatgaactgcctttgcttctagttcctcaattccagtcgtaaatgyatctgacaaccagtgtcagagccagagaaagaccagaagctgagctagactattcgttggcccagatgagatccccaggccagtgagcgctctctgactgtctggctgacacctgcccttcatcaaatgaatgaatcgggtctttcccagcttctcattttttcccaaggccatcacacccgagaggtgggaactggatgagcccacgtccattgtacggccagacagggcagcaatccatggctctctggaggcagctgccacgggttattctactgtaatactttccttcctccttta

SEQ ID NO: 66360 - DNA, 601 bp, Human
gtaaatgtgtgaagtgagccatgacattcacagtgggagcagttgcttttcccagaatccaaacaggagcacggtggaagtgagggagagaagccgcagaagttaaacaaagccacagagatcatactgaaagaatctggggccttaaaaaataagcaagatttaacaaagtgaagcaaagggagatggtgttccaggaagaggaaacagcatgatgagacccaggagtatgagaatagaattctctgagaacaaaagttaatctggcctgatgaaatgggtaaagaaaagcgaagagacscaagacctaaggcgtagctggggctcaccccaggggctgcaggagccgtaccctgtatttggaatttgggctggaggcaaaagaaaactgtcagtgatttcagagaaggagagggccataaacagagatagaaaataattctggtgccaagtgaaggatgaaatgaagaccgagtcagttatgacacaattgctgaatccagattaaaataataattattattaaaggaatctgaaccaggactacagctcagacttttgaaataatgtaaatccctgagcacggaatcgctgttgtgtg

SEQ ID NO: 66361 - DNA, 601 bp, Human
gaaggacctaccgactggcaatttgatgttaccgttgaggctgtggggagctggtttagtaacaccaggtggtagagatttgacagcaaaatcagaacatctgacttgggttcaataaaaggaatacttctaaaaattaagctgtccaacaataggaataagttaataaggggaggagattaaatagagagattggacagccacttattagtaagggtgtagaaatgattcctttattgaggaggaatagagtaaacgagctctaaattcccttacaaatccaagactttatgatgctctracagcatttgtttattggcatccaaggaataatgctgttccataagatggtaataagagttccccaataagagagttctcagttttaaaaaggctgggatatattggtttagagttaaaaacaacttatgttatttcagggcttactggggcccttaatatgctgataattattgcagtatctaagaagaaagactagatgatatcgagtttcctaaatttatttgagcacgggaatctctttatgtacagcaactattaatgtgttttaatgtgttttaaatagtttgggacaggatgg

SEQ ID NO: 66362 - DNA, 601 bp, Human
ttgaaacacggggtttttagtgaagagactgtcgatactattttagtcggaaaacatgattcagtcactattctctggaataattcaatcactttgccacccatttccatagtaaggttacagtgccagggcaaatgaatggccattgacgatgaaactttccacttatctatctcaaggaactgagtatgcgaatgcaggactgaagctctgaccactcttgagagaggaatatgacatttgaaagattggttatttaaattcacctcaaaattgcaatatgtgggttttttttttttttagattttagcatataaaaatgatagcaatgagctgccttaaaagctatgatttccaaagggagctcaaactccctaacagctaaatgataaagtacttgaactagatatggatggaaatactggaagaaccacactaataatatttcacaaaaccaaagagtttccaaaatattttaatcatgacaaaaccagaatagtaggatattctcccaaagaaggggaacatttaaatataaatatatgctctggttgtgatttttatttatcagttgatttttataaatgccttctcttaaaag

SEQ ID NO: 66363 - DNA, 601 bp, Human
actattttagtcggaaaacatgattcagtcactattctctggaataattcaatcactttgccacccatttccatagtaaggttacagtgccagggcaaatgaatggccattgacgatgaaactttccacttatctatctcaaggaactgagtatgcgaatgcaggactgaagctctgaccactcttgagagaggaatatgacatttgaaagattggttatttaaattcacctcaaaattgcaatatgtgggttttttttttttttagattttagcatataaaaatgatagcaatgagctgycttaaaagctatgatttccaaagggagctcaaactccctaacagctaaatgataaagtacttgaactagatatggatggaaatactggaagaaccacactaataatatttcacaaaaccaaagagtttccaaaatattttaatcatgacaaaaccagaatagtaggatattctcccaaagaaggggaacatttaaatataaatatatgctctggttgtgatttttatttatcagttgatttttataaatgccttctcttaaaagggagagtaaaagtataaatgtgtccttgctaacctc

SEQ ID NO: 66364 - DNA, 601 bp, Human
ctgagtatgcgaatgcaggactgaagctctgaccactcttgagagaggaatatgacatttgaaagattggttatttaaattcacctcaaaattgcaatatgtgggttttttttttttttagattttagcatataaaaatgatagcaatgagctgccttaaaagctatgatttccaaagggagctcaaactccctaacagctaaatgataaagtacttgaactagatatggatggaaatactggaagaaccacactaataatatttcacaaaaccaaagagtttccaaaatattttaatcaygacaaaaccagaatagtaggatattctcccaaagaaggggaacatttaaatataaatatatgctctggttgtgatttttatttatcagttgatttttataaatgccttctcttaaaagggagagtaaaagtataaatgtgtccttgctaacctccgtgacatttgaccctgagccattgatcccacagagttgaccattacaacaacctagacactcctgtccagaattgcccccattcttttttttaaaattgattcttactgttttctttctctaagatatgcaatgtctcttacttc

SEQ ID NO: 66365 - DNA, 601 bp, Human
tttgtctgctaacttggtttttacccagtgattgatcacctgggtaggtgaatgcaatctgaaagtataggtctggagaacaaaaaagaaaaagtaaaaagcccaccatgatagcttattttttgacatttcaagggataacctctagttacaaagctttttatttccccctaatctcccaaaatacctaatcacctccttttatgtagattctgtgtttccctctgaatttagctgtaggtgatccctccttttttcagcaaggaaaactcactaactaacagtgtgcaggacttgcttrgacttaattgtagctttccaggagcctacatttatgtttaaatgtaagcaggctggataggtcaaagattttatttttaattttgaccagattcttaacttaaaggtcacaaattagtgcctgcccatccggcttcatttgtctcctgtaggagataaatagacagagccagctgtatatactatagaaactccaatgcaaaaagagagttcgaggaaacctgacataagaaagtgagaaagggggcgattaaaggtgtcaaccttaataacagagagagtctctctaagagaaaagatg

SEQ ID NO: 66366 - DNA, 601 bp, Human
tatgcaaaagtttaaacccaactccagactggtccaaaggatccaggttggagaagagcaattagcttccctcacttctacctacagtccatcccaagtgaacccaaactgtcaggtcattccaaaccaattataatctccttagcacccatagatgcagagagctcctggtatgggtgctggccaagcatcaggcatcagcccaagctcttcttggggaggcatcaggaacccatcagcctccttgagccgattacctgggggagcagtctccaaagaagtgaatttctgaacccatttsatatctccagggcagcttgttcttaaacctgcttcagatgtcacaagtcactgggctatgttgggcccccttagctgagatgatgtgatcttgtatgaaacaggcaagtgggcccatctcatctccattacaattgctttctctaggttctctgctggagaagttactggtaggcaggttcaaagtgcttctgagatgagcactggcttttactcttaagctttctccatcagcacccagtaaacacccaaggagataagaggaaagccattttgaaaagtaactctcttgtgtgtcccg

SEQ ID NO: 66367 - DNA, 601 bp, Human
attacagacacgtgagtcatttatctgcccccaaaggagaactgtacagagctcgacaggctaacaaagcatctgggtgctccctaaaattcctgcatccatttgttcaatgaagtcagtgagcacctacccaattttttctgtatcaggtacactggcagacaaagatgggctctgggaatggaaaatgtgcacgttggaggggaactaagcaggcattctggggggtctctggtgatgctttttatctgcaggaagagagtagctcagccctcctgttattaatgacttccatgattaytcctatgaatagcagaggcacattttcctcttgagtagtcaaactaattgcctggggaatggaggctctggaagaaaaggagttccgtgtagaaagcagtaatgaaagggaacaaaagcacctgacggggagagcattgaagagaaaatagcgctgaaaaagcctttggaaacagccttgtgttgagaaagtgccagacggggctaagacagagacggcaggatgacggtcagtctccagggaaatcgcttcctccgcactcttagcctgcttaatgagctgtgtccttctcttacctag

SEQ ID NO: 66368 - DNA, 601 bp, Human
tctctggtgatgctttttatctgcaggaagagagtagctcagccctcctgttattaatgacttccatgattattcctatgaatagcagaggcacattttcctcttgagtagtcaaactaattgcctggggaatggaggctctggaagaaaaggagttccgtgtagaaagcagtaatgaaagggaacaaaagcacctgacggggagagcattgaagagaaaatagcgctgaaaaagcctttggaaacagccttgtgttgagaaagtgccagacggggctaagacagagacggcaggatgacsgtcagtctccagggaaatcgcttcctccgcactcttagcctgcttaatgagctgtgtccttctcttacctaggggactaccgggtttgaagcgcatgttgataaatgtttggagttggcagagtatttatacaacatcataaaaaaccgagaaggatatgagatggtgtttgatgggaaggtatgtatttggatttctacaatctcagaaagtttagtcaattccaaccctcatcactgatatgatgtaaatgatgtgctgtccaggtaagtgggacgattacagaggggagcagtggat

SEQ ID NO: 66369 - DNA, 601 bp, Human
taagcctttttccagagtgcactatttggggacaaatatctggataacagaagttattaataaagcaaatacagtcatatcttcatgagggtggtaaacacgagaatccagtcagtgtgcttcctgctgctctgtcaggactatgatcttgcagatggcgctttgtccctgaggcagtgcagatgatgaatgcttggggcactatgaggatgtgacgccacacacatgccttggacacagggaggggcagcaagtgggctgtgccaatgtttaccaaacaagaatcaaaagggctggtctrttgatcacctcttgtgtttctggttctttatcttcttattttaattttttttattcttgatcattatctggttctgtcagcttttatagtcctacactgattggaggacttttcaaaggttagcagtggatttaatactaaatttgtaaggaagtagcctggacttatatttaatacagactctttgaaagtctgtgttattaagtgcaatagaggatttaattggtgaaattttcgcatattagaattttttttttttaagacagggtctcactctgttgcccaggctggagtacagtg

SEQ ID NO: 66370 - DNA, 601 bp, Human
tgtgccaatgtttaccaaacaagaatcaaaagggctggtctattgatcacctcttgtgtttctggttctttatcttcttattttaattttttttattcttgatcattatctggttctgtcagcttttatagtcctacactgattggaggacttttcaaaggttagcagtggatttaatactaaatttgtaaggaagtagcctggacttatatttaatacagactctttgaaagtctgtgttattaagtgcaatagaggatttaattggtgaaattttcgcatattagaattttttttttttaagacagggtctcactctgttgcccaggctggagtacagtggtgccatctcggctcactgcaacctccacctctcaggttcaagtgattctcccacctcagcctgccgagtagctgggattacaggcacacaccaccacacccagctaatttttatattttttggtcaggacagggttgggacggggtttcaccatgttggccaggctggtctcgaacgcctgaccttaagtgatcggctcacctcggcctcccaaagtgctgggattacaggcatgagccaccaagcctagccaacagt

SEQ ID NO: 66371 - DNA, 601 bp, Human
ttaagtgcaatagaggatttaattggtgaaattttcgcatattagaattttttttttttaagacagggtctcactctgttgcccaggctggagtacagtggtgccatctcggctcactgcaacctccacctctcaggttcaagtgattctcccacctcagcctgccgagtagctgggattacaggcacacaccaccacacccagctaatttttatattttttggtcaggacagggttgggacggggtttcaccatgttggccaggctggtctcgaacgcctgaccttaagtgatcggctcrcctcggcctcccaaagtgctgggattacaggcatgagccaccaagcctagccaacagtttagaatttctcatttaattattctgcttttacatttttcagaaatttctcgcagtcttccaaaatgtaaaaacaaagaggttttctaagacatagtgaaaaatacatttctgtgatatcttttaagtttatttcataatgctttactatgcaccctctttgaaagggacaaatgtggattccaattatggaaaagtcgcctggttattgctttctaaaggactgaaaaagctaatggcaca

SEQ ID NO: 66372 - DNA, 601 bp, Human
aagtgcaatagaggatttaattggtgaaattttcgcatattagaattttttttttttaagacagggtctcactctgttgcccaggctggagtacagtggtgccatctcggctcactgcaacctccacctctcaggttcaagtgattctcccacctcagcctgccgagtagctgggattacaggcacacaccaccacacccagctaatttttatattttttggtcaggacagggttgggacggggtttcaccatgttggccaggctggtctcgaacgcctgaccttaagtgatcggctcacstcggcctcccaaagtgctgggattacaggcatgagccaccaagcctagccaacagtttagaatttctcatttaattattctgcttttacatttttcagaaatttctcgcagtcttccaaaatgtaaaaacaaagaggttttctaagacatagtgaaaaatacatttctgtgatatcttttaagtttatttcataatgctttactatgcaccctctttgaaagggacaaatgtggattccaattatggaaaagtcgcctggttattgctttctaaaggactgaaaaagctaatggcacaag

SEQ ID NO: 66373 - DNA, 601 bp, Human
cctttaagttttccacccattttactcttagcggactcactctgcaagcgtgacaaaccaggcttcatctcagattaaattagggtaattgtctctattctgctttccagttcggcctgttttgaacagaaggttgatgctagttcttgaggcatcttccaaatagtattcttttattaggtcatttgaattaattagagaaagtaaaaataaaaccttatcagcctgagcaaagaggaatgaagcacactcccagaatgtggtgagcccagaaaattaaagttggccttgggagaagagrtctctgtgggacaataatgacatcatcctggcgccatattgccactgtccaggaaagagaaatttacctccaggccagttgcgcatttccatcccctccccattcctccccacaaagtctctcccactagactccctaccactgggacccaaaatagttactttatattccatgggtggttgtttttcttccatgaaatgagcctctcaccctagattttgaggcattatcttaagattttcctttatccatctcccatcgagatccaaagtgaccagaatatgcagaaataataagatc

SEQ ID NO: 66374 - DNA, 601 bp, Human
aacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcktggagaagacagtggggcccagtgccctggtgaaccaaccctgctgtactccaggatgctttatcttttgagttacagatcctagattataaactgctgctttttaggttaatgagatggtaaaattttaaaggacaatttgtgcctatatatgaaattccagcaaaacaattctagcaacaacaatagctcttcttccccgctcccctaccccttcccagtactccttcaaattggctgagagccttgctcaggcctgtgcagggaaatccttaccaactgtagcccaaagaaggaagc

SEQ ID NO: 66375 - DNA, 601 bp, Human
ctttttctcaatgttgctttgtccagtatatgcgtatgtcacatctgatcatcacatggttgactacaggaaccaagctatttgttcagtacttatatttaagtccatttcccaatgctgcctaaaagtatactgcccaatatggcaggcaataatcacatgtggctatggagctcttgaaaagtagctagactgaattgagatgtacaccaagtacaaaataacataccaaatttcaaagacttagtacctaaaaacgtgcaataactcattaataaagtttttatattgattatgtgtyggcatggcaatattttatagattgggttaaataaaatgtttgataatataatacattttccattttgaagagtaggtggaaacccttaaggctgtcattatattgctgacttagagcaagggactggctgagtaaattgaaattctttttttttttttttaatactgagtttcgctcttgttgcccaggctggagtgcaatggcatgatctcagctcactgcaacctctgcctcctgggttcaagcgattctcttgcctcagcctcccaagtagctgggattacaggtgcctgccaccac

SEQ ID NO: 66376 - DNA, 601 bp, Human
gcctttttatttcttgtttatggactactaatgcagaaatgtctgtgtggcttaaaataacaaaagactcacagaaaactaaaagtgaacagagcttacaactggcaggtagtacagtggttctccgctctccactccacagggcacacttctgaccaaatgaatcaagaattttcaaggttgggaacacatttatattttgaaaaagttctactcgtgcttgaaactactgtggtaaccagaagttaagattagtatatgtgacagaaacaataaactcttcatgggcataatttttttwaaaaaaattctttctataagacttacagttttatgcatttaggatactatgtttatttactatatagactggaaaaggcaaaaaaaaaaaaaaaaaaagcaaggctgtcacttacactccataaattcagacatatgtctctccaagtaagtacgagctgattgggaacgggctccaatggacatggctctgcagtcaaaatagttagcagatggacaggtttggaaaatgtgagggcccatatcctacaaatagaaataaatacaccacataattatttactttggttgaactaaaaat

SEQ ID NO: 66377 - DNA, 601 bp, Human
catcaatcttagcagtgaatgactaaaaccttttcccttaagtttaggaacaaaaaaaagaaggtttgttcatgcaacttatattcatcattgtaccagaggttccagccacggcagttagaaaggaaaaagtaaaactatctctattcccagacaacatgatcttaggaatctataaaaaaatgactagaactaataaacaagttcagcaagattgcaggatataagattgatatataaaaatcaactgtatttctatatagttgcaatgaataatatgcaatgaaattaagaaaacaaytctgttcacaacagcaccaaaaataataaaatactttaagacaaatatgatttgtacactgaaaactacaaaacatcagtgaaagaattaaatacctggttgggtgtggtggctcacgcctgtaatcccagcactttgggaggcccagttgggcggatcgcctgaggtcgggagtttgagaccagcctgaccaacatggagaaaccccgtctctactaaaaatacaaaattagccaggcgtggtggcgcatgcctgcaatcccagctactcaggaggctgaggcaggagaattgcttgaa

SEQ ID NO: 66378 - DNA, 601 bp, Human
atcatctctcacataattacctgaatagccttaaaactatttctacccatagccccactatctatctacccctacaatctgttttttttttttttgagatggagttttgctttgtcacccaggctggagtgcatgcaccgccacgcccggctgatttttgtatttttaatagagacagggtttcatcgtgttggccaggctggtctcgaactcctgatctcaagtgatccactcacctcagcctcccaaagtgttgggattacaggcgtgagccaccgcggctggcccacaaaccggttgtttttttttttttttttttgagacggagtctcgctctgtcgcccaggctggacaggctggagtgcagtggcgcaatctcagctcactgcaagctccacctcccaggttcacgccattctcctgcctcagcctcccgagtagctgggactacaggcgcctgccaccaagcccggctaattttttgtatttttagtagagacggggtttcaccgtgttagccaggatagtcttgatctcctgacctcgtgatccacctgccttggtctcccaaagtgctgggattacaggcgtgagccaccgc

SEQ ID NO: 66379 - DNA, 601 bp, Human
gaagcaattagaagagaactttcacaagttcccactgtatccactctttcctgtacctatgtccctagattctctcctttcccattaaaacttcctaaggccaacccttccacctatgtactattaaaggacattgttctaacaattttctcattatttttcctcataaatgcttccctaaatttacttggattactctcacaatcatgcagcaaatgtgatgtaatttcttccatcttaaaaaacaaaacaatttatttctctcctcttccagtcaccactccatctcaaaaaaaaaaaaaaaaaaaaaaaaaaacccagattgtaggggtaaatagatagtggggctatgggtagaaatagttttaaggctattcaggtaattcatgtgagagatgatagcgattggagcagagtgacagagtgaccgtcaacagaaatatcctccaaaaagctatctgcaattcctcgtctcccattctctcctgattccactatcaggtttttgccttattattccattaagcctgttttgtcaggtcctcagtgacaacttcattgcccctcctccttgaaagtttattcgtttgcctccaaagat

SEQ ID NO: 66380 - DNA, 601 bp, Human
ccgcctcccgggttcaagcgattctcctgcctcacctcctgagtagctgggactacaggtgcatgccatgacgcccagctaatttttgtatttttagtagagacggggtttcaccatgttggccaggatggtctccatctgttgacctcgtgattcacccgcctcggcctcccaaagtgctgggattacaggcatgagccaccgcacccggccccctttttgtgtttatggagatcactgccctttcaatatttaactttactcagttcttaattttcctgttgccatttgaattatgggyccatttcaatatttaagacaaaatggaaaatttacagacacagttgtggtaagaacagcagcttacaatagaactaaagcctcttgtgttatgattatatacctgtgcctttctctgtggtctttcttcaagaccttccaggaatggagacacatcatcatcatcatagattgtaaactccaagtctttaccaacaattccaatggaaacattctgaagggtaaaatatggtaaaagtaaaataagagaatttggatgaaaaaatacatacgataaaatattgggtgaaaaaagcagaat

SEQ ID NO: 66381 - DNA, 601 bp, Human
acttgatcaatatacacatctaatcacaaatattacgttattaaaaattgagaaaaaggggtaaagagatattctgaatactcagttttagttcactgtcctgttaacatttctgagcagtattttttttctccttgagtgctcatgatttgagggaataaagattttttatttaaaaaaaatacagttggctcgaacaacaaaggtttaaacagtgagggtccacttatatgcagatttttttttctttttctttttcttttttgtttgcttttactctaacattgtttagggtgaagctttttttttgtttgtttgttttccaataaatataaactagcagaccaactgtgtagcctagaaatataaaaaaaaagagtaagaaaaagttaggtatgccgaatgcataaaatatatgtagaaaatagtctatttggtcgggtgcagcagttcacacctgtaatcccaacactctgggaggctgaggcatgaggattgcttaagcccaggagtttgaaactggcctgggcaacacagtgagatcccatctctactaaaaagaaaaaaaatgtgctgggcatggtggcacacacctgtagtt

SEQ ID NO: 66382 - DNA, 601 bp, Human
gctgcataggaggcctgggtggtggtgactgtagcagtggtggtatcataagcaccagtgccatacccctggacaggctggctgtatgcctggggggcagttggagtagtataaccagtgggaggctgtccataagaagttgcataggcggtctgcccatagattgcagtggtctgagcctgggtatagctgacatcaatgggctgtccataggttccatagctttgttgcccatatgcctgggtggtctgtgcatatccttgagtgggctgggtgttgtaagcactgtagccctgctgcrctgcagcttggctataggtactgtaatccatggatgccattttctctccttcctcctcgttctctcaacgtccccatctgttgtttattgactttttaataatagtcattctgactggtgtggttttgatttgcatttctctaatgatcagtgatattcaactttttttcatatgtttcttggccacatgtatgtcttcttttgtagtgcctgttcatgtcctttcccactttttaataggggtgtttgttttttttcttgtaaatttctttaagttccttatagttgctggatgttaga

SEQ ID NO: 66383 - DNA, 601 bp, Human
cgcagcctgcaggccggcattgagcttggtgaccagatcttcctcggagaccaccgtggagaagtccatgctggccaagtgctgcagcagggtgggcacacggtccaccagcgtgtagtagtccttcaggacctcctggaggcagtggactacccctggaagggcgctgcgcagagtgaggatggccagggctttctccagggcctgctcggccggagtccccacacagggcagcaccccgctgccctcccacgtctggctgcctccaccaaggggccccagggacctggacacgggcacygtgaagaagaagtcagactcgcctatcctcagcttccggaggtccagggcccctcccccagtccgctcgcccaccacgatggccctgcgcatctgcttaaggatgtgcgcgatgtcctcggccacgcccctggtctggctgctggtgaggaccaccacatccttgtcggcaccgtacctttctcccaggacctggggcaaggtccagatctccgtggtggtgttggaggggcggttgtagatagtgtccacgtgcaggatggtgttccctgggtgcaggtaggagatgatgtagggaatg

SEQ ID NO: 66384 - DNA, 601 bp, Human
gaaatattaagggcatgggacaggaactaacatttctgaaggaattagtagacaccagggactttcccagtggcatgtctggatgtgacatgccactgggacatgtgtgatctatgggcagcctccttgcagaggatgctcctgtctgccacccacatgccctggtgtcctgagctagaaggcccaggaatggtctcccctctgacctctccaaccttaccagatacttcctatgtctctaagctgctccactggggcaggattggaagatgttagttacctttaccaggcacctggccckgtactaagcactttgtagagcttatcatcatcctcacagccacctgtacaggagataacacgatccccatcttttccatggaaaaactgaagcacagagagattaagtaactagtctcaggtcacacagtcagtaagtggtggagccagaatctgaatccacatctgactccaaatcgtgaaccttggctatactggaaaggaaggagatgttgatttggaaactggggattctgcaagcctagcacaggctactcgcacgtggatgcacctcctcctccctctctaaggctgctggagg

SEQ ID NO: 66385 - DNA, 601 bp, Human
cgtcctggctaggaagcactgacccctggccactgacctcatgtcgatgatcatggcatccgtgtgcatgatcttcttccagatgtgctccaccagcagcctggagacctgggtgagcagctcaccgtccccaaacatgtcaaacctcaagtagccaatgttgtcctcaagcacgttagtgtggaaggaaaacttgatcagctcttcaaatacttcaggggaagggatctgtaagagttggaggtcctactcagtgtcaggaggagcagccagttttagagcccaggaaagcaggcgccaygggaaatattaagggcatgggacaggaactaacatttctgaaggaattagtagacaccagggactttcccagtggcatgtctggatgtgacatgccactgggacatgtgtgatctatgggcagcctccttgcagaggatgctcctgtctgccacccacatgccctggtgtcctgagctagaaggcccaggaatggtctcccctctgacctctccaaccttaccagatacttcctatgtctctaagctgctccactggggcaggattggaagatgttagttacctttaccaggcacctggc

SEQ ID NO: 66386 - DNA, 601 bp, Human
tgatgtgaggcacactcccaggtggggggcctggctgtctcacacaccactgaccatcagaatcacctgggatgcctgtcaaatagagattatcgggcctgtcccctggagcttctgagtcagtaagaggggagtggggcccaggaatcagtgtttttaacatctccttcctctcctccccactgaatcctatgaccaggcaaatctggggtaattctcaatctggaatgcacattggaatcactggagaagcttgcaaaaactaccagtgctgggccccacctgcaatgacagcagatcygctgggctagctggccgaagccctgataggcaggaggcctggcccccctcaggtcctctgctgtgtcacagggttccttttcttccctgctgtggcccatagctttgactgtcccctggcagccctgcgtcctggctaggaagcactgacccctggccactgacctcatgtcgatgatcatggcatccgtgtgcatgatcttcttccagatgtgctccaccagcagcctggagacctgggtgagcagctcaccgtccccaaacatgtcaaacctcaagtagccaatgttgtcctcaagca

SEQ ID NO: 66387 - DNA, 601 bp, Human
agctgtctttccctggtttcccagaagcttctagaatgacagcagaaaggagaaagcttctccacgtacctacaacctgggcgtgtgtccagagttcactgacagagtcatcaggccggctgtagatcttgtccagcagaactggagggccttcatcaaagaagtaggagcacaagatgggaatggaggatgtggggccaccgatgttgaacctgaaggatgggaagcagagcctgttcaggggctgagctcacagtgaggccctgtgtgcccctcggggaggccaggatctttgtcccayggagggttctaattcttggcagcctcagtctagtgcctcttcctcctttagaattccatgggttggcattttccagagtatttccaagagtactagtctctttagaacaagaaacttagtgatcaaatatgttatcctttccttctgctatgtaattaatacatgttaatatattaaaggccctgacaagtcctgcagtcagaaacttgttgataaatttcccccatttattgaccatggactgctcccctgcacccatatcttcctatgagtggaacacattttgggaaacattgtttt

SEQ ID NO: 66388 - DNA, 601 bp, Human
ggggagaggacaggaaatagcacaaaggctgggtgtcttcctcttgcctggatcggcttttcggctggaagcggggtgggggtggggagtggggagatctgttgaaaattccacagggctgtcggctgaggcttttgacttttaagaacctgctatattttttcttgtgaatcgatagttgattcaaatgatattttaacatttcttgtgtccgttaaattacatggttagcatgcagaagcagtatcagcttttgtttgcttaattcatcttcatggaagccttttttttttttttttttaagagatgggatctctttgtaaaagagatcctgttaaccaggctggtctcgaactctggggctcaagcgatcctcccgcctcagcctcccaaagtgctgggattagcggccttagccaccgtgcccagcctgtcttcatggaagctttttcttaagattgtgaaatgggctcctgaaggaaaacgccgatgttaaaatttgtgttttgaaaagggagttggtgtacatttacagttagggtgtacagtactggacttatgggtaaatagtgtagaaatggtaacctatggttttcttttg

SEQ ID NO: 66389 - DNA, 601 bp, Human
ctttttgagatggagtttcgctcttgttgcccaggctggagtgcagtggcgcgatctcggctcattgcaacctccgcgcccccgggttcaagtgattctcttgcctcagcctcccgagtagctgggattacagctaccaccaccacacccggctaattttttgtatttttagtagagatagggtttcaccatgttggccaagctggtctccaactccagacctcaggtgattcacccgccttgatctgccaaagtgctgggattacgagcgtgagccaccgcgcccagccggtaaggcagmactttctaacgattagagctgcgcagaaatgaactgcaactgcagggtccagaggctgatgctgtcaaccctgggggaaggctggactgcaggtgttgggcggtggtcccaggttacgagcatttggtttcatcaacactgaaagtgctccccccgcccgcctttttttttttttttgagattgagagtttggaaaaccagttaagttctgaggtgcctgtgccccctcccagttaagtgcgcactgcccaggcccagtgtgaggatgacattttatcttctgcgggaacctttcaagat

SEQ ID NO: 66390 - DNA, 601 bp, Human
gatgtgggcactgataacagagctcagtgcaaggattagctatttctgttgctgatggccttgctttgtaaaaatttcttttatggcaaggttaacaaatgttataagatgacagtttactgagatttttctttttttctccatggttccagaagaatattaattcagggtgtggaacatgcatattagctatctttgcaaatccctatcacttatttactgccttactttctactaaatctctcacatccttatcttttcttgaaaggtttttttttctttttcttttttttttttttttgggacagggttttgctgtgtcacccaggctggagtgtggaatgtgatggtatgatcatggttcactgcagcctggacctcctgggctcatacgatcttcttctctcagtctcacaagtagctaggaccacgggcacatgccaccgtgcccagctaattttttttattgtttgtagagacaggctggtctccaactcctgggttcaagtgatcctcctgccttagcctcccaaaatgttgggattatagatgtgagccacagtaacctgctcttaaaggctttcctttacctttgtagaat

SEQ ID NO: 66391 - DNA, 601 bp, Human
actgcagcctggacctcctgggctcatacgatcttcttctctcagtctcacaagtagctaggaccacgggcacatgccaccgtgcccagctaattttttttattgtttgtagagacaggctggtctccaactcctgggttcaagtgatcctcctgccttagcctcccaaaatgttgggattatagatgtgagccacagtaacctgctcttaaaggctttcctttacctttgtagaataatcttgaactatgcctcattttgaaaactggtaagtttatgtcctttttttttttttgagacrgagtcttgccctgtcacccaggctggagtgcagtgacatgatctcggctcactgcaacctccacctcctgggttcaaacaattctcctgcctcagcctccagagtagctggggttacaggcacctgccaccatgcccagctgatttttgtatttttagtagagacagggtttcaccatattggccagtctggtctcaaactcctgacctcgtgatctgcctgcctcggcctcccaaagtgctgggattacaggcgtgagccaccacgccctgcccatttatgttcatttttttagagaat

SEQ ID NO: 66392 - DNA, 601 bp, Human
cagggtttcaccatattggccagtctggtctcaaactcctgacctcgtgatctgcctgcctcggcctcccaaagtgctgggattacaggcgtgagccaccacgccctgcccatttatgttcatttttttagagaattctcctcctcccatttatgaagctagatttttttttaatttcaccaaaatttgttgacgtcccttgatttgctgatagggacaataattaaatattttccacttgtttttataaaaactgtaatggtgatttgtttaacagatgttgacttagcaccttctctccttttttttttttttttttttgagttggagtcttgctctgtcacccagctggagtgcagtggcacgatttcggctcactgcaacctccgcctcccaggttcaggcgcttctcctgcctcagcctcccaaatagttgggattacaggtgcatgccgccacgcctagctaatgttttttgtatcttagtagagatggtgtttcaccttgttgcccatgccgctcttgaactccttggcctcccaaagtgttaggattacaggcgtgagccactgtgcctggccccaatttagcaccttactgg

SEQ ID NO: 66393 - DNA, 601 bp, Human
acagtctggataaagagcttttaccttgaggccgggcacagtggcttatgcctgtaatcccaccactttgggaggccagggcgggcggatcacttgaggtcaggagtttgagaccagcctggccaacatggtgaaaccttgtctctactaaacatataaaaattaggcttggtggcgcacacctgtattctcagctactcattaggctgaggcacaaggatcacttgaatctgggaggcggaggttgcagtgacccaagatcaccctagcctgggtgacagtgtgagactcaaaaaaaaaraaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttggg

SEQ ID NO: 66394 - DNA, 601 bp, Human
agtggcttatgcctgtaatcccaccactttgggaggccagggcgggcggatcacttgaggtcaggagtttgagaccagcctggccaacatggtgaaaccttgtctctactaaacatataaaaattaggcttggtggcgcacacctgtattctcagctactcattaggctgaggcacaaggatcacttgaatctgggaggcggaggttgcagtgacccaagatcaccctagcctgggtgacagtgtgagactcaaaaaaaaagaaaaaaatgaacttttacctcgagagctccaggaagccytgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcga

SEQ ID NO: 66395 - DNA, 601 bp, Human
cacctgtattctcagctactcattaggctgaggcacaaggatcacttgaatctgggaggcggaggttgcagtgacccaagatcaccctagcctgggtgacagtgtgagactcaaaaaaaaagaaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgaytgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttctcctccctgtccttggaaaactcctggctgtgtgtttgcacagttcactccctctctccgttcaggcatttgtcatgtatcccttcctccgagggtgtgctctgatctcattgatc

SEQ ID NO: 66396 - DNA, 601 bp, Human
agttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacrgcaggccttatactttctcctccctgtccttggaaaactcctggctgtgtgtttgcacagttcactccctctctccgttcaggcatttgtcatgtatcccttcctccgagggtgtgctctgatctcattgatctctgctgttttaccccactctgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaa

SEQ ID NO: 66397 - DNA, 601 bp, Human
tctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttytcctccctgtccttggaaaactcctggctgtgtgtttgcacagttcactccctctctccgttcaggcatttgtcatgtatcccttcctccgagggtgtgctctgatctcattgatctctgctgttttaccccactctgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaagataggtctggatggag

SEQ ID NO: 66398 - DNA, 601 bp, Human
ctctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttctcctccctgtccttggaaaactcctggctgtgtgtttgcacagttcactccctctctccgttcaggcatttgtcatgtatcccttcctccgagggtgtgctctgatctcattgatctctgctgttttaccccactctgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaagataggtctggatggaggcaggcctttgggagttagcaacatttgggtgatgattgaagtcttggggagcagtg

SEQ ID NO: 66399 - DNA, 601 bp, Human
ctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttctcctccctgtccttggaaaactcctggctgtgtgtttgcacagttcactccctctctccgttcaggcatttgtcatgtatcccttcctccgagggtgtgctctgatctcattgatctctgctgttttaccccactctgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaagataggtctggatggaggcaggcctttgggagttagcaacatttgggtgatgattgaagtcttggggagcagtggt

SEQ ID NO: 66400 - DNA, 601 bp, Human
ttcttctaagctccatggacacaggcagtctggttcactgcagaccagcccctaaaacggtacacagtaaatgctgacgtagtgactcctgtgcctgtgagtggggagctctggaagataggtctggatggaggcaggcctttgggagttagcaacatttgggtgatgattgaagtcttggggagcagtggtcacttagagcagtggttctcaaagtgtgatcgtggacccctgggggctcctgagacagtttcaggaattcacttagtcagaactgttttcatcatcatatatatatatwttttttttttgagatggagtctctctctgtcgcccaggctggagtgcagtggcgcgatctcggctcactgccagctccgcctcccgggttcacgcaattctgcctcggcctctccgagtagctgggactacaggcaccccccaccacgcccggctaattttttgtatttttagtagaggcggggtttcaccgtggtctcgatctcctgacctcgtgatccgcctgcctcggcctcccaaagcgctgggattacaagcgtgagccgccgtgtccggccttcataatcatattaagatgtta

SEQ ID NO: 66401 - DNA, 601 bp, Human
acttcagctaaaactgtgtattgcatcaggctgagagcagacacgatgtgaagatccattgctcccattgaggcagacaaggtaaatgtaaaatgtaaaatatggcttatcaccagattatttttcttagaaaatagttattcttttttttttttttttccctgagacagagtctcactctgtcacccaggctggagtgcagtggtgcgatcttggctcactgcaagctccgcctcctgggttcacgccattctcctgcctcagcctcccgaatagctgggactacaggtgcctgccaccrcgcctggctaatttttgtatttttagtagagacagggtttcaccgtgttaggcaggatgctctcgatcgcctgatctcgtgatctgcccgcctcggcctcccaaagtgctgggattacaggcatgagccactgcgcccggcctagaaagtagttgttctttataaaaatgttatgtatggtaacatgcagtgggcttattttcaaatgataaacatttttaggacatttcagttttaatttatagcacagtaaatattgatagatcaaaccctcataaacaaaagcccctggggtcctta

SEQ ID NO: 66402 - DNA, 601 bp, Human
acagaaggtattctgagagcagagggaatggtccgaagttggagatggattcgtcagtggtagagattgctgagggccagtgagttccagtggggtgaggagagtcttgtaggaaagtagtcggagagagaagtgtggggctaggggaggctctgtctgcatggattttagatgggaatactgagagggcagcgcccataaaggggaagagaggagagatcttttgtaaaatgcgtattcagggccaaagatgtgccaaggagaggcaggtgatgggcagtgaataagagatgccaacttrccttggtgagaggaatgttacctatgcgacagtggaaaaggctgtgtgctgaaaaagatggcggacgagtctgctgtagggctctaggcattgctggtgcttccatgttgaaaagggtggtccaaacatttgaggagagagtaggaggaggtgagaagacaaaccagacagacatctgggaaaagagggttccaggcaggagaagccccaagtcagggctgtgcttggacttggaattgaaataagtcctggaaaattggttaatccccgcttggcatacatattatgtaaagtgtgttg

SEQ ID NO: 66403 - DNA, 601 bp, Human
atattatgtaaagtgtgttgggagaggtacttgaaggttttcctgttgaaataaattccctacaaccttagccttccagtccctctgcctgacactcccatggcagttggtgcacttgcgttttgccctgttgaagatgcctgtgccattagctcgcatttgttgggtatctttcttgcaccaggcaccatgctgggaactatgctattactgcgtggtcctcacatcagctctgataggtgctgttaatagctccatcttacagatgactggatctacagggagattagacagttggccrtggtgacagtgaacttagttcttgggtcattgctcctggagcctatgcattatagacctgctggtgtgagctctttctcctcattcatctgagaagacttctgtgtctgcatttgcctcttcctatgttagtaaaaggaacatttttccactggaaaacagttaccaacagttttgtcagtggctactctattataccttcaaacatgcctaaatcttatgtaactcaacacccagttaatcttgctatctattctagccactcttcttgtttttctctctttaaactccccaacaggca

SEQ ID NO: 66404 - DNA, 601 bp, Human
ctgtaatcttagcactttgggaggctgaggcaggagaatcacttgaggccaggagtttgagaccagcctgggcaacacagctagaccctgtctctatttttaaaaaaataaataaaattttataaaaaagggaaattaggaacatacagcaaaaatctataatctctcaatcaggaaataaccatgtaagattattatatttcttctagtgttttgtatctctcatgcatgtgtgtatagagatgtttttcctcggattgggggtcccactctgtgtgtgtgtgtatatatatatatattwttttttttttttttttgagacagagtctcacttattgcccaggctggagtgcagaggcgcgatctcggctcattgaaacctccacctccccagctcaggcgattctcctgcctcagcctcctgagtagctgggattacaggcatacaccaccatgcctggctaattttgtatttttagtagagacggggtttcaccatgttggtcaggctggtctcgaactcctgacctcaagtgatccgcccaccttggcctcccaaagtgctgagattacaggcatgagccaccacgcctggcctgta

SEQ ID NO: 66405 - DNA, 601 bp, Human
aaggtaaagtgtccttggccaggtgtgatggctcacacctgtaatcccagcactttgggaggccacagcgggtggatcacttgaggccaggagtttgagaccagcctgaccaacatgtgaaaaccccgtctctgctaaaaacacaaaagtttagtggggtgtggtggcgtgcacctgtagacccagctacttgggagactgaggcatgagaatcacttgaactggagaggttgaggttgcagtgagctgagatcacaccactacactccagactggtaggcagagcaagactttgtctccraaaaaaaaaaaccagaaaaagataaaatgtcttctaagcatgggcccccaactcctgggctgtggtctcttaggagccgggctgcacagcaggtgagaggtgggcaagcgagcattcccacctgagctccacctcctgtcagatcagcggcagtgttagattctcataggagcgtgaaccccgtcatgaactgcacacgcgagggatgtaggctgtgcactccttatgagaatctaatgcctgatgatctgaggtggaacagtttcatcccaaaaccatcccctctgtctgtggaaaaat

SEQ ID NO: 66406 - DNA, 601 bp, Human
gtgatctgcctgcctcggcctcctagagtgctgggattacaggcgtgagccaccgcacctggccaggaggcgcgttgtgtttatgctttgctagtctttcttttgtgggaactgaagagtgttgtcctcggtagcttccacagggatggatcgaggctgctgccagcatttgttccactgactgtccttggggaccagtaacctagatcagaagtcaatgagaagacataaagaatgcctccaaagcagggaatctttccttcccctgtgaaagtgctgagtcccctagaggcaggtatgygttccctcttgtatttagtccccacgctgcctgcctggatacattggtggttgtgacagctggggtgtgccacagggatcctgctccaccatggagaattgtccagtccagcagtctcggtgccaagtttatttaagatggagtcttgctctgtcgcccaggctggagtgcagtggcaccatcttggctcactgtaacctctgcctctggggttcaagcaattcttctgcctcagcctcctgagtagctgggattacaggtgacccgcccacctcggcctcccgaagtgctgggattgca

SEQ ID NO: 66407 - DNA, 601 bp, Human
acagtgtagggtgcagttgaggagtcaggtgaatgggggtggggaaagggttcccttaagtctcactctgttgccgtggctggagtgcagtagcgcgatctgggctcactgcaacctccgcctcctacgttcaagcaatactcctgcctcagcctcttgagtagctgagattatagatgtgtgccaccatgcctggctaatttttgtatttttaatagagacggggtttcaccatgttggtcacgctggtctctaactcctggccttaagtgatccacctgcctcggccttaatgttatcmaaaatgctggggttacaggtgtgagccactgtacctggccaaaggttccttaaatttaaggactgcaggtactaggtggtcagcccttttggtttcacggtagggagtgaaagccagattggagtcaattgaaacataggagatggaagaggagaccacctgtgtagatacgacttaaagaaggttgctctagagggctcagagaaggagctcagtagttggagggtgatgtgggcaacagtggagagttctgtttttattttattttattgtttatttttttgagatggagtctctgtc

SEQ ID NO: 66408 - DNA, 601 bp, Human
gtgagatgttgtctcaagaaaaaaaaagaaaagattgtttttgaatctgaagacataacaaagcagcattacaagttgtgttgtacaagtgtgttagcgtaggttgtccttgataaatggaatataaatagctctgaagtttttgtatatattgacctattacaaaatcagagactttctttcggggttgggagggcagtttgagggtagttgggtcatctggaagaagaggcagaaaagaggaaccagctacgtgatgaataactgtgataagacaaataggctcctctactgccacctycttgttttttcctgcttactatttctgtggctgtgattgttgggattcacgggaggaggaagcagggacagtaggaaaagctccagttcctgatggacctgtgttgctggtgctgcactgccttttctctgacttcatcccacccacctgagagacactaaggtgggggctgaggtccaccctgtaattaagctcttgggcatgaatggttagctgaaacaagactgtcaccttctagtgaaattctgttttttggattcttatagaagtcagtagtaagtgtctgagataatgaatggt

SEQ ID NO: 66409 - DNA, 601 bp, Human
tgtgccccaggttggagtgcagtggcgcgatctcagctcactgcaagctccgcctcccgggttgacgccattctcctgcctcagcctcctgagtacctgggactacaggcgcctgccaacacacccagctaattttttgtatttttagtagaaacggggtttcaccgtgttagccaagatggtctcgatctcctgacctcgtgatctgcccatttcggcctcccaaagtgctgggattacaggcgtgagccaccgcgcccggccacattgagatttttttttagcgattttttttttttttaagctcatcagctattactagttagtgtattttatgtgtggcccaagacagaattctccaatgtggcccagggaagccaaaagattggacacccctggatgaatctaaatgtccatcaatagattggttaaattaaggcagacttggaatggcatactgtgcagttgttaaaaagatttaaggtggccttcctttattggcatgaagagatgaccacaatacagtaaatggttgggcattttgaatatgtatagtttggggaatatggtatcatttgattgacttgtgaaaaattatgca

SEQ ID NO: 66410 - DNA, 601 bp, Human
ctaattttttgtatttttagtagaaacggggtttcaccgtgttagccaagatggtctcgatctcctgacctcgtgatctgcccatttcggcctcccaaagtgctgggattacaggcgtgagccaccgcgcccggccacattgagatttttttttagcgattttttttttttttaagctcatcagctattactagttagtgtattttatgtgtggcccaagacagaattctccaatgtggcccagggaagccaaaagattggacacccctggatgaatctaaatgtccatcaatagattggytaaattaaggcagacttggaatggcatactgtgcagttgttaaaaagatttaaggtggccttcctttattggcatgaagagatgaccacaatacagtaaatggttgggcattttgaatatgtatagtttggggaatatggtatcatttgattgacttgtgaaaaattatgcacatatgtatcaaagtctggaagacatccctgtgaaacgtggtatctcatggggtgaatggaggaaaggaacatactgttttaagatactgttttctggctgggcgcagtggcgcacgcctgtaatctc

SEQ ID NO: 66411 - DNA, 601 bp, Human
atactgttttctggctgggcgcagtggcgcacgcctgtaatctcagcactttgagagaccaaggcgggtggatcacctgaggtcaggagtttgagaccagcctgaccaagatggtgaaaccctgtctgtctactaaatagaaaaaattagctggccgtggtggtgcatgcctgtaatcccagctacttgggaggctgaggcaggagaatcagttgaacctcggaggcggaagttgcagtgagccaacgttgcgccattgtactccagcctgggcaacaagagtgaaactcaaaaaaaaaawaaataaataaatactgttttcaaggccaggcgtggtctcaaaaaacaacaaccaaaaaacaaaactgttttctctttattttttggaaaattcgccaaagtcagtgacagaaaaaaggagttatttttcattttggaagaaatgtgaaagtggattatttacatttaaaagttttaaaagctttctcaagttagcatgactgaaatgagcacattacaggaatttgtttaaatctgcctttttaggtactgtagtctcctgtttcatagaccttgtagtcatgtttcttgctgtatcctg

SEQ ID NO: 66412 - DNA, 601 bp, Human
agtctcactctgttgcccaggttggagtgcggtggcacaatcttggctcactgcgacctctgcttcccgggttcaagcgattctcctgcctcagcctcctgagtagctgggactacaggtgcccgccaccacacctggccaatgttttgtatttttagtagagatggggtttcaccgtgttagccaggatggtctcgatctcctgaccttgtgatccgccctcctcggcctctcagagtgctgggattacaggcatgagccacaatgtgttgcctgttttttttttttggtttttttttgktttttttttgttttttgagatggagtctcactctgtcacccaggctggagttctgtggcgtgatctctgctcactgccacctctgcctcccgggttcatgccattctcctgcctcagcctcccgagttgctgggacttcaggtgcccgccaccacgcctggctaattttttgtatttttagtagagatgaggtttcaccatgttagccaggatggtctcgatctcctgaccttgtgatctgcccgcctcagcctcccaaagtgctgggattacaggcatgagccaccacgcctggcctgg

SEQ ID NO: 66413 - DNA, 601 bp, Human
ctcttgtctcagcctcccaagtagctgggactacaggctcgtgccaccatgcccagctaatttttgtatttttagtagacatggagtttagccatgttggtcaggcgggtctcgaactcctgacctcaagcgatctgtccggctcggcctcccaaagtgtcagttcccatttttgatgagcgtgtagtgtgttacagcttactgcaaagtggaggggcagagcagtaggtgaggcttttggggtggatttagagctgagctgcagtctggtcggtttgtggggactcttcctccctctttktttttgagacagagtcttgctctgttgcccacaggctggtttgtggggactcttcctccctctttttttttttttttgttggagatggagtcttgctctgttgcccaggctggagtgcagtggcgtgatctcggctcgctgcaagctccgcctccaaggttgacaccgttctcctgcctcagcctcccaggtagctgggactacaggcgcccaccaccacgactggctaatttttttttgtttgtttgtttttatttatttattttttgactaattttttcaacttttattttagattca

SEQ ID NO: 66414 - DNA, 601 bp, Human
aggacttgctgtatcctccccagttccacagtgtaccagccacctggcctgcagacagtgagggagtgagttggtgcagaggagactctggagacagagacatggctgacatttgatgattgctgtgatttagaatcctaggctgcgttgaaccctgtacaagatgacagtgattggttaatagagagattcacagaggagcagagaaagcacactggaaggagagagagaggagccagccagccccaagagccatccgagactgggttcttggttcctctttccactttctcgtttccastttagtttccttgggacctctcatattcctcctctccccacttcccagtgagaaccttggctagactgggtagacttttgaagtgggggtaaagtgaagtcaggagtagttttaattttccatttctagaattaatgatttcctaaaagatgtagttaataccaaatttcccattaaggcttctcattaatcagcaggattttgagacaggtgattggacagtgaatttaattacctggtgaaaatacctgaagtgattaaaatcagagtatgctctccatatacctgggctctcctgaa

SEQ ID NO: 66415 - DNA, 601 bp, Human
aaacagcctgggcaatgtagcgagaccagcccatctctgaaaatataaaagttagccaggtgtgatggcacatgcctttagtcctggctgctcaggagactgagatgggaggatacttgagcccaggaatttgaggctgcagtgagctatgatggtgccactgcactctagcctgggtcacagagcaagatcgccatctcttaaagaagaagaagaaagtccattgattaaaaaaatttgggaggctgctttacgccatgagtcctgagaacacagtggtgaaaaggtagagggccctgcyctgagctccctgcttatcaccttccccagatcagtgctgtcaacttcactcttaggttaagaaggtcatagcatctagttctgtagacactattgcctcctcctctttgaaatagccaaagaagcaaacaccaggtgtctctctttccccaggttactctgatgtactttcctcactggaaaacagtgacttagtgttttttccttttatgggagtttttttttgttttttttttgagacggagtctcgctgtcacccaggctggagtgcagtggcgcgatctcggctcactgcaggctc

SEQ ID NO: 66416 - DNA, 601 bp, Human
tctactaaaaataaaaaaaattagcagggtgtgatggcacatgcctggaatcccagctactcgagaggttgaggcaggagaatcgcttgaacctgggaggcggaggttgtggtgagccaagatcccgccattgcactccagcctgggcaacaagagagaaactccatctggaaaaaaaaaaaaaattagctgggtgtggtggcgggcacctgtaatcccagctactcaggctgaggcaggacaatcacttgaacctgggaggcggagattgcagtgagctgagattgtgccattgtacttmagcctatgtacagagcgagactccatctcaaacaaaaaaaaagtgttgagtagttgtgagactatagcaaactgtcaaatatacagataattggagccctaggaagaaaatggggcagaagaaatattcaaagagctaatggttgagaattttttcattagtaaaagacaacaaaccagaggtctgtgaagttcagaggactccaagcaccataaatataaacaaaaaaccctcaacacctaggcacattatagtcaaactgctgaaagtcaaagagaaagttttgaatgtagccagaaa

SEQ ID NO: 66417 - DNA, 601 bp, Human
caggacaatcacttgaacctgggaggcggagattgcagtgagctgagattgtgccattgtacttcagcctatgtacagagcgagactccatctcaaacaaaaaaaaagtgttgagtagttgtgagactatagcaaactgtcaaatatacagataattggagccctaggaagaaaatggggcagaagaaatattcaaagagctaatggttgagaattttttcattagtaaaagacaacaaaccagaggtctgtgaagttcagaggactccaagcaccataaatataaacaaaaaaccctcarcacctaggcacattatagtcaaactgctgaaagtcaaagagaaagttttgaatgtagccagaaaaaaagtatttcatacaggccaggcatggtgggtcatacctgtaatcccagcactttgggagactgagtggcagactcacttgagcccaggagtttgagagcagcctgggcaacatagcgagacttcatctctacaaaaaaaaaattatccaggtgctctggcggtgcctgtggtctcagctactcaggagactgaagtgggaggatcgcttgagcctgggaggttgaggctgcagt

SEQ ID NO: 66418 - DNA, 601 bp, Human
catttctctaaaaaagtttctgtatgatagcaaccttctgttgtatgctttatagttttagttcctgtgccataaaagctctgtgtcctaaagaagtcaagtgcagtcttggggaatggggaccttctgccagattgcccagtgtccacgtgtttttggcactgcttctttctcatcgtttggcaccacgttggaagtactgacatctgtcaaggtgtgttctgttaattcctctggtgtggtgtctaatagctcttgaatttctctaagatccacatgttgaagtccttacccacccccytacccttttaaaagcatatgcacagtcttttcatgatttcctcgtctggctctcgtaaatcctgtgaggtcaggcgcagcatctggacgtcgtcctctccagcaggagttgattgtttcaggctcatggccttcacagctttttctgtaacaaccttggcatcttcagcaggataatccttccagacttaaacgatgttctgtctattgggattctcttccatagcattgacaattctttccatagagtactgtgtgttatgagccttaaaggtccttatgaccccctaatctagaggct

SEQ ID NO: 66419 - DNA, 601 bp, Human
tcttaacattttttaagccaaccctctttctaaactgatcaagccacccttttgctggcattaaattctctagctttaagtccttcactttcagctagaaccagtggctcattcctataatctgagcactttgggaggccaagggaggaggattgcttgagaccaggagttgaagaccagcctgggccacatagtgagaccctctctccataaagaaacaaaaaatttagtcacgtgcagtgtggcacatgcctgaatccttgctacttagggggctgaggcaagaggatggctgtgcctmggagttcaaggtttcagtgagctgttcaaggctgtcacccacttgggtgacagtgagactctgattgattgattgattgattttgagatggagtctcactttgtctcacagcctggagtgcagtggcatgatctctgctcactgcaacctccgtctcctgggttcaagcgatccttctgcctcagcctcccgagtagctgggattacaggtgccagccaccacgcctggctaatttttttgtttttagcagagatggagtttcaccacgttggcctggctggtttcgaactcctgagctt

SEQ ID NO: 66420 - DNA, 601 bp, Human
ttacagacatgagccactgcacccggctaaatcttactccttctatgtgtattggcattcctctgtaaagaagagcttcgcttttcctctttttttttttaatttatatgttaccatgtgcttgtgtgttctttttttagatccagtaaggtatattccattaccattgttcgtcatgttgaccctcagattgtcctaaatttggccagcagacttccttcaagctggtgtgtttttgacatgttctttttagttttggagcccttcctttctgccatagcaagagggttcctgtgccaggccttgagggagtgatttctcagaggaaccctgaagctccttttaaagggaaccgtttttataaaaccaagatttgggctttgtgtgtggagaggtcgttgcttccagacctttcagttgacaagagataggagatatacgtgtgtgtgtgtgtgtgtgtgtgtgtgtgtgtgtgtgtgtgtgtgtgtatggacttacacacaaatgattctacagcggaataaatgtatagagaatttccattgtctccaaattcagattgaaccccagggggccattccttgctttcagatagtccgtg

SEQ ID NO: 66421 - DNA, 601 bp, Human
tacagacatgagccactgcacccggctaaatcttactccttctatgtgtattggcattcctctgtaaagaagagcttcgcttttcctctttttttttttaatttatatgttaccatgtgcttgtgtgttctttttttagatccagtaaggtatattccattaccattgttcgtcatgttgaccctcagattgtcctaaatttggccagcagacttccttcaagctggtgtgtttttgacatgttctttttagttttggagcccttcctttctgccatagcaagagggttcctgtgccagascttgagggagtgatttctcagaggaaccctgaagctccttttaaagggaaccgtttttataaaaccaagatttgggctttgtgtgtggagaggtcgttgcttccagacctttcagttgacaagagataggagatatacgtgtgtgtgtgtgtgtgtgtgtgtgtgtgtgtgtgtgtgtgtgtgtgtatggacttacacacaaatgattctacagcggaataaatgtatagagaatttccattgtctccaaattcagattgaaccccagggggccattccttgctttcagatagtccgtgt

SEQ ID NO: 66422 - DNA, 601 bp, Human
acagacatgagccactgcacccggctaaatcttactccttctatgtgtattggcattcctctgtaaagaagagcttcgcttttcctctttttttttttaatttatatgttaccatgtgcttgtgtgttctttttttagatccagtaaggtatattccattaccattgttcgtcatgttgaccctcagattgtcctaaatttggccagcagacttccttcaagctggtgtgtttttgacatgttctttttagttttggagcccttcctttctgccatagcaagagggttcctgtgccagacmttgagggagtgatttctcagaggaaccctgaagctccttttaaagggaaccgtttttataaaaccaagatttgggctttgtgtgtggagaggtcgttgcttccagacctttcagttgacaagagataggagatatacgtgtgtgtgtgtgtgtgtgtgtgtgtgtgtgtgtgtgtgtgtgtgtgtatggacttacacacaaatgattctacagcggaataaatgtatagagaatttccattgtctccaaattcagattgaaccccagggggccattccttgctttcagatagtccgtgtt

SEQ ID NO: 66423 - DNA, 601 bp, Human
tttttagtagagacggggtttcatcgagttagccaggatggtctcgatctcctgacctcgtgatccgcccgcctcggcctcccaaagtgctcggattacaggaatgagccaccgcacccggccagtaatttttgtatttttagtggagagggtttcaccatgttggccaggctggtctcgaactcatgacctcaggtgatccacccgcctcggcctcccaaagcactgggaggtgcgagcccagctcctgatgttctttaagggtagtgctactggtttagggttacattattgtgggacyggtagtcctgtccttagtgtggggttctatgagctggatagtcagaaaaagagcatacatttgggtcatcttgtttttagccagaaatgggtccagacaactctccatgtgaatccaggctaaggtgatttgatagcacttttagcatccttactccaatcttgagtcatgatttgagccacagggcaatctaggcattaaaatagagcagctgggtgcggtgccttgtgcctgcaatcccagcaccgtggaaggccgacctgcaaggatcgtttgagcccaggagttaaagaccagcct

SEQ ID NO: 66424 - DNA, 601 bp, Human
atacatttgggtcatcttgtttttagccagaaatgggtccagacaactctccatgtgaatccaggctaaggtgatttgatagcacttttagcatccttactccaatcttgagtcatgatttgagccacagggcaatctaggcattaaaatagagcagctgggtgcggtgccttgtgcctgcaatcccagcaccgtggaaggccgacctgcaaggatcgtttgagcccaggagttaaagaccagcctgcgcagtatggcaagaccccatgtctacaaatatatatatattttttaattagcwgggcatggtggcacacacctgtggtcccagctactcaggaggctgaggcaggaggatcaccttagcccaggaagtcgaagctgcagtgagccatgattgtgccactgtactccagactggctgacagagggtgaccctgtctcaaaaaaataattaataatgataaaatagagcagattatgtataattttttttagtagtatttctcttcctacctgtcccttgatctggaaagtacttgaaaagatttatatttagtggttgagataattgtgacagttgaagagttctcaactgggg

SEQ ID NO: 66425 - DNA, 601 bp, Human
atattggccaggctggtctcgaactctttaccttgtgatccgcccaacttggtctcccaaagtgctgggattacaggcaggagccacggtacctagcttttttttttttttcttttcgagacggtgtcttgctctatcacccaggctgaagtgtagtggcgtgatctccactcactacaacctccaccttctgggttcaagtgattctcctgcctctgcctcccaggtagctggggttacaggtgcctgccatcacgcctggctaatttttttaatttttagtagaaacgtttttttttttagttcgctgccaagaacataatgtgttcttaaaacacattaaaattaaaaacatttaatttttagttagccacgttggccagactggtctcgaactcttgacctcaggttatgcgcccacctcagcctcccaaagtgttgggattacagatgtgagccaccgcgcccagactgttgtgtgtttttgttttgagacagattcttgctctgtcacctaggctggaatgcagtggaatgatctcggttcactgcaacctccacctcccggatttaagcgattctcctgtctaagcctcctgag

SEQ ID NO: 66426 - DNA, 601 bp, Human
ttaatttttagtagaaacgtttttttttttagttcgctgccaagaacataatgtgttcttaaaacacattaaaattaaaaacatttaatttttagttagccacgttggccagactggtctcgaactcttgacctcaggttatgcgcccacctcagcctcccaaagtgttgggattacagatgtgagccaccgcgcccagactgttgtgtgtttttgttttgagacagattcttgctctgtcacctaggctggaatgcagtggaatgatctcggttcactgcaacctccacctcccggattyaagcgattctcctgtctaagcctcctgagtaaccgggattacaggcttgtgacaccatgcctggctaactttttttttttgtatttttagtggagatggggtttcaccatgttgaccatgctggtctccaattcctgacctcaggtgatttgcctgcctcagcttcccaaagtgctgggattgcaggggttagccactgggcccggcctgcattagtttttaaattgttactgtaatttttctagtgataggattctaacctctgtgcccatacttttcagtttaattcaaggtattttc

SEQ ID NO: 66427 - DNA, 601 bp, Human
ggtctccaattcctgacctcaggtgatttgcctgcctcagcttcccaaagtgctgggattgcaggggttagccactgggcccggcctgcattagtttttaaattgttactgtaatttttctagtgataggattctaacctctgtgcccatacttttcagtttaattcaaggtattttccctggggcatttctaaggattcttaaagaagttgagatctgatttcttattttgttcccatgctgaaaaacaaaatatgacagtactgctaaataaagcaattttgggggagaaatagtaatwgggaagggtcaaatttatgtgtcgttgcataaaatatagctactagcaaaatagaatattttattcacaacctgagtgcaatacaaatacagccttttctgtttgtttcagacaaatttacatgtattggagaccagaccagaagcccttctgaattaaggtaattttgatatatttgatcctcatcagttttagaaagacaatatataaatttcttcagagtttgtttttataaatagctggtgggttggttttttaaagagacagtgttttgccatgttgctcagactggattctaac

SEQ ID NO: 66428 - DNA, 601 bp, Human
gtctccaattcctgacctcaggtgatttgcctgcctcagcttcccaaagtgctgggattgcaggggttagccactgggcccggcctgcattagtttttaaattgttactgtaatttttctagtgataggattctaacctctgtgcccatacttttcagtttaattcaaggtattttccctggggcatttctaaggattcttaaagaagttgagatctgatttcttattttgttcccatgctgaaaaacaaaatatgacagtactgctaaataaagcaattttgggggagaaatagtaatasggaagggtcaaatttatgtgtcgttgcataaaatatagctactagcaaaatagaatattttattcacaacctgagtgcaatacaaatacagccttttctgtttgtttcagacaaatttacatgtattggagaccagaccagaagcccttctgaattaaggtaattttgatatatttgatcctcatcagttttagaaagacaatatataaatttcttcagagtttgtttttataaatagctggtgggttggttttttaaagagacagtgttttgccatgttgctcagactggattctaact

SEQ ID NO: 66429 - DNA, 601 bp, Human
ccgtctctacgaaaatacaaaggaaaagatttagccacgtgtggtggcacgcccctgtagtccagctactcaggaggttgaggcaggggaatcgcttgaacccaggaggcagaggttgcagtgagctgagattgcaccgttgtgctccagcctggtgacagagtgagactccgtgtcaaaaaaacaaaaacaaaaacaaaaaggccaggcatggtggctcacgcctgtaatcccagcactttgggaggccaaggagggtggatcacgaggtcaagagatcgagaccatcctggctaacacratgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaa

SEQ ID NO: 66430 - DNA, 601 bp, Human
ttgcagtgagctgagattgcaccgttgtgctccagcctggtgacagagtgagactccgtgtcaaaaaaacaaaaacaaaaacaaaaaggccaggcatggtggctcacgcctgtaatcccagcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcrgagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatg

SEQ ID NO: 66431 - DNA, 601 bp, Human
aaaggccaggcatggtggctcacgcctgtaatcccagcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactctcaaaactcaattttggctaggtactatggctaacacctgtaatcc

SEQ ID NO: 66432 - DNA, 601 bp, Human
agcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacstaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactctcaaaactcaattttggctaggtactatggctaacacctgtaatcccagcactttgggaggaggattgcttgaagccagtt

SEQ ID NO: 66433 - DNA, 601 bp, Human
gaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactctcaaaactcaattttggctaggtactatggctaacacctgtaatcccagcactttgggaggaggattgcttgaagccagttgttcgataccatcctgggcaataaagtgagacccctgtctcttcaaaaaaaaaaaaaaaaaaaagttagcagtcgggcacggtggctcacacctgtaatcccagcactttgggaggcccaggcaggcggatcacctgaggttgggagttcgagaacaacctggccaacatggggaaaccccatctctactaaaaatacaaaaattagctaggtgtagtggcttatgcctataatcccggccatttgggagactgagacacaagaatcacttgaacctgggaggtggaggttgcagtgagtccaggttgtgcaactgcactccagcctgggtgataaagcgagactgtctccaaaaaaaaaattt

SEQ ID NO: 66434 - DNA, 601 bp, Human
gagcgagaccctgtgtcaaaaaaaaaaaaaaaaaaaaaagcaatattaagaaaacaggtaacccaataaaaaagaggcaagtgacttgaacagacactttaccagaaactgtatagacagcaattgagtgcctcagaagctcagcagtcagcgagatgcagatggagactacagcccacgcccccattagaatggctgtgacacccacccagcgttgttgggcgtgaggagccgggactctccacattgcttataggatgttgggaatgtgacccagcataaccattttgaaaagagttgkttttttttgttttttgagtttgttttttgtttttttgaaatagggtctcactctgtctcttagactggagtacaatggtgtgatcatagctgactgcatccatgacctcctgggctcaagtgatcctctggcctcagcttcctaagtagttgggactataggcacgcactaccatgtctggctttttttttttttttttttttctttttttaattcttgtaagacggggtctcagtatgttgcccaggctggtcttcaattcctgggctcaagtgatcctcctgccttgcctcggaaagt

SEQ ID NO: 66435 - DNA, 601 bp, Human
gcccacgcccccattagaatggctgtgacacccacccagcgttgttgggcgtgaggagccgggactctccacattgcttataggatgttgggaatgtgacccagcataaccattttgaaaagagttggttttttttgttttttgagtttgttttttgtttttttgaaatagggtctcactctgtctcttagactggagtacaatggtgtgatcatagctgactgcatccatgacctcctgggctcaagtgatcctctggcctcagcttcctaagtagttgggactataggcacgcactacyatgtctggctttttttttttttttttttttctttttttaattcttgtaagacggggtctcagtatgttgcccaggctggtcttcaattcctgggctcaagtgatcctcctgccttgcctcggaaagtgctcagattatagtcatgagtcactgcacctggcctggcattttcttggaatgttcaacacacacctgtagtatgatccagccattccaccgctaggaatctgcccaagagaagtgaaagcagatgttctcataaagacttgtacatgtaacaacatgcacagatttcaaagt

SEQ ID NO: 66436 - DNA, 601 bp, Human
cagacatcattggtcctgcttaagtgggctggacctgcaaatgccaataaaaacacggaagtttttctaggaacagaattctaacccccaccgcccatttgctgttgggaaagcacatagtattcattgtagtttgcagcagtaaatgtaaaaacaaagattatttttatatactggagtgcagatggcatggcacacagcagtctttccctaaacctaaggatttccaggccccttataaaaggtgcttggaggccgggtgcagtggctcacgcctgtaatcccagcactttgggaggcygaggtgggcggatcatgaagtcaggagatcaagaccatcctggctaacacggtgaaaccccgtctctaataaaaatttaaaaaattagcagggcatagtggcaggcgcctgtagtcctggctacttgggaggctgaggcaggagaatggcatgaacccgggaggcggaggttgcactgagccgagatcgcaccactgcactccagcctgggcaacagagtgagactccatctcaaaaaaaaaaaaaaaaaaagtgcttggagtttagcctcctctgttgtgtgcgctgcatgattgttag

SEQ ID NO: 66437 - DNA, 601 bp, Human
tgtgctagattttgtgctccgccctaaaagcaaaaagaggccataggctaacagggttagaaaagggagagcagaatgggagatcagatgttttttgtgatgcatgagaaataataaggcttcgggagagtcagtagccacttctgggatttcagagttccaagggtcagaggtaagctcttagcagctgtgcctcactggctcacccctggctgttagacccctccctggagaattgccttctgagggctttgtgaccgcacaccatagttcctgcccttcccccagttgccagcgtctratgggtgagtgagctcacttgtgactgggacatgaaggagatgattctggggagtctcttcacttagtccagaaatcctccctccattgtttgctttctctcctttttcccttgaagtttatttgttaaagacagactaaccgacctgcctggtcgtctgtcctggagtgtttcccaggccattgtgtagtaccgttgcctctgtggggtcattgaacatgtttccctgtcttctagttctagagctttggtcacattcactttttcgttaagattactttataggcacaggcaaaatcc

SEQ ID NO: 66438 - DNA, 601 bp, Human
tagaggcactacacggagcacattgcattgcaaatatgaaatattctgactttaaaaatcttgctaacacttgactcacaaagatgttgttctaaagtaggggcagatcccttcacctgcttgcttttaagttattcaaatctctctcaaaaggatttccaaaactcagattctgaataaaagccaatggcagatatgggtcatcaggaagactagacatgaggccttagcagagcctgtcttagtggattagacgggcgggctcttggagtcagcacagccagagcttagccgtgacgtyggcaccggaggagaggagcccaggccagggaaacctggtggtgggtgttctggaaggtctgggggactgagggaagcgaagagaaaagcaagagcaattaaatgtgagtaagacttttaaaatttacatttattctttaattttcaaaggaagctgcatcaatattacgtttagtagaaaaacgtgactaatagttataataaaaatgctattctatctttctttaaagtgagtatatttttcttttttcttttcttttttttttttttttgagacaaggtctcactccatgtgctcagg

SEQ ID NO: 66439 - DNA, 601 bp, Human
aattagccaggtgtggtggtgcatgcctgtaatcccagctacttggggaagctgaggaaggagaatcgcttgaactcaggaggtggaggttgcagtgagccgagatcgcgccattgcactccatccagcctgggcctcagagctagactcagtctcaaataaaataactatatgcaaatttatattatttttgacttagtatatagtaagcgttttcccaaattattactgtcttccttattgttcttagcaatatgttacagttattccagtaactatttagagacaggatcttgctctrttgcccagattggagtgcagtggtgctatcatagctcactgcagccttgaactcctgggctcaagcgatcctcccacctcagcctcccaagtaggtaggactacaggcacgttccacgatacccagcgaattgcatcaagtaactttttttttgagatggagcctcattctgtcacccaggctggagtgcagtggcacgatctctgctcactgcagcctccgcctcccaggttcaagccgttctcccacctaagcctcccgagtatgtgggattacaggcacgcatcaccacacctggct

SEQ ID NO: 66440 - DNA, 601 bp, Human
aaaaagttaactttaggctgggtgtggtggctcatgcaatagattagagtctagcgctttgggaggccttggcaggaggatcacttgaagccaagagtttgagaccagcccgggcaacatagcaaggcctcgtctctaccaaaaatttcaaaaatagctgggtgtgatgggtggagtctgcttgtagtcctggctactctggaggctaaggtagaaggatggcttgaactgcagtgagctatgatcatgccactcactccaccctgggcaagagtgtgagaccctcacagagatttttttwaaaaaatgtaacattaaggctgggcgcggtggctcactcttgtaatcccagcacttcgggaggctgaggcgggcggatcacgaggtcaggagatggagaccacggtgaaaccccgtccctactaaaaatataaaaaattagctgggcgtggtggcgggcgcctgtagtcccagctactcggagaggctgaggcaggagagtggcgtgaacccgggaggtggagcttgcagtgagctgagatcgcgccactgcactccagcctgggcgacggagcaagactccatctcaaaaaaaaaaaaa

SEQ ID NO: 66441 - DNA, 601 bp, Human
tgggaggccgaggtgggcggatcacctgaggtcaggagttcaagaccagcctggccaacatgatgaaaccctgtctctactaaaaatacaaaaaattagccgggtgtggtggcatgtgcctgtagtcccagctactcgggaggctgaggcaaaagaatcgcttgaaatcgggaggcggaggttgcagtgagccagcactgtgccactgcactctagtctcagcaacaagagcaaaactccatctcaaaaaaaaaagaaaaaagatggcttgccctggcattggcgtttgtccttcttgtayacacaaaagcatcatgctttgtacactgttcgtttttgtttcgttcactgtcttcacggtaaagatgaactaagagccactgagaaggctgtttatgggaaccagaaggttgtttgcttcccttaagttcgctcttcctggcacctggtgcccttgcagcccatggggaatgtgatggtcacgttttctcgtctctcctgcctcatcccatcagccagttcactgctgtgcctgaactcctgtacagggtgtctggtgcatgtccacataacaaaaagatggtactgatcattgagttta

SEQ ID NO: 66442 - DNA, 601 bp, Human
gtttgcttcccttaagttcgctcttcctggcacctggtgcccttgcagcccatggggaatgtgatggtcacgttttctcgtctctcctgcctcatcccatcagccagttcactgctgtgcctgaactcctgtacagggtgtctggtgcatgtccacataacaaaaagatggtactgatcattgagtttatctccaaaaatttttttcaatttgattgtagaaaatacatttttaggcggggcatgatggctcatacctgtaatcccggcatttgggaggccgaggcgggcggatcacctgrggtcaggagttccttacagcctggccaacgtggtgaaaccccgtctctactaaaaatacaaaaactagccaagcgtggtagcatacgcctgtaattccagctactcgggaggctgaggcaaaagaatcacttgaacctgggaggcagaggttgcagtgagcagagattgcatcattgcactgcagcctgggcgataagagtgaaactccgtctcaaaaaagaaaagaaaagaaaatatatctttatcctggagactagagaatgtaatttttttaaaaaaattgaaatgcctgacaatag

SEQ ID NO: 66443 - DNA, 601 bp, Human
ggagactagagaatgtaatttttttaaaaaaattgaaatgcctgacaatagatttttcttatcacttctatgtgtggactgaagagggcctgaccaggaaatttatttttattgctaacaaaaattgtgtgtgtgtgtgtgtgtgtatgtgtgtatgtgtgtgtgtacacagcgttttgccatattgcccaggctggtcgcaaactgctggattcaagcagtcctcccgacttgacctcctaaagtgttgggattatagcccaccatgcccagccaggaatacgcctttttaaaaaaaatwgacaaacgtaggttttgagtctctgaattgaaactcaaatgttggcacagcagagtgctataataatttctgctattaactatgaaaaagaagtccgtctggtttttttctctttgcatgtgactaaagatgaaagttagcgagttttggcattactacttctgaaattttgtgaggtcactaagttatattgagctcattttaaagatacttagatttttggtaaatttgtttctctagtctcaagcaatacagctgggtgattgttgtgtacatgttcttgtataatatgtgaaaaga

SEQ ID NO: 66444 - DNA, 601 bp, Human
tgctgggattacaggcgtcagccaccgcccccagccggaacatcatttttgaagcatctcagaacatgcgtttctctttcccgagatcccaggagtttgttgtttttagtcccgtactataaaaattagctttactttttagtgtttaaatgatcagaaactgtgtgtgttaactaaaacagtttaattcggggtacttcataacattaacttgttttcttcatgttgattttggaaggattaaagtagctttacagactaagaacaattctctattatgcgtgcggggtgctggtgaaayaaaactacccccaactctgcaaaattgtgtgcataatataatttgatcatgtgtgaaatacaagtgagtagtgtcagggcatgcagaaagaatgcaaagcacaaggcatccagacagcttccatctgagacactgctcatcttgtcctggcactcttactgcttaacacattaacgtccacaaatcgcagtcgctaggatttatatgtgaaaaccagggaaagaattaaccagtcttatcccttaagaataaactgcccttgaggtgtgaccttgtccatacctaattccggtgatgctc

SEQ ID NO: 66445 - DNA, 601 bp, Human
actgtgtgtgttaactaaaacagtttaattcggggtacttcataacattaacttgttttcttcatgttgattttggaaggattaaagtagctttacagactaagaacaattctctattatgcgtgcggggtgctggtgaaataaaactacccccaactctgcaaaattgtgtgcataatataatttgatcatgtgtgaaatacaagtgagtagtgtcagggcatgcagaaagaatgcaaagcacaaggcatccagacagcttccatctgagacactgctcatcttgtcctggcactcttaytgcttaacacattaacgtccacaaatcgcagtcgctaggatttatatgtgaaaaccagggaaagaattaaccagtcttatcccttaagaataaactgcccttgaggtgtgaccttgtccatacctaattccggtgatgctccatgtgtgcagggaggcctgaggtatttttccttagtgaagctttcctcatgattaaaacatccgtttcaaataatgcctttagaaacaactatttggtcagaaatctttctgacaccgtgttgctgtgcagcctgcctccccagagagcagtggcagc

SEQ ID NO: 66446 - DNA, 601 bp, Human
ggtcaggagatcgataccatcctggctaacacggtgaaaccccgtctctactaaaagaaaaaaaatacaaaaaaaattagccaggtgtggtggtggtgggcgcctgtagtcccaactacttgggaggctgaggcagggaatggcgtgaacctgggaggcggagcttgcagtgaggcgagagcgcgccactgcacactccagcctgggagacagagcgagactccgtctcaaaaaaaaaaaaaaaaaagtaaaaagagagacggccaggcaccgtggctcatgccgttaatcccagtacttygggataccaaggcaggaggattgcatgagcccaaaagcttgagaccagcctttgtaaggtagaaaggccctgtcttttgaaaaagaatgaaaagaaacgggtggaattaaccctaacaaggtttttttcatttttttgtttgtgtgttttgagacagggtctctgtcagtcattcaagctggagagcagtggtgcgatcacagctcactgcagcctcccgagtagctggaactacaggagcatgctgccacacctggctggtttttttcaattttgtagagacagagtccaccatgttgc

SEQ ID NO: 66447 - DNA, 601 bp, Human
attatgcaatgtgtaattaatacattttaattgagatatttgacactgtttttgtcccaagtctcctggttccgtttgctgtgcgcagcagccacaggcaggtcatggcccccgcggtgggacgttcactaggagaggcgcctagctgctttgtctccgaagtaccaggaaccgcgctgtgttagttcctttgcacgagacagggacagcaaaagctgttgaagtccttttaccccaaatgggaaaggaagacttatttttaaaatgtagaacattttttcctgattgcccaaggaatacrtgcttgttaaagaatgcagagcatagtgaatcaaacaagaaattgtagatgattctaaaaggggctgttttctttcttagatttgtttttcagccaaaagacccttaaaggaccttgcatgctccttttgattattattgaggaaacacaggctctcagagggattctgattaaaacatggtgtgccttaaaatacacagagtagctgatggagtaaggaaagctccacaggatgcacaggcgtagatgtgttctggagcggcatgccagccagtgcaagggagcagggtccattcgtgc

SEQ ID NO: 66448 - DNA, 601 bp, Human
tgtaacatcaacaagaatagtatttcaaaaacaaatattaaactcagtacttgccagtaaaattcattgacaaaaagacttctgctgctctaagtattcttcatcccccttactccaaatgttactgcttgcatagaaatactcgatttttttgtgtgtgtcttaattataagcagaatgaccaataaagagcttaactaaagatgaatttggaatgtataaatttggtatatttataataatctcagtatagttccttttttttttttttttttttttttaaacagagtctcgctctgtygcccgggctggagtgcagtggtgtgatctcagctcactgcaacctctgcctcccaggttcaagcgattctcctgcctcagcctccccaaatagttacgattacaggtgccggccaccatgcctggttaatttttgtgtttttagtagggatggggtttcaccatgttggccaggcttgtcttgaactcctgacctcaggtgatccacccacctcagccgcctgaggtgttgggattacaggcatgagccactgcgcctgaccaatatatttccatattatcagtttataatattcccaca

SEQ ID NO: 66449 - DNA, 601 bp, Human
gtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaacactgcttttcaaacacacacatgtacatagcagcaccattcacaatagccaaaatgtagaaacaaccaaaatgtgcataaatgaatgagtggagaaacaaattgtggtgtctctgtgccctggagtattrtcagccattaaatggacgtcagtacagtcagaggctgcaacgtggataaaccccataaatattacgatagtgagagaagccaaacaaatggctatgtattgtttagttctatttatatgaaatatctagaatagtaacattcactgagacagagtggactagtggccagcaggggtgttaggggagagagggagaggaagtgaacagggagtgactgctgaatcaatgtctggtctccttttggaagatggtttggaactagatggtggcagtggttttacaacaatgagtgtactaaat

SEQ ID NO: 66450 - DNA, 601 bp, Human
cggagtctcactgtgttgcccagcctggagtgcggtggggcaatctcggctcactgcaagctccgcctcccgggttcacgccattctcctgcctcaccctccctagtagctgggactacaggcgcctgccaccacactggctaatttttttgtatttttagtagagatggggtttcaccatgttagccaggatggtctggatctcctgacttcacgatccacccgcctcggcctcccaaagtgatgggattacaggcgtgagccactacgcccagcctctttttttctttttttttttttttttttttttgagacagggtctcactcagtcatgctggagtgcagtggtgtgatcatatctcactgcagcctcgacgtcctaggctccagcaacccttcctactcagcctcccaagtggcataggccacaggcatgtgccaccatgcctggctaatattttttggttttttacagagacagggtctccctttgttgctgacactggtctcaaactcctggcccctaagtgatccttccacctcagcctcccaaagtgctgagattataggtgtgagccaccaccacttctagcctatttct

SEQ ID NO: 66451 - DNA, 601 bp, Human
tgggaggccaaggcaggcgaatggcttgagcccaggagttcaagatcagcctaggtcacatggcgagaccccttctctacaaaaagtacaaaaataagttggttgttgtggtgcgcacctggagtcccagctacttaggaggccgaggtgggaggatcacttgaacccaggagtcagggaagcagagcttgcagtgattccagatcaccccactgtgtttcagcctgcacggcagagtgagaccctgtctctaaataaataagtaaataagtaagaatatactttgtgaattcaaagttaytcctttaaaaaattaaaaagaattttttaaaaaatgttctggctggatgcagtggcgcacacctgtaatcccagcactttgggaggctgaggtgggcggatcacttgaggtcaggagttcgaaaccagcctcctggccaacatggcgaaaccccatctctgctaaaaatttaaaaattagctgggcatggtagctgtagtcccagctacttggaaggctgaggcacgtggaggttactgtgagccgaaattgcaccactgggtgacagagtgacactgactcaaaaaaaaaaaagaaaaa

SEQ ID NO: 66452 - DNA, 601 bp, Human
tttttaaaaaatattttttgtgggccgggcgcggtggctcaggcctgtaatcccagcactttgggaggctgaggtgggcggatcacgaggtcaggagatcgagaccatcctggctaactcaatgaaaccctgtctcaactaaaaatacaaaaaataagccaggcgcggtggcaggtgcctgtagtcccagctatttgggaggctgaggcaggagaatggcatgaacccaggaggcagagcttgcagttagccgagatcctccagcctgggtgacagagcgagactccatctcaaaaaatayatatatatttttttttgtggagacagggtctccctttgttgcccatgttggtttcaaactcctggacttaaccaatcctcttatctcagcctcccaaagtgctggggttacaggcatgagccaccaccctccctcctttgagtaaaatgaagggcattaggtgttttgatttttgacagctactttcagggtcctggagcctgttagcttgcttcctggcccttgcctctatgttctaggtgagtggcacctcagataattgatttttgagtaggtaaaggcactactaggcaacgtgaa

SEQ ID NO: 66453 - DNA, 601 bp, Human
aatattttttgtgggccgggcgcggtggctcaggcctgtaatcccagcactttgggaggctgaggtgggcggatcacgaggtcaggagatcgagaccatcctggctaactcaatgaaaccctgtctcaactaaaaatacaaaaaataagccaggcgcggtggcaggtgcctgtagtcccagctatttgggaggctgaggcaggagaatggcatgaacccaggaggcagagcttgcagttagccgagatcctccagcctgggtgacagagcgagactccatctcaaaaaatatatatatatwtttttttgtggagacagggtctccctttgttgcccatgttggtttcaaactcctggacttaaccaatcctcttatctcagcctcccaaagtgctggggttacaggcatgagccaccaccctccctcctttgagtaaaatgaagggcattaggtgttttgatttttgacagctactttcagggtcctggagcctgttagcttgcttcctggcccttgcctctatgttctaggtgagtggcacctcagataattgatttttgagtaggtaaaggcactactaggcaacgtgaacccagcttt

SEQ ID NO: 66454 - DNA, 601 bp, Human
caggtgaaaaggtttttatttgttcttaaactcattgacacctgtatcaaaacatctagtttgatattaaaagtgtcagagttatcaacaaaacttgagagagcgttactccagctttaggtcagctttaagaagccacatatgttcacagctgaaatagttaaaacctgtgttttgaggcgctgtggcttatgtctgtaatcccaacactttgggaggccaaggtgggcggatcacttgaggccaggagttggagaccagcctgggtaacatggggaaaccccatctctactaaaaatamaaaaattagccaggtgtggtggcacgtacctgtaatcccagctacttgggaggctgaggcatgagaatcacttgaacccaggagatagaggttgcagtgagctgagatcacaccactgcactccagcctgggtgacagagcgagactctgtctcaaacaaacaaacaaacaaaaacaaacaaacaaaaaaccttgcgtttgatagaaactttaaaattaaaaatccttatactatcatttaccgtactgacagatatccctgcatcaaacagtggaaccttcttgctcttccttgaaaac

SEQ ID NO: 66455 - DNA, 601 bp, Human
accttggcctcccaaagtgttgggattaaagacatgagcctctaatttgatttgtaatgaaaccaaacagaaacacttatgaaatgatgtcagcctgtctcagctgacaaagggaatgggtgccaggggtgatgtggcctgcattcggttggggccaggcatctccactctcaactgtggtctgtgacagtgtttttgttcatgctttgaagttggtctgacatttagagccttcctttcctttctttctttctttcttgaaacagagtctcactctgttgcccaggctggtgtccagtgrcatgattgtggctcactgtaacctccgcttcctaggttcaagcgattcttctgcctcagcctcccgagtagctgggattacagagacgcactaccatgcccggctaatttttgtatttttaatagagacagggtttcgccatgctggccaggctggtcttgaactcctgacctcatgtgatctgcccacctcagcctcccaaagtgctgggattacaaacgtgagcaactgtgcccgaccagagattttttttcttataaataagtggctttgtctgaagcacatgtaacatgggagcac

SEQ ID NO: 66456 - DNA, 601 bp, Human
cacgggcctgctgtctgcccttgctcactcttgtggttttcatatgcatcacacctgtgtgtgttattagctccatgatgcattgttgtattctttactttaaacattcttaagaaattaggggtcttataatgtgaataaatatgaaaagcatgaaataggctgggcatggttggctcacgcctgtaatcccagcactttgggaggccgaggcaagcagatcacctgaggccaggagtttgagatcagcctagccaacatgacgaaaccccgtgtctactaaaaataaaaaaattagccragcatggtggcatgcgcttgtagtcccagctgctcaggaggctgaagcaggagaattacttgaactgaagcggaggttgcagtgagctgagatcacgccactgcacctccagcctgggtaacagagtgagactccgtctcaaagagaaaagaatgaagtaaatctactctgccctccagagagatcttccatgtccagtgcccttcccgctctcctgcaaaggcgccttctgcgggcgtcctttcggccgggagccctacccggaacaagtcatggttaatgcagttctcaggtctgctg

SEQ ID NO: 66457 - DNA, 601 bp, Human
ttgtgttatttaaaaaaaacacacacacacatttggcctcttaagagtgtttgtgggctgggcgcggtggctcacgcctgtaatcccagcactttgggaggccgaggcaggcggatcacgaggtcaggagatcgagaccatcctggctaacacggtgaaaccccatctctactaaaaatacaaaaaattagccgggcgaggtggcgggcacctgtagtcccagctactcaaaaggctgaggcaggagaatggcgtgaaccccggggggcggagcctgcagtgagccgagatcgcgccaccrcactccaacctgggcgacagcgagactccgtctcaaaaaaaaaaaaaaagagtgtttgtgagtctgggtgacatagggagacccgcctctacaaaaaatacaaaaactagttggatgtggtggcatgcacttgtagtcccagctactcgggatcctgaggcaggagaatcacttgaacccagcaggcaaggttgcagtgagctgagatcgctccactacactccagcctgggcaacaagagcgaaactccgtctccaaaaaaagcttatttccagccctctgatccagtctcagattttt

SEQ ID NO: 66458 - DNA, 601 bp, Human
tttgtgggctgggcgcggtggctcacgcctgtaatcccagcactttgggaggccgaggcaggcggatcacgaggtcaggagatcgagaccatcctggctaacacggtgaaaccccatctctactaaaaatacaaaaaattagccgggcgaggtggcgggcacctgtagtcccagctactcaaaaggctgaggcaggagaatggcgtgaaccccggggggcggagcctgcagtgagccgagatcgcgccaccgcactccaacctgggcgacagcgagactccgtctcaaaaaaaaaaaaaaagagtgtttgtgagtctgggtgacatagggagacccgcctctacaaaaaatacaaaaactagttggatgtggtggcatgcacttgtagtcccagctactcgggatcctgaggcaggagaatcacttgaacccagcaggcaaggttgcagtgagctgagatcgctccactacactccagcctgggcaacaagagcgaaactccgtctccaaaaaaagcttatttccagccctctgatccagtctcagatttttatcaaagcagatccctaagggccaatgcagggagactcaacgcttgctc

SEQ ID NO: 66459 - DNA, 601 bp, Human
ctggaacccctgaatcttcagattagggccagtctgtcaccaatcctgggcacacactaactggtttgttgaccctatgcttttagttccacagtaaataccagaactgtgatcaatgtacaaaagaaataatggtcaacagaagtcattaacaacttgaactgccgggttcaaatgattctcctgcctcaccctcctgagtagctgggattacaggtgcccgccaccacgcttaatttttgtatttttagtagagaccagtcatcatgtgtggatattgcggactgattttttgttgttrcttttcctcattttggaagttgtttaggacggggcatcttggtgtgtcctgctctcgcctctgatgcttccttcccagtgggagtgggtgggaatactcagagacacagaattgtgcccacgctgatgtgggtgtcacagccactgtccccaagaaaacaaacccacccacacatattcacgagcacccccgtgtctgcagtgttgctgccatgccgcgttcctgttgccttcgttatcccttccatgacctgcaggcccttgccaccctgaccctgtggcctcgccgcctcctgccctg

SEQ ID NO: 66460 - DNA, 601 bp, Human
ggcaggcagtgccttgagaacccacagcccctggcacattcctctgtgaacatggaggaaataaggttcttgacataatattaggccatctgtaatttaagtggccttaagatttaaaacacatagtagcaatgtgtgaattcattatactttttttttttttgagatggagttttgttcttgtcacccaggctggagtacaatggctcaatcttggctctgcgacatctgcctgccgggtttaaatgattctcctgcctcatcctcctgaatagctgggattacaggtgcccgccaccaygcctgactaatttttgtatttttagtagagaccaggtttcaccacattggccaggctggtcctgaactcctgacctcaggtgacctgcccacctcggcctcccaaagtgctgggattacaggcgtgagcctccgtgcctagcctcattatacttctaataaatttacaaagtttaattttcagcagctgagaactaaaatacacatttttttctttttttttttttttttgagatagagtctctctctgtctccaggctagagtggagtggcgtgatctcggctcattgcaacctctgcc

SEQ ID NO: 66461 - DNA, 601 bp, Human
gcctgccgggtttaaatgattctcctgcctcatcctcctgaatagctgggattacaggtgcccgccaccacgcctgactaatttttgtatttttagtagagaccaggtttcaccacattggccaggctggtcctgaactcctgacctcaggtgacctgcccacctcggcctcccaaagtgctgggattacaggcgtgagcctccgtgcctagcctcattatacttctaataaatttacaaagtttaattttcagcagctgagaactaaaatacacatttttttctttttttttttttttttgagatagagtctctctctgtctccaggctagagtggagtggcgtgatctcggctcattgcaacctctgcctcccagattcaagcaattctcccctctcagcctcccgagtagctgggaactacaggtgtgcgccaccacacccagctaatttttgtattttcagtagagacgggatttcaccacgttggccaggatggtctcttatccgttgacctcgtgatctgcctgcgtcagcctctgaaagtgctgggattacaggtgtgagcccccatgcctggccaacatagatattttaacta

SEQ ID NO: 66462 - DNA, 601 bp, Human
aaagatttgtcacctagattgtcaatcttgagaagactttatttattagaagatatttttaaagtgcttctgttcattaatcatttttttcagactcttttacgtatcttgcttcccttctgcagtcagtccctcaggccctagagaggaggctccctgtgcagtgtctgttgagattggctgattggatttgcattgccaggcccagccaggctttcctctgaggctgacatgaacggacagtgctctctggtgttgccttccatgggtcgaggcacaggagaatagtatgttggtgggygtgtggccctcacagctgtccttacacctgagccaggcttctgctctgtgcagggctctgtcagcgtctcaccttttgacagcttgttaagcagaaatgtgatagaataccaggtatggccgggcgcggtggctcatgcctgtaatcccagcactttgggaggccgaggcgggcggatcacctgaggtcaggagttcgagaccagtctgaccaatatggagaaaccccgtctctactaaaaatacaaacaaaattagccgggcatggtggcgcatgcctgtaatcccagctactggagag

SEQ ID NO: 66463 - DNA, 601 bp, Human
ttacgtatcttgcttcccttctgcagtcagtccctcaggccctagagaggaggctccctgtgcagtgtctgttgagattggctgattggatttgcattgccaggcccagccaggctttcctctgaggctgacatgaacggacagtgctctctggtgttgccttccatgggtcgaggcacaggagaatagtatgttggtgggcgtgtggccctcacagctgtccttacacctgagccaggcttctgctctgtgcagggctctgtcagcgtctcaccttttgacagcttgttaagcagaaatrtgatagaataccaggtatggccgggcgcggtggctcatgcctgtaatcccagcactttgggaggccgaggcgggcggatcacctgaggtcaggagttcgagaccagtctgaccaatatggagaaaccccgtctctactaaaaatacaaacaaaattagccgggcatggtggcgcatgcctgtaatcccagctactggagaggctgaggcaggagaatcgcttgaactcgggaggcggaggttgtggtgagccaagatcgcgccattgcactccagcctgggcaacaagagtgaaattcgg

SEQ ID NO: 66464 - DNA, 601 bp, Human
gctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccrgtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactct

SEQ ID NO: 66465 - DNA, 601 bp, Human
gattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctccygtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgttttt

SEQ ID NO: 66466 - DNA, 601 bp, Human
ccctgtctctactaaacatacaaaaattagccaggcatagtgacatgcacctgtagtcccagctactctacttaggaggctgatgcaggagaatcctttgaacctgggaggcagagattgcagtgagcccagatcgcaccactgcactccagcctgggcaacagagcgagactctgtctcaaaaacaaacaaacaagaaaacaaaaataaaagatgttttaaaaagtagctaaattctgaaatacttacaggagacatgtaataaggtgtgccaacaaatgtttttgcaaaactcgtgtcrtggtttaatattctagctagcccaaagtctccaagcttgacgttttgcttgccatccaggaaaacattggctggtttcagatcccgatgcaatacggtatgaccaccatcacttcgtctgtggcattccttcagggccagagtcaactgagtcatcactcgaagaacaaactcttcatctaagtattgcctaaaaccaaagcagttatacagcatataacttctaaaaaaatcattgccaagatgggatgatataaattatccagtgtacaaatagggaatttatttatttatttattta

SEQ ID NO: 66467 - DNA, 601 bp, Human
cttgagggcaaggacaaaatccatttcatttttgtaatccttgagtttaatgcatcatagtcattccataaaagcttgaactgaatatgctttaatttgcatgaatgctcaaaaaattgaacccagtgagagatgacaaacggcgcaaaccttagactaggaatctgtcttcatcatacttacattaatgcacataactcatgcagcaaacaaaaactgatatagactttattggtctggtggtccatgtggaaaaatataacagtattttcaattcttggctactagatattactaaacraacagaaaactcaatttccctgcttcagaatgcttaacattaaaagatgttttggctgggcatggtggctcacgcctgtaatcccaacactttgggagactgaggtgagcagatcgcttgaggtcaggagttcgagaccagcctggtcaacatgatgaaaccctgtctctactaaacatacaaaaattagccaggcatagtgacatgcacctgtagtcccagctactctacttaggaggctgatgcaggagaatcctttgaacctgggaggcagagattgcagtgagcccagatcgcacc

SEQ ID NO: 66468 - DNA, 601 bp, Human
gcttatactttatcttgaaatttataatggaaaaaaggcaatgatcttgttccaatacactccatcatacataattcattcactcattttccattcacaaatgaaagtgcttagtatagactaggcactgacaatacagaggtgaatatgagagacttctactctcaaggcaaattaagaaacaccattttaaaagaactagaggaaatttaagaatagtcaaaatatgtatctagtccacatttaaatggatatagacataaatagctaattgaattatccatttatattttgtcttagwccactccataaatcacagtagtaactaatattatccttacctattttattgtttgcctttcttccacatctacagtaacaacagcctaccagagctcctattctcaacagagggaatagaagcaatctctagtggctggttagtgttttaaagtccaactggtgagtctgatgccactttttgacaatcagtgccttaggaaagctgaaccactctaattacaagggcaggagggaaaaggaacaaaagaataggtttcaaatttcccaagaaccacttctggataattgtcctttatgt

SEQ ID NO: 66469 - DNA, 601 bp, Human
tggcacatcttgtgctggggcttggtagcattgctagggtctgttttaggggaagtactgcccttgcatttctaaactacatttagcaagatactctctcactgactctcaatcctgtcacttcatctgtatccttctctgtgatcctacggcattttccttcttctcttatgtcagcctggtccccagaacatctccttccccattctatagccagagtttttccacataatctctttattgattttccctctgtttttagctgtcctccgtccgccctccatcacccctccccttcttstggtctttaatctctcaattagagctagaggcagagtaataaactcttatttctggccccttccctcactacctgccactgtgaggtaggcaaggacaaggggaacgagaatttgaattctttttgcaatctttccttgctaccgaccatctgttagcatgacagagtgggaggagaaataaagaaagcgcagaaggtgggccagcaaggatgtgcaatttgccaaatttacatatgttttcacttgtgttaacacagtaaatttagctaagaaagtatatttaacgtttcttcagtctc

SEQ ID NO: 66470 - DNA, 601 bp, Human
aagaaaggactcctttatggctaggtcttaaacacttggaaaaataagttcactggtggttttaactcatgaggttctgggtccacaaggtaatgcagatgttaacttaccttttttcccttttccccttttcacctttctaagaaggttcaatccctgaagattggcacatcttgtgctggggcttggtagcattgctagggtctgttttaggggaagtactgcccttgcatttctaaactacatttagcaagatactctctcactgactctcaatcctgtcacttcatctgtatccttstctgtgatcctacggcattttccttcttctcttatgtcagcctggtccccagaacatctccttccccattctatagccagagtttttccacataatctctttattgattttccctctgtttttagctgtcctccgtccgccctccatcacccctccccttcttctggtctttaatctctcaattagagctagaggcagagtaataaactcttatttctggccccttccctcactacctgccactgtgaggtaggcaaggacaaggggaacgagaatttgaattctttttgcaatctttcc

SEQ ID NO: 66471 - DNA, 601 bp, Human
atttccttcagtttcagctcactcaatacagggctggaatcctgcgatttttctggctctcctaattgtcgccctcttctctcaagatttcttctttgctcgtctgcaaccaaatctgctattaaagggttctcaagaatttcttcaacagaaggtcgatggtaatcctggggaaaaaatactcagtattatagtcagattgcataacagaatagtcctcctaagacagcagttaaaataaaaggacaaaaatgtgtttccaagacaaaagaaaggactcctttatggctaggtcttaaamacttggaaaaataagttcactggtggttttaactcatgaggttctgggtccacaaggtaatgcagatgttaacttaccttttttcccttttccccttttcacctttctaagaaggttcaatccctgaagattggcacatcttgtgctggggcttggtagcattgctagggtctgttttaggggaagtactgcccttgcatttctaaactacatttagcaagatactctctcactgactctcaatcctgtcacttcatctgtatccttctctgtgatcctacggcattttccttcttctct

SEQ ID NO: 66472 - DNA, 601 bp, Human
taaaaatacaaaaattagccgggcttggtggcgggtgtctgtagtcccagctacttgggaggctgaggcagaagaatggcgtgaacccgggaggcagagcttgcagtgagccgagattgtgccactgcactccagcctgggctacagagtgagactccatctcaaaaaaaataaaaaaataaataatgataataaaaataagtatcaattactaaacatgtagtttgataaggtaaagaaaatcaaacatgaaattctatgactcattgcctcaggtctatgaacccaggaaataaatcaytgctataacagaattttgtttccattgaaatgcatatattcaatgaaatccatcttaaaatttgagatttgtaaatgaaaagggctacctaagccactttgggagcaacactggtgcacatttcttcatttgtagcaccagcttctgttgaccaagttgattctcatacctggattacttgccagagacaggaacttccgttcctttagcaagctgtagttcttcaacagattttctgctctagccagtttgtcctctgctagtctctcacgaacacaaagctcctgttctttctcttta

SEQ ID NO: 66473 - DNA, 601 bp, Human
gaaatggtagactgcaatattgggaaaaaagaaggtattttaacagagatgaagccaaagtttcatataatccttgtttcatttacttctatcagtagtttcatttctttccatcacttattcactacaaagttattgtgatcatcaatctaacttaagtagggttttttgtctgttccatttacaaaatgctgccaatgctcactaaattgatcacactacatctcaatttattaaagatgggaataatagctttcatatatgctgtcctacatggaataagggagttataaaaactctraattttattgaaaattcagatgctcgatttttgaaaccaacaacttttaacagttagtttgtgtcataaatcaagcaaaaagatgtttcacagtttgcattttacataatcttaaagagtcgattaaattagattgagggtttctataaaatggagaatgttagacaatggttcactggtatatacgataaccacatctcagtgcggcagagtgaagggacaatgccacacaaaggcagggccctgagaaagctgaatatctatataccagactttaaataaagaaggaaatgcagagaa

SEQ ID NO: 66474 - DNA, 601 bp, Human
aagtggcaacactattaactgctgacagaattactgggggctggaggcttacagattctagaatccttttattttttgtgttaaaggaaatatgttcgaatatttactgagctcataggatgggccactgtgaaccaaacaaaggccctattctagtaggaggagataaaccaaacacaaacaaacaagtactggtggggaatatttgatggtaatacgtgctattaggaaaaatagctctggaaacagggacatgctgggtgctgggtgctgggtgtaatgatacaaagcctcatacagyatttctgaagtaagaagccacagggctgtctggatgaagagtgctccaggcagaagaaataggaaaggctggcacacagatgcactgccttccaagggtcctgtgacttcccgcttcatacgtcgcttctgcttcaaagcaaactggattgcttttagaccttatctccactgtttcaactctatccaccttcttattaccacaaatacctttacatttgtaagtcaacattgtcttactaatgggatagttttattttgtttttgtttttgtctgagatggggtcttgccatgttttcc

SEQ ID NO: 66475 - DNA, 601 bp, Human
ctcttgaggagcaaaatcaccctgttaaggaccactggcttacatacatggattaatgagatgggaggtaaagcgccatacagtttaggactggaatgccactcccttgagcatcagatccatgtttccttctgtaccctacaatgaagacctacaaatcataaacacaactcccatcaactaagagaccaacaaatgcaagacacataactacagggaaactgaagaattcttttatttagtgggaaagaagtaggtaaatgacagacagctcatattctgttaaacagaaaaaaaaaaagaatacaaacatcacagtgatgaattttcacaaagctaacagatttgaactacagagcaatggaatatttataagcaagatgtcatggtattaatgaccaaattgcatctaactgggttttctaagctcaaaaacatttaaaatctcagacttaaaatttaaatctagacatgacaattgtaagcataccactcagtcatttaaaactattcagtgagtgctactcttcctgcataaatatttttttcctaacattattttttctcccaagatttagaatgtcacatctcatgttcctac

SEQ ID NO: 66476 - DNA, 601 bp, Human; identical to SEQ ID NO: 34333

SEQ ID NO: 66477 - DNA, 601 bp, Human; identical to SEQ ID NO: 34334

SEQ ID NO: 66478 - DNA, 601 bp, Human; identical to SEQ ID NO: 34335

SEQ ID NO: 66479 - DNA, 601 bp, Human; identical to SEQ ID NO: 34336

SEQ ID NO: 66480 - DNA, 601 bp, Human; identical to SEQ ID NO: 34337

SEQ ID NO: 66481 - DNA, 601 bp, Human; identical to SEQ ID NO: 34338

SEQ ID NO: 66482 - DNA, 601 bp, Human; identical to SEQ ID NO: 34339

SEQ ID NO: 66483 - DNA, 601 bp, Human; identical to SEQ ID NO: 34340

SEQ ID NO: 66484 - DNA, 601 bp, Human; identical to SEQ ID NO: 34341

SEQ ID NO: 66485 - DNA, 601 bp, Human; identical to SEQ ID NO: 34342

SEQ ID NO: 66486 - DNA, 601 bp, Human; identical to SEQ ID NO: 34343

SEQ ID NO: 66487 - DNA, 601 bp, Human; identical to SEQ ID NO: 34344

SEQ ID NO: 66488 - DNA, 601 bp, Human; identical to SEQ ID NO: 34345

SEQ ID NO: 66489 - DNA, 601 bp, Human; identical to SEQ ID NO: 34346

SEQ ID NO: 66490 - DNA, 601 bp, Human; identical to SEQ ID NO: 34347

SEQ ID NO: 66491 - DNA, 601 bp, Human; identical to SEQ ID NO: 34348

SEQ ID NO: 66492 - DNA, 601 bp, Human; identical to SEQ ID NO: 34349

SEQ ID NO: 66493 - DNA, 601 bp, Human; identical to SEQ ID NO: 34350

SEQ ID NO: 66494 - DNA, 601 bp, Human; identical to SEQ ID NO: 34351

SEQ ID NO: 66495 - DNA, 601 bp, Human; identical to SEQ ID NO: 34352

SEQ ID NO: 66496 - DNA, 601 bp, Human; identical to SEQ ID NO: 34353

SEQ ID NO: 66497 - DNA, 601 bp, Human; identical to SEQ ID NO: 34354

SEQ ID NO: 66498 - DNA, 601 bp, Human; identical to SEQ ID NO: 34355

SEQ ID NO: 66499 - DNA, 601 bp, Human; identical to SEQ ID NO: 34356

SEQ ID NO: 66500 - DNA, 601 bp, Human; identical to SEQ ID NO: 34357

SEQ ID NO: 66501 - DNA, 601 bp, Human; identical to SEQ ID NO: 34358

SEQ ID NO: 66502 - DNA, 601 bp, Human; identical to SEQ ID NO: 34359

SEQ ID NO: 66503 - DNA, 601 bp, Human; identical to SEQ ID NO: 34360

SEQ ID NO: 66504 - DNA, 601 bp, Human; identical to SEQ ID NO: 34361

SEQ ID NO: 66505 - DNA, 601 bp, Human; identical to SEQ ID NO: 34362

SEQ ID NO: 66506 - DNA, 601 bp, Human; identical to SEQ ID NO: 34363

SEQ ID NO: 66507 - DNA, 601 bp, Human; identical to SEQ ID NO: 34364

SEQ ID NO: 66508 - DNA, 601 bp, Human
cttgctcactgatgagcccactccaaggctgctttttctgccagccttgaagagaaaaataatagtgtacgtgcgttttgatctattttccaacttttatctcttccagtacatgcagggtagatgaacaaacacttgttacattttcccctaagtcacggactgctgagaagcctggttgttatgctaaatgaaaccaaattctaaaaaacaggaaaacagacaaacaaatctagaagtaaagatctttcccaattgatgacactaaaacattctaagtaatacttccatggtgtgtagcagggatgtttggatggatggcaggtacaccgaaatgtaagataaatatggaggcaatgactcgtgtctcctaatgagggcgccattgaaggtatcatgctgagacaggttagaggggaggtagggttgtcggagcagaagccataccttggtctggaatgtacaaaacatgtgcgtcagaaacggatgctcccaggccaaggaaagaactctcttctctaccatcgtgcactcaacatcatcgtccatcaagaccacatctttctttaaggcctttattgcgaaaaattgattggttttc

SEQ ID NO: 66509 - DNA, 601 bp, Human
attaatggcgagtatatcttaagtggtgggattataagtgattttcttctttgagtttataaaaattttctacaatgatcctgaataattttgagtcaggaaagaaaaggataatttttgtttttttaaggaaaaaggagaccaggatgcaagtcctcccagaacggcacagccttctggcaaattcagcataaggaaagggtcccaacaccgagtgggaatgcagacgcatccaacctccacctcccagctcaggggcttgctcactgatgagcccactccaaggctgctttttctgccrgccttgaagagaaaaataatagtgtacgtgcgttttgatctattttccaacttttatctcttccagtacatgcagggtagatgaacaaacacttgttacattttcccctaagtcacggactgctgagaagcctggttgttatgctaaatgaaaccaaattctaaaaaacaggaaaacagacaaacaaatctagaagtaaagatctttcccaattgatgacactaaaacattctaagtaatacttccatggtgtgtagaagggatgtttggatggatggcaggtacaccgaaatgtaagat

SEQ ID NO: 66510 - DNA, 601 bp, Human
ttctgcccattcaaattcctctttctagtttctctcagctctggtactttgtgtctgccttctgatctaatattactcatactgttagaaatgcagccttgactcttattagagtgtgaagttctcaaggtcgggagctgtattatatacttctgtatcctccacagtgctttgagcacagcatatgctcagtaagtgctttgccatggtctggcttctctttatcttaggtaagtgcatttattcattgatttggttattgcacatatgctgagaatctactgggaactgcagaggtggkgatggatgccccagttgccatccactttcctcattcattccctggttccctcattaattcttcccatggctcaagtctccttagaagttttccctcattcactctccagtcgtcatggcttgagatagaaaatgggaaaagggctgggtgcgttggctcacgcctgtaatcctagcactttgggaggctgaggggggtggatcacctgaggtcaggagtttgagaccagcctggccaacatggtgaaaccctgtctctactaaaaatacaaaaattagctgagtgtggtggtgcacacct

SEQ ID NO: 66511 - DNA, 601 bp, Human
gaaaactgtcatacatgcaaatcaaaaaaaaaaaaaaaaaaatggggaaaaggcaccaagagaagcacaactgcctaagtgcccagaagcccagtctaaagtgtgtttatagtaacatacacagaaagatataataaaaataaaatcagttataatcctacctcccaattaacaactgttagtttttcattatttttcatgcttatacatgcaaatgttcttgcttaaaaggaaatactatatattctcacttatgatttcataaacaacattctgtattgatgtttaagcatttacatcwtcatttaaaatggttatatagtattattttctctgaccatataataatttattcaataaatctgtcattgggtatttgtgttgtttccaatttttcgctactatgaaagctttacagtaaaaatctttatttatggcaaaaaagaaaaaatgtgtttagcagtttgctacaagcctcaaaatactgcaaagggaaaagattacagggagccccagcatgtgcagaaaatctagacaacagtacggagagggtggcagagtttgtctccttgcctgcaggtgacataccttcaccctccca

SEQ ID NO: 66512 - DNA, 601 bp, Human
tatcttctacaaagtgggattcccaatagccttccccgtaagacatgaaaactgtcatacatgcaaatcaaaaaaaaaaaaaaaaaaatggggaaaaggcaccaagagaagcacaactgcctaagtgcccagaagcccagtctaaagtgtgtttatagtaacatacacagaaagatataataaaaataaaatcagttataatcctacctcccaattaacaactgttagtttttcattatttttcatgcttatacatgcaaatgttcttgcttaaaaggaaatactatatattctcacttaygatttcataaacaacattctgtattgatgtttaagcatttacatcatcatttaaaatggttatatagtattattttctctgaccatataataatttattcaataaatctgtcattgggtatttgtgttgtttccaatttttcgctactatgaaagctttacagtaaaaatctttatttatggcaaaaaagaaaaaatgtgtttagcagtttgctacaagcctcaaaatactgcaaagggaaaagattacagggagccccagcatgtgcagaaaatctagacaacagtacggagagggtgg

SEQ ID NO: 66513 - DNA, 601 bp, Human
tgaataattaagacatctcaaaaacaacaactcggggtgttggaaaaggtgattcaagcttcttcctttgtttctttcctctttctaaaaggactcagttccttgagatctgagtcttgagccagtcagatttacatttcatgtaaacattctctgctgaagtttttttttctctcccagcaccaatgctgtggatgcacttgtggctcaggtcttggtaaagcatcccagctgcacggaactcatttatgcctagtgttccattattggaacgctaagcatgtgggagttatttatatcytactgctcaaggtcatcaccaaggtctgatttcaaaattcaaaaagttgcaacctcaggcataaatgggttaaggagatctctcataagagggacagaaacaaatgctgcctgaagctgtgatggacaggcaagagaaaggagcatacctatcttctacaaagtgggattcccaatagccttccccgtaagacatgaaaactgtcatacatgcaaatcaaaaaaaaaaaaaaaaaaatggggaaaaggcaccaagagaagcacaactgcctaagtgcccagaagcccagtctaaagtgtg

SEQ ID NO: 66514 - DNA, 601 bp, Human
aatttaatccaaatgaccctaattaataacaagtgaatacctgtcctcagaatctcctgaataatctggtattcaacaggtgcgctctttggaggcagagagcagatgaataacttcctttaaaaaataacaatgccctggagaagtacatagttaatttatcttatctgatgtctacactagcatacacaggtaactgtcctcccaagaaaggtcattcccaacatgttcccagaacaaagcattatccatatcacgtatcaatcgttgccttttgcattcacttgtggtatttaatcasttactttgacaagcaaggtttgaataattaagacatctcaaaaacaacaactcggggtgttggaaaaggtgattcaagcttcttcctttgtttctttcctctttctaaaaggactcagttccttgagatctgagtcttgagccagtcagatttacatttcatgtaaacattctctgctgaagtttttttttctctcccagcaccaatgctgtggatgcacttgtggctcaggtcttggtaaagcatcccagctgcacggaactcatttatgcctagtgttccattattggaacgctaagc

SEQ ID NO: 66515 - DNA, 601 bp, Human
aaagtcattttgatctagcacacagaaaattcattgtgaagattcttttgatttgagcctcattcagattcaggttcagatttcatgaattatcctgtacatctatgtccccagacggtgccgtcccattagggcccctggttttacagctcccagcccctctgcctgtaactcttactctctgtcctgggcaggggtaaagtgggtgcctcagagccctgttgataaacggcagagctgggcttgaacttcggaatccaagtccacaggaattttcacattttgtagcttcctaaatggmtttatcatattttcacccttccataggtgatatatccctcatctaggaactttaaaaactttaacaatttaatccaaatgaccctaattaataacaagtgaatacctgtcctcagaatctcctgaataatctggtattcaacaggtgcgctctttggaggcagagagcagatgaataacttcctttaaaaaataacaatgccctggagaagtacatagttaatttatcttatctgatgtctacactagcatacacaggtaactgtcctcccaagaaaggtcattcccaacatgttcccag

SEQ ID NO: 66516 - DNA, 601 bp, Human
ctgagaagggatcgtgcaatttcaagccctgcagactttgtaagacagaaaatgtaaatattaacaacaaagaaatgttagaaaaaaagtaaaagaaagaagagctagcccttctttcctcttgccaagacagcagcctctcagaatgctgatctacgttagaccctgagccagtaatttatgccagagcctggatgatgtacaaagtcattttgatctagcacacagaaaattcattgtgaagattcttttgatttgagcctcattcagattcaggttcagatttcatgaattatcctgyacatctatgtccccagacggtgccgtcccattagggcccctggttttacagctcccagcccctctgcctgtaactcttactctctgtcctgggcaggggtaaagtgggtgcctcagagccctgttgataaacggcagagctgggcttgaacttcggaatccaagtccacaggaattttcacattttgtagcttcctaaatggctttatcatattttcacccttccataggtgatatatccctcatctaggaactttaaaaactttaacaatttaatccaaatgaccctaattaataacaa

SEQ ID NO: 66517 - DNA, 601 bp, Human
tactttttaaaaagtatcaagttcaaggagtttttctttttaattttaaatgataataatatcttgtagttagtatggtactttctccaaaaaagatccaaacttctctgcaagtgctattattgttattattattatttttcacgttatccttaggaagcaaaaaaggagaaccagtgtcacaaagaaatgttaggtgacttgttcaaagtaactcacacactcatgccctgaagccataaccggaagtagagctttgtgtgttctatgaatagaaagtgaaactcagttttctttttcmtaaaagaaaaatttcaaagtgatattgaccaagaatgttcaactggtgcatattgggagtgtgggagtcaagggcagtgatgtgaatccaggaacactagcgttctgcctcttggcatcaccctgggaggcctctcttcagaggcctgcaaaaccacggcggcctgccctcaaatccaacctgagggaacgacccagagacagagctgttcctataggatctagagctacttaggtgtgaaatagtaacactacttaaatgtcagaatacagatcggcctttcagaattcaaaggagaca

SEQ ID NO: 66518 - DNA, 601 bp, Human
gtaggctgggcatggtggctcatgcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttctcaaaacaaasaaacaaacacaacaatgacaacaacaacaacaaaaaacaaaagagggatagtagattcacagaaggcatgcactttcctgaggcactctcttgaaggagatgtcaaatgctcatgtcttctgggaagctggtgacaatacttttgggactttgtgagaatggctgacaaaggaatgggcagataatatgggccatgagcctggaagaatattacagagtcacatcaagatgagaacagatctgtgagcttaaaaagtgggcgtgtaggggccgggcgcggtggctcacgcccgtaatccc

SEQ ID NO: 66519 - DNA, 601 bp, Human
aaggagggagagtaggctgggcatggtggctcatgcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttytcaaaacaaacaaacaaacacaacaatgacaacaacaacaacaaaaaacaaaagagggatagtagattcacagaaggcatgcactttcctgaggcactctcttgaaggagatgtcaaatgctcatgtcttctgggaagctggtgacaatacttttgggactttgtgagaatggctgacaaaggaatgggcagataatatgggccatgagcctggaagaatattacagagtcacatcaagatgagaacagatctgtgagcttaaaaagtgggcgtgtaggggccgggcgcggtggctcacg

SEQ ID NO: 66520 - DNA, 601 bp, Human
atatgaaagaagtcacagaagacacccagcagtacaggagcaaaatcatctttctgggtcacgtaagctgagaagcctgagcgtctgaatgacaagtaggatttagtgtatctgagcgtgatttatagagtaggtagtttgtcagcaaggtttcaaaggagggagagtaggctgggcatggtggctcatgcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttctcaaaacaaacaaacaaacacaacaatgacaacaacaacaacaaaaaacaaaagagggatagtagattcacagaaggcatgcactttcctgaggcactctcttgaaggagatgtcaaatgctcatgtcttctgggaagctggtga

SEQ ID NO: 66521 - DNA, 601 bp, Human
aacattatctagcactctacgggcaaatgaaacaaaagaaaagagcgaaacatgcatcttggtatcaaggaatgtattatttacatagacaaggtattatttaaacagaacatatgaaagaagtcacagaagacacccagcagtacaggagcaaaatcatctttctgggtcacgtaagctgagaagcctgagcgtctgaatgacaagtaggatttagtgtatctgagcgtgatttatagagtaggtagtttgtcagcaaggtttcaaaggagggagagtaggctgggcatggtggctcatrcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttctcaaaacaaacaaacaaacacaacaatgacaaca

SEQ ID NO: 66522 - DNA, 601 bp, Human
cccctgaacattatctagcactctacgggcaaatgaaacaaaagaaaagagcgaaacatgcatcttggtatcaaggaatgtattatttacatagacaaggtattatttaaacagaacatatgaaagaagtcacagaagacacccagcagtacaggagcaaaatcatctttctgggtcacgtaagctgagaagcctgagcgtctgaatgacaagtaggatttagtgtatctgagcgtgatttatagagtaggtagtttgtcagcaaggtttcaaaggagggagagtaggctgggcatggtgrctcatgcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttctcaaaacaaacaaacaaacacaacaatg

SEQ ID NO: 66523 - DNA, 601 bp, Human
tatgctatttatcagatatttctctaagactggtggtggagaagaggttcctgaagtgacagaagttttaagggggagagacaaggagatggagaagaacgattttgccatcaaggatcaaggcagaggccaagcgcggtggctcatgcctataatcccagcattttgggagcctgaggtgggtggatcactagaggtcaggagttcaagaccagcctggccaatatggtgaaatcccatctctaccaaaaatacaaaaattagccaggcatggtggcacacacctgtaaccccagctacytgggaggctgaggcaggagaatcacttgaacccaggaggtggaggttgtattgagccgcctgggcaacagagtgagactgtcgcaaaaaaaaaaaaaatcaaggcagagacctgatagctacagtgggtacaagatcatgtgaactctgggatgaaggggaaaataatgaaacaggaggtcagagaggggtgggaagagggtttgtcaaagatagacttctcctctgcagttctattcgggaccagccttcctggcacctgagttagccagtatgatctacagtcagaccatttatcttt

SEQ ID NO: 66524 - DNA, 601 bp, Human
gagggcttttctgtggtttagcacttgaatttctgcagtacgttgattctgacgctcatatattcccacagtttcccctgaagagtcccatgcgtgtcacctcctcaggatgggaactgtaatcacctcaaatacaacgtaatgttgggtctaataaggaaactccactctgctccactttaggaagaaatcgttgctaggaacaacacatattaaactgctctatgctatttatcagatatttctctaagactggtggtggagaagaggttcctgaagtgacagaagttttaagggggaragacaaggagatggagaagaacgattttgccatcaaggatcaaggcagaggccaagcgcggtggctcatgcctataatcccagcattttgggagcctgaggtgggtggatcactagaggtcaggagttcaagaccagcctggccaatatggtgaaatcccatctctaccaaaaatacaaaaattagccaggcatggtggcacacacctgtaaccccagctacttgggaggctgaggcaggagaatcacttgaacccaggaggtggaggttgtattgagccgcctgggcaacagagtgaga

SEQ ID NO: 66525 - DNA, 601 bp, Human
tttggagcgagtgtgcagagggaggccccacactgtgggtccccaggtttaagtgttattaatcaagctcaccaacaattcaattaaatatgctctacattcctatatgttctgtctcttgggaaatataacttcataatgaccaagaaggatcgtgacaaattcaggatccctcaaaattctgcaccagttaattggccatatcgggaaagtctcctcctgcccctttcaaggacagaacctagggagatgtctacacaggcttgaggctgtttaggtatggaattccgaggtcctgggragtagtttaggaacagagacgacctcttggcttcacaggaaggagtgtggtttgagaaaggccaaagggaggattctaagtgaggggctgggcggaacccctcttgcttgggtctaaggtttaggacatggaatgaacaattttccaattaaataagttgtgagttggatttgtgtttaggtatcttgaagtctcaactttactaataattttggattgaccacagaaaagagcactctcctgtgaccagctaggcttatcttctctggagctccatttcctttgctgcaaaatgagggg

SEQ ID NO: 66526 - DNA, 601 bp, Human
agatagttctttaaagggaggaataggacattttgtgaatattctagaattagtaaagggtgaattgtaaaagtggcctcaaaagttatttaatacaacctagcttctacactgctttcttcttacagtgattacacttttcaaaggagagaatgagaataaagagaatggaaaagtgtttagttgtgatgactattcaacacagctaatcaaatattgagtaaacaaggaaatggctggcaaatgtgcatatattataggatgaatgacaggtttatagcattaaagaaataaactcatkatttttatcagactaataacagttaattttgtaaatgcactgagaacttggcaaatatcatgcaaataagatcagatttgtagactccctctccagaaaaacaagatgggaaaagaaggaaaagaataattatagtcatttttttcgaggtatcttttttctccgaaggctagtaaaccaacgtaataaattttacacaagagaatatttgcaatctctgcaaaataaataaaattaagatcaaaatatttatgacaaaacatctaaatttaccatcacacctttcaaagtatcatatgt

SEQ ID NO: 66527 - DNA, 601 bp, Human
tgtgtgatcaggtaaatcccaccatcacagggccttggtttcctcctctgaaaaatgaaccctgtccatgaaaatgagagagtcaccattacctacagctttgttgtgatttccagacaactgaaggcaataaacaatgttgacattctgtagataggtgggtaatcaaagctgtatgactcttatgtttgtgttattgatgttttaaagaaatggtatttaagttgggtgcagaggtgcatgcctgtaatctcagctattcatgaagctgaggctggaggttcacttgagcctaggagtmcaaagccagcctgggcaacagagtgagaccctgtcttaaaaaaaatgatgattaaatacaagatcaaagtgatagatttaacaaaatcagttgtataattctcataggactgcgtttgcatacacaaatatcatttggagcagataaaggtcctagagctgtcaaaatatatcattatttaaaacacaagatagttctttaaagggaggaataggacattttgtgaatattctagaattagtaaagggtgaattgtaaaagtggcctcaaaagttatttaatacaacctagcttctacac

SEQ ID NO: 66528 - DNA, 601 bp, Human
gtatgtcagtagagctggggccctcgagtggccacagtcagaagtagggctgggtggtcttcaggctgtggtgggcatatcagccaggattgtaaccagcctcagcaactcaatgatgtgagacaatttttttttccaataaatgtatttataacactttagagaaacctgattttttaaagggttgtaatgcatcacagaatcagtaatccataaagtgtgaggaccttcggtgcgtctgggcatgaatttgcatctgaaagtctcacctgggtggtttcttaacagaattaacctttaygttttgatgtgaacccaaccgaggccgtggggcataggaggtaatagtagaaacattgttctggtctgacagtgagactccttgcctggtcaccacagaatggggaaaccaagtattgtggcaattatctcaataatccaggtcaaggtaagcatccgtcttttttcaatgttagtttccgatctgatttactaattccatatatctttaagtgaagcccacccttttctcttctggacaggcccaaattctcagctgacataaatcatgacttaacacagatttcaaacccaatttgag

SEQ ID NO: 66529 - DNA, 601 bp, Human
tgatccgcccaccttggcctcccaaagtgctgggattacaggcgtgagccaccatacccagtcacagttccaatttttagctctttagagaaaatacaacaaggaggactactttttaaatggattagatcatttcaggggaactaattctgttgtgaaatcacttatcagaagactgtcaaaatcatttaaacaatctatgtttttgagccccaggaagcctggggaatctaggtgggatgccctgtggcatctagatgcttgcgtgttacaacccagcagatgagcggggggcacaagsgagagtccagttgacctgctggccagacaatgggatggtgccaggcacttagggcacttagcatgtgccgattgtatacttattgaaagtgacagggtgcagggtgataaggagaatgtgttttggtctctgactccaagggcggagcttgaaaacattcattcactcaacactcagtaattagctactgagcatattctgtgggcgtggcgtggggggagtgggcgggtcatgtcagtcattcctccctgaagcttgcaatcaagtttaaccttatttttctccagtcctgacttaact

SEQ ID NO: 66530 - DNA, 601 bp, Human; identical to SEQ ID NO: 34365

SEQ ID NO: 66531 - DNA, 601 bp, Human; identical to SEQ ID NO: 34366

SEQ ID NO: 66532 - DNA, 601 bp, Human; identical to SEQ ID NO: 34367

SEQ ID NO: 66533 - DNA, 601 bp, Human; identical to SEQ ID NO: 34368

SEQ ID NO: 66534 - DNA, 601 bp, Human; identical to SEQ ID NO: 34369

SEQ ID NO: 66535 - DNA, 601 bp, Human; identical to SEQ ID NO: 34370

SEQ ID NO: 66536 - DNA, 601 bp, Human; identical to SEQ ID NO: 34371

SEQ ID NO: 66537 - DNA, 601 bp, Human; identical to SEQ ID NO: 34372

SEQ ID NO: 66538 - DNA, 601 bp, Human; identical to SEQ ID NO: 34373

SEQ ID NO: 66539 - DNA, 601 bp, Human; identical to SEQ ID NO: 34374

SEQ ID NO: 66540 - DNA, 601 bp, Human; identical to SEQ ID NO: 34375

SEQ ID NO: 66541 - DNA, 601 bp, Human
agaggaaagaaattgagatggctcaggtgaggctgagggagtgacaaaggagactgctgctggggatggcagtgagggtggtctgagcagagtgcatttgggcatatttcagaattgttacaaaggggaattcagtaattgagttgagtccgtcctcttaagtccccatcactcgtgctttgatgagctttggtttcacttcaaatgaaaatggtttatagcatcaaaacctgtatctgtgccaaactgaatgaaacatagatttctacgatcagaaagttatttaatcaataagcctcgytctgtgagttcaacaatgccatgtaagctaaaagacatcattcctcatggaatagaagccaaggctaaattcaaattacatatcacccaaccacagggcaaagctacatagttctaggactcagatggccacaactcctttggcaatgacaggaacttgctgctgaataattttacccaggaaatcagaggtctgccagagtctttatcaaacaaccatctccaatcacacgtttattagttagttcatccatttactcttctagaaggtatctattagcaccttaatatgccaacacct

SEQ ID NO: 66542 - DNA, 601 bp, Human
gacctgctgtctttgaaggactcatgcatttacttggaggtctcaagcaggaaagtggacgtagtgtctgcagcaggaagaagtgcaggtgggccatattgactctacagcgaagaccacagtcatcaatgaagttgctcgtggaggatgtagagtaagaagagaagaggaccaagcactgaatcacgtggagacaagcacacgtaaaagaaaagaagggagtgaagctgcagagagaagcaagctgtggaagccggattctgcaagaagcagatggaaatcgggaaggaaggtttgccgkggaaaagacccggcacccaaaatctgtagacaggaatacatcagagtaaggcagccacaccaaggtgttgcaaggtgaagaggaaagaaattgagatggctcaggtgaggctgagggagtgacaaaggagactgctgctggggatggcagtgagggtggtctgagcagagtgcatttgggcatatttcagaattgttacaaaggggaattcagtaattgagttgagtccgtcctcttaagtccccatcactcgtgctttgatgagctttggtttcacttcaaatgaaaatggtttatagc

SEQ ID NO: 66543 - DNA, 601 bp, Human
aaggtgactgtttgaggggagggtcacagaccaaggatgtgcaatggcagagaggcacagtgtggcctggccagggaaggtagcacttaatttttttttttttgagtcagagtctcactctgtcaccaagctggagtgcagtggcacgatctcggctcactgcaacctccgcctcccgggttcaggcaattgccctgcctcagcctcctgagcagctgggattacaggtacgtgccaccacacccagctaattttttatattttagtagagacggggtttcaccgtgttagccactatggkcttgatctcctgacctcatgatccacccgcctcagcctaccaaagtgctgggattacaggtgtgagccactgcacctggccaaaaccaagatttttaaaaagtcatttaatctcattattttgatgaagcatagatatttttgtagtattaataaatatagttctgcagacaccgctgctgatacccaggcaaacagggtctggagtggacctctagcaaactccaacagacctgcagctgagggtcctgtttgttagaaggaaaactaacaaacagaaaggacatccacaccaaaaacc

SEQ ID NO: 66544 - DNA, 601 bp, Human
tccagcctgtgagtggataagccatggtccctgatggggagaagctcaatggattggtcaggtggatgtagaggtgctgtggttgcacagggaagggaacagcaggtgattcctaaagccggtggcaactttagggagaaggtgactgtttgaggggagggtcacagaccaaggatgtgcaatggcagagaggcacagtgtggcctggccagggaaggtagcacttaatttttttttttttgagtcagagtctcactctgtcaccaagctggagtgcagtggcacgatctcggctcactgmaacctccgcctcccgggttcaggcaattgccctgcctcagcctcctgagcagctgggattacaggtacgtgccaccacacccagctaattttttatattttagtagagacggggtttcaccgtgttagccactatgggcttgatctcctgacctcatgatccacccgcctcagcctaccaaagtgctgggattacaggtgtgagccactgcacctggccaaaaccaagatttttaaaaagtcatttaatctcattattttgatgaagcatagatatttttgtagtattaataaatatagt

SEQ ID NO: 66545 - DNA, 601 bp, Human
gggcaatggggaactgagtgaggtgaaagaaaacttcaccaagtggatggtgggagggcagcctccgaccaggggtgggatttttccaggtggagtagggggaagctggggagggttatttaacaaaagacgcccagaggtggggaattcagtatacacttagagatgaacttttagggtgtttgactttgtgtggtcgtttattcaggaaggagctgagggctgctgctccagcctgtgagtggataagccatggtccctgatggggagaagctcaatggattggtcaggtggatgtagrggtgctgtggttgcacagggaagggaacagcaggtgattcctaaagccggtggcaactttagggagaaggtgactgtttgaggggagggtcacagaccaaggatgtgcaatggcagagaggcacagtgtggcctggccagggaaggtagcacttaatttttttttttttgagtcagagtctcactctgtcaccaagctggagtgcagtggcacgatctcggctcactgcaacctccgcctcccgggttcaggcaattgccctgcctcagcctcctgagcagctgggattacaggtacgtg

SEQ ID NO: 66546 - DNA, 601 bp, Human
aggaggtgcagcctagtgagacgatccccagttgagggagcacaggtgtgtttttcatgtgtagctcctgactctgctacgaaatgcatgagcttctgagatttgagttctcctcacaggaacgatgggtgcctgccagatggcctctgtcccagcagttgtgtgttcctgtgttttaattctctgcctcacctagtcggccttccccaggccacagagtcccctccctgaaggtgcttacagacacgtttgtaggagagacagcagcggaacactcataaagaccctgcagggcagcatygacttagaatcacacaagagaggctaacatttctctaaggcactgaggagggagaacacagctccagttttgtttggtttttgagggcaaaaggggcaatggggaactgagtgaggtgaaagaaaacttcaccaagtggatggtgggagggcagcctccgaccaggggtgggatttttccaggtggagtagggggaagctggggagggttatttaacaaaagacgcccagaggtggggaattcagtatacacttagagatgaacttttagggtgtttgactttgtgtggtcgtttattca

SEQ ID NO: 66547 - DNA, 601 bp, Human
tattataggaacacagggggaacagtggggcttttgagacgcactttagctctcaggaggtgcagcctagtgagacgatccccagttgagggagcacaggtgtgtttttcatgtgtagctcctgactctgctacgaaatgcatgagcttctgagatttgagttctcctcacaggaacgatgggtgcctgccagatggcctctgtcccagcagttgtgtgttcctgtgttttaattctctgcctcacctagtcggccttccccaggccacagagtcccctccctgaaggtgcttacagacaygtttgtaggagagacagcagcggaacactcataaagaccctgcagggcagcatcgacttagaatcacacaagagaggctaacatttctctaaggcactgaggagggagaacacagctccagttttgtttggtttttgagggcaaaaggggcaatggggaactgagtgaggtgaaagaaaacttcaccaagtggatggtgggagggcagcctccgaccaggggtgggatttttccaggtggagtagggggaagctggggagggttatttaacaaaagacgcccagaggtggggaattcagt

SEQ ID NO: 66548 - DNA, 601 bp, Human
gagcaagactccacctcaaaaaaaaaaaaaaaaagtacgatatttccctgtttaactgccttgctattctttgtcaaaatgagtttgcacctccaaagagacatcagcctctctttgctcctattataggaacacagggggaacagtggggcttttgagacgcactttagctctcaggaggtgcagcctagtgagacgatccccagttgagggagcacaggtgtgtttttcatgtgtagctcctgactctgctacgaaatgcatgagcttctgagatttgagttctcctcacaggaacgaygggtgcctgccagatggcctctgtcccagcagttgtgtgttcctgtgttttaattctctgcctcacctagtcggccttccccaggccacagagtcccctccctgaaggtgcttacagacacgtttgtaggagagacagcagcggaacactcataaagaccctgcagggcagcatcgacttagaatcacacaagagaggctaacatttctctaaggcactgaggagggagaacacagctccagttttgtttggtttttgagggcaaaaggggcaatggggaactgagtgaggtgaaagaaa

SEQ ID NO: 66549 - DNA, 601 bp, Human
acagagcaagactccacctcaaaaaaaaaaaaaaaaagtacgatatttccctgtttaactgccttgctattctttgtcaaaatgagtttgcacctccaaagagacatcagcctctctttgctcctattataggaacacagggggaacagtggggcttttgagacgcactttagctctcaggaggtgcagcctagtgagacgatccccagttgagggagcacaggtgtgtttttcatgtgtagctcctgactctgctacgaaatgcatgagcttctgagatttgagttctcctcacaggaaygatgggtgcctgccagatggcctctgtcccagcagttgtgtgttcctgtgttttaattctctgcctcacctagtcggccttccccaggccacagagtcccctccctgaaggtgcttacagacacgtttgtaggagagacagcagcggaacactcataaagaccctgcagggcagcatcgacttagaatcacacaagagaggctaacatttctctaaggcactgaggagggagaacacagctccagttttgtttggtttttgagggcaaaaggggcaatggggaactgagtgaggtgaaag

SEQ ID NO: 66550 - DNA, 601 bp, Human
cgccagagcaagcctcatctgttctccttcagcctcagaagctgggaagtcaggtctggacaggcggggctctgccaccatgatgtgcaactgggtgagtgctgccccagcagtcagtgacctcctggggccaataccagtgtggtttccagggaaatccgactttctccagggagctgcttccatgcattgcaatcccatctggatttactgagtgtctagtgtgccatagaaagtatgatgtttccggctgggcgcagtggctcacgcctgtaatcccagcactttgggaggccaaggygggcggatcatgaggttaagagatcgagaccatcctggccaacatggtgaaaccctgtctctactaaaaatacataaattagccgggcatggtggcacgcgcctgtagtcccagctacttgggaggctgaggcaggagaattgcctgaacctgggaggcggaggttgcagcgagccatgattgtgccactgcactccagcctgggcaacagagcaagactccacctcaaaaaaaaaaaaaaaaagtacgatatttccctgtttaactgccttgctattctttgtcaaaatgagtttgcac

SEQ ID NO: 66551 - DNA, 601 bp, Human
tcttgtgagatccagtgaaaagtagcaaagtcaagatgatttgtcttatgggacaactataaatgttatgataaatatctgctttgatgatgcacttgtccccgtttctgaaaataaagttgcaaacagaattttgcaatgttactgatttccaatataaaaatgctacccactactcttacctcgatatttacatgctaaagtttactttataatttagaaaaaataggctttgccttaaggaatcatctgaaggtagacccagggagaatgataaggaaatataagatgcacctaatamaatctttgctcaatttgctgggccagggacacatgcaatttccgagacttgcccacaaggcggcgtcaaagcaaccagaaacgtctctgaaccacatatctttgtaaacaacttcgttttggcaggacaaacaaaaagaaaatttggaaggacaggagacagctgtggtgcaaattaaggcttcaaagcttggcgatgttggtaaaaaatttcagttttaccttaggaggaagaagtaaaacgcaaactcacacgtgcagcagagtgttcgcctcaggaatactgatatgtgttaggagt

SEQ ID NO: 66552 - DNA, 601 bp, Human
aggcagacttgctaaacaaacagaagaacaatatcaacagcagcacaagagtttttctggccatgtaaaacgtcacaggctctacttctggcttaatcccttattgtgtagttttgggaggaccctttcacccttcttgtttgtgaaaaacgggaatcatatctggcccgcttcttataagcttcttgtgagatccagtgaaaagtagcaaagtcaagatgatttgtcttatgggacaactataaatgttatgataaatatctgctttgatgatgcacttgtccccgtttctgaaaataawgttgcaaacagaattttgcaatgttactgatttccaatataaaaatgctacccactactcttacctcgatatttacatgctaaagtttactttataatttagaaaaaataggctttgccttaaggaatcatctgaaggtagacccagggagaatgataaggaaatataagatgcacctaatacaatctttgctcaatttgctgggccagggacacatgcaatttccgagacttgcccacaaggcggcgtcaaagcaaccagaaacgtctctgaaccacatatctttgtaaacaacttcgt

SEQ ID NO: 66553 - DNA, 601 bp, Human
attttctaggaaagccagatgttttgatgtcggtgagcttttttagatggagcagactgatgtgcacggcaaccccatccctgaccctccaccaccccggggcccactcctgggagacagatcagtgctaagtgaggcccaggggtgctgtgaagtctctctaaggcagacttgctaaacaaacagaagaacaatatcaacagcagcacaagagtttttctggccatgtaaaacgtcacaggctctacttctggcttaatcccttattgtgtagttttgggaggaccctttcacccttctygtttgtgaaaaacgggaatcatatctggcccgcttcttataagcttcttgtgagatccagtgaaaagtagcaaagtcaagatgatttgtcttatgggacaactataaatgttatgataaatatctgctttgatgatgcacttgtccccgtttctgaaaataaagttgcaaacagaattttgcaatgttactgatttccaatataaaaatgctacccactactcttacctcgatatttacatgctaaagtttactttataatttagaaaaaataggctttgccttaaggaatcatctgaag

SEQ ID NO: 66554 - DNA, 601 bp, Human
tcaggagttagaatggaagagaacaagaacacagccagcaagagcatgacaacactgtctcctccagtagtgagcagctgccaatcacgagctctgagcagaggaaaggaagcaggagtcccagctttaaaattaaaatttatgtgatgaggctgggcatggtggctcacatctgtagtcccagcactttgggaggccgaggcgggcagatcccttgaggtcaggagttcaagaccagcttggccaacatggtgaaactccacctctactaaaaatacaaaaatttagctgagtgtggtcrtgcacctgtgatcccagctactcaggaggctgaggcaggagaatcgctttaacctgggaggtggaggttgcagtgagccaagatcatgccactgcactgcagcctgggtgagggagtgagactgtctcaaaaaagaaaaaagttatgtgatgaataatatcccagactggatggttttaatttccccactgagacagtgtttcataacataagagtgacaataggttgtcttttatctaagagcaggccaaaaagtcatacatcctgtccaagatttcaaccagaggcaggggaagatga

SEQ ID NO: 66555 - DNA, 601 bp, Human
tgaagcagaaactcaggagttagaatggaagagaacaagaacacagccagcaagagcatgacaacactgtctcctccagtagtgagcagctgccaatcacgagctctgagcagaggaaaggaagcaggagtcccagctttaaaattaaaatttatgtgatgaggctgggcatggtggctcacatctgtagtcccagcactttgggaggccgaggcgggcagatcccttgaggtcaggagttcaagaccagcttggccaacatggtgaaactccacctctactaaaaatacaaaaatttagstgagtgtggtcatgcacctgtgatcccagctactcaggaggctgaggcaggagaatcgctttaacctgggaggtggaggttgcagtgagccaagatcatgccactgcactgcagcctgggtgagggagtgagactgtctcaaaaaagaaaaaagttatgtgatgaataatatcccagactggatggttttaatttccccactgagacagtgtttcataacataagagtgacaataggttgtcttttatctaagagcaggccaaaaagtcatacatcctgtccaagatttcaaccagaggc

SEQ ID NO: 66556 - DNA, 601 bp, Human
ggcggtttccccccatgctgttcttatgatagtgagagtatagtttcataaggggcttcccccttcccgcttggctctcattctctctcctgctgccctgtgaagaggtgccttctgccatgattgcaagtttcctgaggcctccccagccatgcagaactgtgagtcagttaaacctctttcctttataaattacccagtattaggtatgtccttacagcagcatgagaacagactagtacactgcccaagacaatctgctgggcaggaaaccaacagtgagagagtcttgcagaatcascgttggtacagtatataggccagggactggactgaatgcctgtatctcaagggtttcagccaaacacatctgcaaggataagtatttctgcagaacctagtagagtgcctcattgaagtctcagctttagccatcctccagttcaggggtaggaggctgccagccgaataagaactgtttttttctgctcatcctctttcctctctcagcttctacctggtaaggtctgaagcagaaactcaggagttagaatggaagagaacaagaacacagccagcaagagcatgacaacactgtctc

SEQ ID NO: 66557 - DNA, 601 bp, Human
atccccatgtgtcacgggagggacttgatgggaggtgattgaatcatgggggcggtttccccccatgctgttcttatgatagtgagagtatagtttcataaggggcttcccccttcccgcttggctctcattctctctcctgctgccctgtgaagaggtgccttctgccatgattgcaagtttcctgaggcctccccagccatgcagaactgtgagtcagttaaacctctttcctttataaattacccagtattaggtatgtccttacagcagcatgagaacagactagtacactgcccargacaatctgctgggcaggaaaccaacagtgagagagtcttgcagaatcagcgttggtacagtatataggccagggactggactgaatgcctgtatctcaagggtttcagccaaacacatctgcaaggataagtatttctgcagaacctagtagagtgcctcattgaagtctcagctttagccatcctccagttcaggggtaggaggctgccagccgaataagaactgtttttttctgctcatcctctttcctctctcagcttctacctggtaaggtctgaagcagaaactcaggagttag

SEQ ID NO: 66558 - DNA, 601 bp, Human
ctgtctccacgtgggtttgccttgggagctcctggctcacaccttgtgattctcagagcccagtttccacctgtaatactgtgcctgtattctcgatggatcctgggctaccacggatagggcgctgaattccgttttgatggtgaattctggagattgctgctaagatggtaatagcctgtactctcagagtttgttagagtgaagaagtcaacaatatttctggtggacagtgggtagggcaggttggggagagctggtctgtaggtattttaagtgcaattgacccttgatgaacctrgatttgaactgcaccagtccactaatatgtagattttttcaatcaaatttacaccaagtgtgcctgcctctcctgcctcccttccacctcctccacctcttttgcctctgccactcctaagacagcaagaccaactccccctcttcctcagccctctcaacatgaagacaaggatgaagatctttatgatgatctacttccacttaatgaacagtaaacacattttcctataattttcttaatagaattttcttctgtagcttcttagattgtaagaatacagtatatcatacatataac

SEQ ID NO: 66559 - DNA, 601 bp, Human
agctgggaccacaggcgcccgccacaacacctggctaattttttttgtatttttagtagagatggggtttcaccgtgtaagccaggatggtctggatctcctgacctcatgacccgcccatctcggcctcccaaagtgctgggattacaggcgtgagccaccgtgcccggctcccactaacttatttttactgttgtcagcctttttaaaaaaattggttaattttgagattagttttcattttatctgtgtttggtcattaaaagtgcctttaattgattgttgagggagttttctaagytattgcttgtttggatcatagtcagaaagtgaaagctgaatggaagtggctcaaatttttaaacatcttgttcctttacccctgggctggggatcctgtgagggctttgtcagcacttctcagattcaagatcttgattttccagggagagccctggagttgcctccaagtttctaatgcccaagacaagttgtcacttttattagagaggtggaagtgtattccctttacatttaattctaagtacttcttcaaaagcaaaaaagtagattagtgaaaaaagatgagcctgctaatatt

SEQ ID NO: 66560 - DNA, 601 bp, Human
cctgcctttatataaaataaaaaactttatatccagatcccactaacttattattttttttattttttatttttttgagatggagtcttgctctgtcgcccaggctggagtgcagtggtgtgatctcggttcactacaagctccgcctcccgggttcacaccattttcctgcctcagcctcccaagtagctgggaccacaggcgcccgccacaacacctggctaattttttttgtatttttagtagagatggggtttcaccgtgtaagccaggatggtctggatctcctgacctcatgacycgcccatctcggcctcccaaagtgctgggattacaggcgtgagccaccgtgcccggctcccactaacttatttttactgttgtcagcctttttaaaaaaattggttaattttgagattagttttcattttatctgtgtttggtcattaaaagtgcctttaattgattgttgagggagttttctaagctattgcttgtttggatcatagtcagaaagtgaaagctgaatggaagtggctcaaatttttaaacatcttgttcctttacccctgggctggggatcctgtgagggctttgtcag

SEQ ID NO: 66561 - DNA, 601 bp, Human
cgcctcaggttgtacagactaagccttgtgctcacttttttccagtgggttttgctggcccaggctttgcagtgcagcctcatgctttggactgaatggcgtcctctcaaaatacacatgttgatgccctaacccacaatgtaactgtaggtaagggctttatggagataattcgggttaaatgaggtcatggggtaaggtcttgatccaatagggctagaagtctcacatgaaagagagaccagagtttatctctctctctctctgctgtaaggacacaacaagaaggcagctgtctacmagccaggaagagagtcctcatcaggaactgacactgctggaccttaatcttggactttctgcctctaaaactgtgagaaagaaatgtctgttgtttaacccactcagtctgtgatatcttgttatggagcccaagctgacacatttcacactgagttcattattacgattgctacatttattgctacaaatgtagcaattgtaatagtgtttgaacctgcctttatataaaataaaaaactttatatccagatcccactaacttattattttttttattttttatttttttgagatggag

SEQ ID NO: 66562 - DNA, 601 bp, Human
ttcacccaccagtcctcttgtttgcttctttaaactttattatcttagtttctgctctattcaaccaaatttattttcttctcttgtggcaactctttctcttgccactgaaactctgcagatgactttttatttgggtgtttgcaaggcatttagccttagatttagttttgtttttaaataattatagattcacaggatgttgataagacagtacagagatgtcctgggtgctcttcaccctatttctcccaacggttccatcccacgtaatgatagcataagattaggagctggcctggtaccgtgtgtgtatatactacttatgccattttatcacatgtgcagatatgggcaacctccacgccaagcaagatacaaactgttccataactgcaaagatctacctgtgctgcatcctgagagtcacgcccaccctcctgtccccagcaccccaaccccaggcaaccactaatctgacttccatttctatggtgttgccactttaatgaagttatatcaatggactcagagagtatgtgatcttttgagattggctttttgcactcagcataatgccttgggttgttttatagatcaa

SEQ ID NO: 66563 - DNA, 601 bp, Human
ttggaagaaggattgtcttgggccacacctaaaatacactaacactaacaatagctgatgaactaaaacaaaaatcacaaaaaatgtcgtaatgtcataaagtttaggaatttgtgttgggctgcattcaaagccatcctgggctgtatgcagggcgtgggttgggcaagcttcatttagaacttctttttactgagaatggtggctcatgcctgtaatcccagcacattgggaggctgaggcgggcagattgctttgagctccagaatttgagacctgcctggggaacatggcaaaaccygtctctacaaaaaatacaaaaatcagctgggcattggtggcatgcacctgtagtcccagcttcatggaagactgaggctggagaattgcttgagcctgggaagcataggctgcagtgagctgagactgcaccactgcactccagcctgggtgacagagcgacactctgtcttaaaaaagaaaagaacctctttcacccaccagtcctcttgtttgcttctttaaactttattatcttagtttctgctctattcaaccaaatttattttcttctcttgtggcaactctttctcttgccact

SEQ ID NO: 66564 - DNA, 601 bp, Human
aattagtatatgttctgccttgcagcgactcaacccactgaggtcctgaggatgacaggtgacctcatgggagtggggccaggctggaagctccgcccctggaaagctgcactgaggaaataaaatacctgaagacttgattttgtctgtaaaagctgtcaggacggaggtttacattgatgggaaaaaatagccaggatgtagttgaagtttgtttaagtttattggacagtctgtgcaagaaagcagctccaggctgcagaggacagccagcagtagtgctgacagattgtacctggarcctgccttccctcttcagtccctcctcagatatgtctttctatgaaaggaagagatatttatgttctatatcattagtttcccatcattttcaaacaaatagacaggacatcctggatggataaatgaggaagtaaagagtgttttttttcttttttttgagatggagtcttgctctgtcacccaggctggagtgcagtggcgcgatctcggctcactgcaagctccgcctcccgcgttcatgccattctcttgcctcagcctcccgagtagctgggactacaggcgcccaccaccacac

SEQ ID NO: 66565 - DNA, 601 bp, Human
atacaaaccataaaacagcaggagtcatcacatggagctgattgatgttttagaagcaaagaggggctgggcacggtggctcatgcctgtaatcccgtcactttgggaggctgaggtgggtggatcacctgaggtcaggagtttgagaccagcctagccaacatagtgaaaccccatctctactaaaaatacaaaaattagccgggtgtggtggtggacgcctgtaaccccagctatgcgggaggctgaggcaggagaatcatttgaacctgggaggtggaggttgcagtgagccgagatygcaccaccactgcactccagcctgggcaacagagcaagactccttaaaaaaaaaaaaaaaaaaaaggaagcaaaaggaataagtgacttgccctatatcccttctcctgaaacaatgatactaaatgataaatgattggtctctgcttcttaaggacatttggatgaaacgagattagatagatggcgtaagtgtctcaggaaggggccaaaacctcgctcatgttgttctaatgagatgcttcagcaaagtaggctggaagtaactgccctgggccgtgtgtgctgcaggctgggtttt

SEQ ID NO: 66566 - DNA, 601 bp, Human
atggagtgggtactaaaagcccttcatcaccactgtgcaatccacataggtaacgaaatgacacctgcaccccatacatttatacaaaccataaaacagcaggagtcatcacatggagctgattgatgttttagaagcaaagaggggctgggcacggtggctcatgcctgtaatcccgtcactttgggaggctgaggtgggtggatcacctgaggtcaggagtttgagaccagcctagccaacatagtgaaaccccatctctactaaaaatacaaaaattagccgggtgtggtggtggacrcctgtaaccccagctatgcgggaggctgaggcaggagaatcatttgaacctgggaggtggaggttgcagtgagccgagatcgcaccaccactgcactccagcctgggcaacagagcaagactccttaaaaaaaaaaaaaaaaaaaaggaagcaaaaggaataagtgacttgccctatatcccttctcctgaaacaatgatactaaatgataaatgattggtctctgcttcttaaggacatttggatgaaacgagattagatagatggcgtaagtgtctcaggaaggggccaaaacctcgc

SEQ ID NO: 66567 - DNA, 601 bp, Human
atagatgctcagtagatgcctgcagagtaagtgaataagctgtctttccattttgtttatctgcagatcacgcatcttctatcctcattttatctcggttgcctgttttcagcatagaaaagaagcaccaagttcacggtaagatatatttttctgtagactcagaaaatggagtgggtactaaaagcccttcatcaccactgtgcaatccacataggtaacgaaatgacacctgcaccccatacatttatacaaaccataaaacagcaggagtcatcacatggagctgattgatgttttmgaagcaaagaggggctgggcacggtggctcatgcctgtaatcccgtcactttgggaggctgaggtgggtggatcacctgaggtcaggagtttgagaccagcctagccaacatagtgaaaccccatctctactaaaaatacaaaaattagccgggtgtggtggtggacgcctgtaaccccagctatgcgggaggctgaggcaggagaatcatttgaacctgggaggtggaggttgcagtgagccgagatcgcaccaccactgcactccagcctgggcaacagagcaagactccttaaaaaa

SEQ ID NO: 66568 - DNA, 601 bp, Human
gggctcagctttcacccccttttccttgtgaaactttctttgattacctcccctgacagggagctctctctcttctgttcaagtcatattcaggattgatcaccctatcatacatcattcacatcactcatgattcttacgactgatacatcatccactccaaccaatgttctttgagaggcaggcactgtgctagatgcctcagtgattttcaaacaaattctaagagaaacaaattcatcatcccagttgtcagctgaggaagccgagcttcagaggatctagcactttgatgacaagyggcctccttccccctcatcctgatggataatctctcatctgtgtaccacacaacatcttcgctccactggagaattagcacattgtatcttttttccaaggttgtcttctttcctaccacactgtaagctctggaggccgggcaccattgacatatctattccttacagaagctagcatagtgccgtgcacaacatagatgctcagtagatgcctgcagagtaagtgaataagctgtctttccattttgtttatctgcagatcacgcatcttctatcctcattttatctcggttgcctgt

SEQ ID NO: 66569 - DNA, 601 bp, Human
ttagcagtctcaacttcctctctcccccttaccatatggggactgctgaggactctctagggaaacttggggttccaaagtacccaattagaaagccactgcacggtggaaataacacgacagctatccgagagactgactacccacgtcgccttggataagttttctgagtctcagtttcctcgtgtgtaaaggaagggctagacaaggtgatctctagggcttggagagttctgacatcctcgggtcctcggctggcattcaaggctctctggagtctgacgctgactcacaggacctwccatttcccattaggaccctctccagtccagacatttctgctcaccgaaaacaccacctgccttcctgtctctgtccctcactaatgacatttccatcttgccatgagataccctcccctagtcgactcctgcttccctcccctcatctttaaattctgccttatctttcagggctcagctttcacccccttttccttgtgaaactttctttgattacctcccctgacagggagctctctctcttctgttcaagtcatattcaggattgatcaccctatcatacatcattcacatcactc

SEQ ID NO: 66570 - DNA, 601 bp, Human
agttccgggtgaaatgtttgtgcaatcacccggtgtatctgattggcaaattcttagcagtctcaacttcctctctcccccttaccatatggggactgctgaggactctctagggaaacttggggttccaaagtacccaattagaaagccactgcacggtggaaataacacgacagctatccgagagactgactacccacgtcgccttggataagttttctgagtctcagtttcctcgtgtgtaaaggaagggctagacaaggtgatctctagggcttggagagttctgacatcctcgggycctcggctggcattcaaggctctctggagtctgacgctgactcacaggaccttccatttcccattaggaccctctccagtccagacatttctgctcaccgaaaacaccacctgccttcctgtctctgtccctcactaatgacatttccatcttgccatgagataccctcccctagtcgactcctgcttccctcccctcatctttaaattctgccttatctttcagggctcagctttcacccccttttccttgtgaaactttctttgattacctcccctgacagggagctctctctcttct

SEQ ID NO: 66571 - DNA, 601 bp, Human
tgaaatagtgcttcacttgtgttatctgagtacttgaaaatcttcaaaggctccgttctaccaaaaaaatataaagaccaaacaacatgctattgtaaagtgaagttttttcgcttttttaaaaaaaagtaggagaatcttttaaagttccgggtgaaatgtttgtgcaatcacccggtgtatctgattggcaaattcttagcagtctcaacttcctctctcccccttaccatatggggactgctgaggactctctagggaaacttggggttccaaagtacccaattagaaagccactgcrcggtggaaataacacgacagctatccgagagactgactacccacgtcgccttggataagttttctgagtctcagtttcctcgtgtgtaaaggaagggctagacaaggtgatctctagggcttggagagttctgacatcctcgggtcctcggctggcattcaaggctctctggagtctgacgctgactcacaggaccttccatttcccattaggaccctctccagtccagacatttctgctcaccgaaaacaccacctgccttcctgtctctgtccctcactaatgacatttccatcttgc

SEQ ID NO: 66572 - DNA, 601 bp, Human
ttttaaggagcctaaggttctttaaaacagaaaacatggtggaacgcgtgattttccaggaggctttcccagggacttgacctccattcacacctaaattgcgagtctcttgtttttactgctcataaacatagccagcctgcatgttctgaaatagtgcttcacttgtgttatctgagtacttgaaaatcttcaaaggctccgttctaccaaaaaaatataaagaccaaacaacatgctattgtaaagtgaagttttttcgcttttttaaaaaaaagtaggagaatcttttaaagttccrggtgaaatgtttgtgcaatcacccggtgtatctgattggcaaattcttagcagtctcaacttcctctctcccccttaccatatggggactgctgaggactctctagggaaacttggggttccaaagtacccaattagaaagccactgcacggtggaaataacacgacagctatccgagagactgactacccacgtcgccttggataagttttctgagtctcagtttcctcgtgtgtaaaggaagggctagacaaggtgatctctagggcttggagagttctgacatcctcgggtcctcgg

SEQ ID NO: 66573 - DNA, 601 bp, Human
tatttatgaagtaaccatgagttatagggcattttaaggagcctaaggttctttaaaacagaaaacatggtggaacgcgtgattttccaggaggctttcccagggacttgacctccattcacacctaaattgcgagtctcttgtttttactgctcataaacatagccagcctgcatgttctgaaatagtgcttcacttgtgttatctgagtacttgaaaatcttcaaaggctccgttctaccaaaaaaatataaagaccaaacaacatgctattgtaaagtgaagttttttcgcttttttwaaaaaaagtaggagaatcttttaaagttccgggtgaaatgtttgtgcaatcacccggtgtatctgattggcaaattcttagcagtctcaacttcctctctcccccttaccatatggggactgctgaggactctctagggaaacttggggttccaaagtacccaattagaaagccactgcacggtggaaataacacgacagctatccgagagactgactacccacgtcgccttggataagttttctgagtctcagtttcctcgtgtgtaaaggaagggctagacaaggtgatctctagggc

SEQ ID NO: 66574 - DNA, 601 bp, Human
catctgagtgaagagaattaccctcagctcctgcaaacctgctggaggagcaatatttaattcaaggtccatctaataatttctgagctggcacatacatacatatgtacattcctctctgcactgttccttctcctgttctttctgcctaagaagttaaaatgaacactggcaagacaggaaagaaacttggatatttttcaaacttaaataaaacctgtcaagggcattaagaaacaggagagtctaaacattaacttagaaaagtaacaggtcccctgggtgtctggagtagttaccrgttattcttacatcagctagatgtttatttatgaagtaaccatgagttatagggcattttaaggagcctaaggttctttaaaacagaaaacatggtggaacgcgtgattttccaggaggctttcccagggacttgacctccattcacacctaaattgcgagtctcttgtttttactgctcataaacatagccagcctgcatgttctgaaatagtgcttcacttgtgttatctgagtacttgaaaatcttcaaaggctccgttctaccaaaaaaatataaagaccaaacaacatgctattg

SEQ ID NO: 66575 - DNA, 601 bp, Human; identical to SEQ ID NO: 34376

SEQ ID NO: 66576 - DNA, 601 bp, Human; identical to SEQ ID NO: 34377

SEQ ID NO: 66577 - DNA, 601 bp, Human; identical to SEQ ID NO: 34378

SEQ ID NO: 66578 - DNA, 601 bp, Human; identical to SEQ ID NO: 34379

SEQ ID NO: 66579 - DNA, 601 bp, Human; identical to SEQ ID NO: 34380

SEQ ID NO: 66580 - DNA, 601 bp, Human; identical to SEQ ID NO: 34381

SEQ ID NO: 66581 - DNA, 601 bp, Human
agagacagtgtcaaaaaaaaaaaatcttcgagaaaatccatttgaaacaaggaatgaaatttaaaatttgcatatataaacacgtatacatatacatatcatgtatatacataggattatgagaagtagtaatgttctaaaagtgagtatgcatatttttaaaaatttctgtaaagttgcacttgtaaggaaattcctaggtgttatttcctaagacgtaaaagcagtgtatacatccttgaagctaaacttttctgagatcttaaattctcccagtgtttgatatatgagtactcatgtytccagcaaattaacctgaacttaaagagcttcctgatagcttcttagttggggggtgggagtgcagagaataaaaggaaattcattgaagaataaaagataatttcttgagaaacctgctcatcgggaccctgttaacatccaaatatcccaaatatcatgccacactattcttcccagaattaattgtcaaggactgagaaggacaggagaacctaatgctatttcaggctctcttgacagaccaaggaacagtgaggcataaactggggtccccgtgggtcacaggcaagaggtggaa

SEQ ID NO: 66582 - DNA, 601 bp, Human
taaaacacataggtcaggcgcgatggctcacacctgtaatcccagcactttgggaggccatggctggtggaccacaaggtcaggagtttgagaccagcctgaccaatatggtgaaaccccatctctactaaaaatacaaaaattagctggtcgtggtggtgcacgcacctgtaaacctagctactcaggagtctgaggcacgagaattacttgagcccatgaggtggaggttgcagtggactgagatcacgccactgcactccagcctgggcaacagagtgagactctgtctcaaaaagtaaaaaaaaaataaataaaaatgtaataagtaaataaaatgccctctttaaagacactcctacatctgggccagtacacagcccagcatgactgggcacttcccctaaacaagcaagcagactcctgaaatgcatcattatgtttcatttcttaataaattctttctacagccagttagcattctacttgttgccattatagactttcaaaaaacactataaactttcttatctgtcttcctgagtaagcaaagggaagacattattagaaaattcacactcaattaggaagagtggtttga

SEQ ID NO: 66583 - DNA, 601 bp, Human
ggaccacctgctgctccctaaggcactcctgtgttttggctcattggggtctctctccctggaatctcattgatggaaatttactggtcccttggggctccctttacatgtcatcctcatgaagccttctctgatagcccaacgctccgtagatcttaccacactctgactggtattactatatttatatctatgtttttctcctcctcaccaggttataagttgcttaagtgtcaggactatatctccctcatttttgtatttcctatagtgttgaggggcagatggggtatggatagaygttgagaatggcgtgaaggagtccttatgggactctagttcccctgctccctccaagaccactcagacccttggataagtcaccaatagctagaaataacacgagtttacttgaaatgtgtcttccagaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaaagggtgcgaggtgggtga

SEQ ID NO: 66584 - DNA, 601 bp, Human
gaagttactttataaatggtagttttaaattttcttgtagttctttattgcctactaggtgaagttaagaagttatcactaggagaattctctttctgaccacatcccagggcccagcaatatacagactaaaaatgcctaatgccttagatgattcattttacctcatcctaactttccagtttgaattccccatatccccaccctccctgtccagggcaggagcacattggaccacctgctgctccctaaggcactcctgtgttttggctcattggggtctctctccctggaatctcaytgatggaaatttactggtcccttggggctccctttacatgtcatcctcatgaagccttctctgatagcccaacgctccgtagatcttaccacactctgactggtattactatatttatatctatgtttttctcctcctcaccaggttataagttgcttaagtgtcaggactatatctccctcatttttgtatttcctatagtgttgaggggcagatggggtatggatagatgttgagaatggcgtgaaggagtccttatgggactctagttcccctgctccctccaagaccactcagacc

SEQ ID NO: 66585 - DNA, 601 bp, Human
atagagactaaaaacactcaagttgactaatatgtcctcataaacccttgccatgttaaatggtggctttggaaattttcagaatgaaaatctgcccttatgaatcagctagaaattgcatctgttgacagtctgatttcattagagaactcttaccctgaggaataaaaagtctgatttgtttcaagactaggttcctcttggagaaaaagtctgtgatgagatggtttcttaccctggagtgatgcctagaaattcctgttgattccagaaacttgacccctgtcattgtctttggccwctgggtcctcatttgccttgtgattggactattttaagagcctcatgacctgtctctgtgcacctgatctctctccactctatgccagtatcatctccataaagcgctgaccctgtttgcaatgaacagaaacagaacaatccagggagaccaggttcaaaccctggcactctcactgcctgtgcgagtctgagttttgggttcttgcttcatctaggggttcatgatatccatactgcaaagtggctatgaagattacaataggacacatatctggcacatagaagttactttataaat

SEQ ID NO: 66586 - DNA, 601 bp, Human
cttacagcctcaagacatgtcttgaagatgaatgaagtaacagtagcaataatactttgggatctcaagaagttgaaagattaaatgtgaagggttaaacattttgtgtttgactgacaaaggtgaagatgggaaattccattgtgggcagttgtctttacaagaatggataattacacaaacacattatctcaatgggtttccacactgtttttttaaagaattatttttgagtctagaggataaagatttgatcacagaattcctagaatgaaagaaagatgatcaagggacatacaarctctcagaatttccacagttctgagaaaggtgccttcaataacgtgccatattggtaataccaggagaattctctttctgaccacatcccagagcccagtaatatagagactaaaaacactcaagttgactaatatgtcctcataaacccttgccatgttaaatggtggctttggaaattttcagaatgaaaatctgcccttatgaatcagctagaaattgcatctgttgacagtctgatttcattagagaactcttaccctgaggaataaaaagtctgatttgtttcaagactaggttc

SEQ ID NO: 66587 - DNA, 601 bp, Human
gaaggttgcagtgagttgagattgcaccactgtgctctagcctgggcgacagagcgaaactgtccaaaaaaaaaaaagattcccctttctcttctctcagggaatggcctgggatagagaagagaaacaggttcccactcatgtaaaacttctcccatgggagacaaggacattgtttgaggggaaaattcctacacaagcaaacaaacagcagaggaccccgccctccctgtccagggcaggagcacagtggaccacctgctgcccctgtgtcttggggcctctctccctggaatgtcaytgatggaaatttaccagtccctcagggctccctttccatgtcaccctcatgaagctttctctgatagccccatgctcagtagatcttaccacatatgacttgtgttaccatgactatatctatgcctttctcctcctcaccaacttatgactctcttaaggatcaggactatgtcgctcatttttacatttcctatagtattgaaaaggggcatgagagatattggatagattttgagaattgagtgagtggagtttttgcgttgacacctgcaactgcagcaattacagaagcagtggg

SEQ ID NO: 66588 - DNA, 601 bp, Human
acgcaacatagcaaaaaccccctctctactaaaattacaaaaaaggagccaggcatggtggtgcacacctgtaatcccagctactcaggagacagaggcaggagaatcacttgaacccaggagctgaaggttgcagtgagttgagattgcaccactgtgctctagcctgggcgacagagcgaaactgtccaaaaaaaaaaaagattcccctttctcttctctcagggaatggcctgggatagagaagagaaacaggttcccactcatgtaaaacttctcccatgggagacaaggacattgyttgaggggaaaattcctacacaagcaaacaaacagcagaggaccccgccctccctgtccagggcaggagcacagtggaccacctgctgcccctgtgtcttggggcctctctccctggaatgtcactgatggaaatttaccagtccctcagggctccctttccatgtcaccctcatgaagctttctctgatagccccatgctcagtagatcttaccacatatgacttgtgttaccatgactatatctatgcctttctcctcctcaccaacttatgactctcttaaggatcaggactatgtc

SEQ ID NO: 66589 - DNA, 601 bp, Human
gcccaggctggttttgaactcctgggctcatgggatcctcctgccttggcctcccaaagtgcaggtattacaggcatgagctatcacactcagcctattttctcatttcagtcgcaagttctgtgtgggtaaaagcaatgcgtatttattctctgacttgatagccttgttactcaaaatggggttcatgcacccacaacataggcctcctgtggaacctgtttgcaccagaatcttaggcggtaacccctgacctcccgagtcagaatttgctccgtgacaagatccctggatgatttcyaaatgcattaaaggttgagaagtactgcttgagcatacctgttcctagtgaatcagaccaaccatggaaatcattattccatctctctaatttggtgagtttcaatcctaagtgcgatttggaagtattcaaggaactggaagggaaggtattgtgatgttcggttctgttccccagagagtccgcttaattcatcttatgagtcttggccatcactttttaaagcatcctggatatacactaatgtacagctggcgttttgaaccattactctccacacatttcccagtgggaactgtg

SEQ ID NO: 66590 - DNA, 601 bp, Human
ctctttggctgccatccagggtcatgtggtgctggtgataagtgatcagtgacccattgaaccgaggacgtctaccggggaccaatgacacctgtagacactgcagggttgaagctgggggagaagcactcacatgctgtctgtctgagcaaaagtattcgtttttgtccgagaatctgagactcatttgcttggcacacacacacaaaactgcatgtatgttgaaatatggctcattatgtagttgtcctggcaaacccctcatctctctaattggtcagctcactactcatggaacacrgtccatgtacacgactccagcagcatcactagaaaacaccattctccagcccctctcctgatattcagaaccaccattcagagccaggaggtcccagggccaccttctctgagaattttttttctagttctccaggtagcatgttactctccctattctgatcatttatggcattatttgcaatgtttgatcaatatttgatctttcccagattggttttccctttttctaatttttttttaagaggcagagtctcactatgttgcccaggctggttttgaactcctgggctcatgggat

SEQ ID NO: 66591 - DNA, 601 bp, Human
acatgggccagcgagctcatccggccacaccttccaccatggggcaggcccctctactggcacaggatgtcaatactcctgatccgtatcttgccttccctccacccgttcctcttcctcccagcacagtgaccttccggtcaaccccacccatgccacccacactttgttgccctggagtttcctgccacctgaacccctccttaagcaggatgcctggatccgggtcgagggctgcaggcggagctgctggtcaaaaaccccccggggaactggttgggtgtgggagtgggagaatggkctgtcaggacaaaagcactgggactccagccctgtggtgtgcacgtggctcgggctgggtcaggaaaaaaatgtggaggtagggaaacaagacccaggaactctttggctgccatccagggtcatgtggtgctggtgataagtgatcagtgacccattgaaccgaggacgtctaccggggaccaatgacacctgtagacactgcagggttgaagctgggggagaagcactcacatgctgtctgtctgagcaaaagtattcgtttttgtccgagaatctgagactcatttgcttggcacac

SEQ ID NO: 66592 - DNA, 601 bp, Human
ctgcatacagcgtgggaggaaaaagcctgggaaacggggggacatgggccagcgagctcatccggccacaccttccaccatggggcaggcccctctactggcacaggatgtcaatactcctgatccgtatcttgccttccctccacccgttcctcttcctcccagcacagtgaccttccggtcaaccccacccatgccacccacactttgttgccctggagtttcctgccacctgaacccctccttaagcaggatgcctggatccgggtcgagggctgcaggcggagctgctggtcaaaamccccccggggaactggttgggtgtgggagtgggagaatgggctgtcaggacaaaagcactgggactccagccctgtggtgtgcacgtggctcgggctgggtcaggaaaaaaatgtggaggtagggaaacaagacccaggaactctttggctgccatccagggtcatgtggtgctggtgataagtgatcagtgacccattgaaccgaggacgtctaccggggaccaatgacacctgtagacactgcagggttgaagctgggggagaagcactcacatgctgtctgtctgagcaaaagtatt

SEQ ID NO: 66593 - DNA, 601 bp, Human
cattttaaaaaatagaggtggggtctcactatgttgcccaggctggtctcaaactcctgggctccagggatcctcccctcttggccccccaaagtgctgggattacaggaatgagccactgcacctggctgcagcttcctttttattcttttgaaacattgctctttcttcttcttttgggtaaaaggactcaattgctgctagtccaattgcaccagcttgttcttgcactgcatacagcgtgggaggaaaaagcctgggaaacggggggacatgggccagcgagctcatccggccacamcttccaccatggggcaggcccctctactggcacaggatgtcaatactcctgatccgtatcttgccttccctccacccgttcctcttcctcccagcacagtgaccttccggtcaaccccacccatgccacccacactttgttgccctggagtttcctgccacctgaacccctccttaagcaggatgcctggatccgggtcgagggctgcaggcggagctgctggtcaaaaaccccccggggaactggttgggtgtgggagtgggagaatgggctgtcaggacaaaagcactgggactccag

SEQ ID NO: 66594 - DNA, 601 bp, Human
tttgtctttgacctttagcagcagtttagacaggaggaaaaaaggcaggttctggaatgagagcgcctgcttcctatcctagccccttcctcgttgggctacatcaggcaacccatttaatctctgtaagcccatttaaccacagttcaccaggcagaaaatggggataatcatatgacctactttattttgagaattaaccaaagtaatactatgtctgaacataatacctgaaagatagcatttaggcaatggatattcactgtggtggttctagctagtgttcaaatgttttctggawcaaagcttgaagcaaataagaacgaaaggaaacataactatcagtatcggagttggtgcatgggccggctttaaccagtcatgtttcctagtctatagctttgctcattttcttaccaaaggaaatcagggcctgttggagactgtcctattttccacgctctttagaataaagaaaccaatggctttcacaaacttccttatttaaaattaattatcattttaaaaaatagaggtggggtctcactatgttgcccaggctggtctcaaactcctgggctccagggatcctcccctcttg

SEQ ID NO: 66595 - DNA, 601 bp, Human
actgctgtagcaacaacttctctctgaaaaccttcccaggggagaaaacgcgccccccctcacgcctcagaggcacacacctatcctagcctttgtttttttattgctgagagtacagaaagcagcggcttctgaaggaggtatctattttggtcccaaacagaaaagagtgggtgattctgtgggcagaggtggcaattcctgaatgtggtatggtgactcacgcccggaggtgctcagaatttcctctgttttgtggctgctggggcaggtgcgacactgccgctttctctaaagatgcccccaagctgctctgggggtagaaggaaggctgcagggaacagcaggacccggagaacccagaccccaaggaccaggtggtccttaagccatcctgcaggaggccggctgctctagcaggttgaggagtgccacgcggctctgtgggtaccgcctcactgcatgtacctggggctgaaggagcagtgggcattactcacagcctattacttcacctttgtaaaaaacaaaaataacttccctgctcacatggcacctttgtctttgacctttagcagcagtttagacaggaggaaaaaag

SEQ ID NO: 66596 - DNA, 601 bp, Human
ccgggagtgctcagagctgggatcccagtgcaggacgaggaggaggaggatgggtgccctggctacaggtcctcttgcactagattgaaaacggggccagagaagcagagcttgagagacgctgggagagggaaagtgaaactgatggtccggtgggtgaaaggtagtgaaagcccgaagtgcagtaaaccagggatcaacatctccagccaaaaggctcaccctgtggtctcagcgccacctgggcgtcagacagatgtctggagagacggctcttttattctgaaacacccctccaacttttttttttttttggtaattgtttgttttgctttccatttaatataaggagttttctcctttacaaaagttctttttgttctaaatcaggctgtaaacagaggtgctaccacaaggaccggaagcagagaccacactggtgctcagctgggttgcaggctctgcctggtttcattgtcggggaagccaccaggcctgcccccagccagcgagatgtcacgcatgcagccgggtgtcatccccaaaactcccgggaaactctcggggcaccagggcaggaagaggctgacgtcaactttaa

SEQ ID NO: 66597 - DNA, 601 bp, Human
acttttccattctctcaagacgcttttctggttgggaaaaattccggtaggcagacaagatggggaagattgttccagtaagggaggagggtgttcctgggagtccagctttgaaatcacaaatgaggaggttccctttgaaggacaggaggagacctgctggccaaggcgtgctatgtgctgagggaacagtcttggctggggagcatgttgtgtgccaggcagaggaggtagcaaagtgcccctgaggcaatggaaatgactggagctcttgcagccgaaagggcatcacgacaggtgytttcaggggagattaacttggggatgaataacagggtgactgaaaaccagagcttcagggcctgcctaggaagcccaggagatgaacagtgcctgttgacagcttgcttcctgtgtcggcctgaatgcatgggttctgctcagatctactggctccttgctttcttgggagagtgaattactgcctcatggtctcagtttcctcatccgtaaaatgggaatggtggcagggcgtggtggctcaagcctgtaatcccagcactttgggaggctgagactggtggatcaattgaggtcagga

SEQ ID NO: 66598 - DNA, 601 bp, Human
gatttgaattcaagctgtcaactttccaaattcataagacttttccattctctcaagacgcttttctggttgggaaaaattccggtaggcagacaagatggggaagattgttccagtaagggaggagggtgttcctgggagtccagctttgaaatcacaaatgaggaggttccctttgaaggacaggaggagacctgctggccaaggcgtgctatgtgctgagggaacagtcttggctggggagcatgttgtgtgccaggcagaggaggtagcaaagtgcccctgaggcaatggaaatgaytggagctcttgcagccgaaagggcatcacgacaggtgctttcaggggagattaacttggggatgaataacagggtgactgaaaaccagagcttcagggcctgcctaggaagcccaggagatgaacagtgcctgttgacagcttgcttcctgtgtcggcctgaatgcatgggttctgctcagatctactggctccttgctttcttgggagagtgaattactgcctcatggtctcagtttcctcatccgtaaaatgggaatggtggcagggcgtggtggctcaagcctgtaatcccagcact

SEQ ID NO: 66599 - DNA, 601 bp, Human
aaaccaataggatgtatgtagataaataagagaatatttataatgggagttggctcactcaattatggaggctgagaagtcccacaatatgccagctggagctggataactaggaaagctggtggtgtggctcagtctaagactgaaggcctgaggagcagaggggccctgctgtaagtcccagagtccaaaagctggagaaccaggagtgcaaatgtccaagagcagacgacggatgtcccagcttgaacagagagaatgcaaccttcctctgccttcttgttctattctggtcctctawggttggatgatccccaccacactggtgagggtgattttctttactcagtctaccaacaagaaatttacccagtctattcaattcaaatgctagtgtctcctggaaataccctcacagacacccccagagagactgtttagccagctatctgggcatcccttagcccaggcaagtggacacattgaaattgaccatcatgctcatgccacacttccctaatgcatttctaccttcttaactcctgctttccctggaggtctcccattggctgtcatctttctctgggaagcctccgggact

SEQ ID NO: 66600 - DNA, 601 bp, Human
tctctgcttccactatgtgcctgagctctcctgccttgcgggactctgcgtggctcttggagctcaccatgtgttttgtcttgggccttggtcattgtattattcagggaaacagaatttctctagagaaacaaaaccaataggatgtatgtagataaataagagaatatttataatgggagttggctcactcaattatggaggctgagaagtcccacaatatgccagctggagctggataactaggaaagctggtggtgtggctcagtctaagactgaaggcctgaggagcagaggggcyctgctgtaagtcccagagtccaaaagctggagaaccaggagtgcaaatgtccaagagcagacgacggatgtcccagcttgaacagagagaatgcaaccttcctctgccttcttgttctattctggtcctctaaggttggatgatccccaccacactggtgagggtgattttctttactcagtctaccaacaagaaatttacccagtctattcaattcaaatgctagtgtctcctggaaataccctcacagacacccccagagagactgtttagccagctatctgggcatcccttagccca

SEQ ID NO: 66601 - DNA, 601 bp, Human
tgcctgtcctcccgcctatcctccctcatgtgctggctgcatcctgctcccgtggcccctgaccctcaactgcccttgtcatgtgcccgtcatgcatcacaggaaggctgtcatgggagtcctgaggtgggtggtgataagtaagcaagaagaggggttgctggcgttaagagattttagaagttggaattgccaaaaattgaggctggattattaggtgcatggaggacagcaaggaagaaatgaggattttgcccagatttcctgggcgatggggaggatggggtgccattcattgagwtagcaaagagaggagaaagagtaggttccagggagggaggacagttctggatgtgtagactgagcagcctgtgaggcatccacacggaaaggtccgagggaagggcctttggccatgcagactagaagcccagcaagtcacatttagtgagcacctactgtgtgctctggtcactctaggcaggctagcttatgtagccttacagcacccagcagggtctgtgttattcccattttatacgaacagaagctgaggcccaccgaggttaaaaccctaccctcatggacttccatggaggtt

SEQ ID NO: 66602 - DNA, 601 bp, Human
tgtgccacactcagaacgcgggatgaacatagaggaaacactagaatggcaaaggctggttgtcacctgggggcctcagaagccacggcaccagaggagagctcaggagtcagcctgctccaaagctcttcctgcctgtagcatgcaccctgtgcctccgggccaccaaaaacagcaatcacgtcagctgagacgcaacacactgcatgccgaacacacaggagagctcacacgcacaaatgttctcggcttcccagacaccaatgaaggagcttattatgaatatgaaggataattaacrtatctattattttattagacatcacaattcaaatacaataaagtatataaatataaatatataataaatgaaatatataaaataccatcttagcttatgaaattatcttatatgataaaataattatacagatatataataagcaattagggtatgttatataaaatactatagtatactcattaatataattagtatattatatgataaatatatataataaaagacatcatacactaatagagtataatagtcaatataattaaaattattacttatgcagtaattaattatgaggtg

SEQ ID NO: 66603 - DNA, 601 bp, Human
gcatgcttgcatggagaacatgcattgtccaaggaccctcaaatccctgcatgccctgcgcatgccctaaccctgaggaggtgctgaacccttgctgatgtgcagaaggggttaatcagaccatgtggacacaggtagcccaaggaacaacccccatgccaacagcactccatcccgacctcataccatgtgcacagcacctgatgctggtggggtcaggagtgtggcctgtgccacactcagaacgcgggatgaacatagaggaaacactagaatggcaaaggctggttgtcacctgggkgcctcagaagccacggcaccagaggagagctcaggagtcagcctgctccaaagctcttcctgcctgtagcatgcaccctgtgcctccgggccaccaaaaacagcaatcacgtcagctgagacgcaacacactgcatgccgaacacacaggagagctcacacgcacaaatgttctcggcttcccagacaccaatgaaggagcttattatgaatatgaaggataattaacatatctattattttattagacatcacaattcaaatacaataaagtatataaatataaatatataataaatga

SEQ ID NO: 66604 - DNA, 601 bp, Human
tatattaatctttgtgtttttctgtattggttgaaattttaataatttttaaatatttatagaacaaataggtttttcttgacaacctcccaaatgttaattctttaccaaagcttcttccaaaggaagtgattagttcagggccttttccttctgtctgtggatgtggaactttatcagagaaagaaacccccctctcccccaactcagtggcaagtccacagcggggaaagtctaactcccaattttatttatgaagtcaatcatccaaatcacctctcagtcctcagcagctgaattmaacacaatgattaagcctagagcatcttcctagagaaggtggtagtgatgcaggacaagcgagccccgaggtggggcttagcccgcaagggttcttggctttgcccaggaaggaattcaggggcaagccagtggtagaataaaagaaaacagctttattgaagtggcaatgttatagttccggctgtgctacagctccgtgactgcttctgtagagcagggcgaccacataggcagagagtagtaggtcagggcagttttgcattcatatttatatctgcttttaattacatgcagttta

SEQ ID NO: 66605 - DNA, 601 bp, Human
cattcaaggctgtttattagagcattgcttgtaatagggaaaaatcagatacaatctaattgtccatcaaaagaaggttagattaataaacttggcattatcaagaactctgtattattatacaatgtaataatgtacagttgttaaaaagaataaacatcaaaaatgaatctcagaaacactgctgagtgaaaaaagcaaagttgcaaatagaaacagtatattatgcatttatgtataaaataaaaaacaaaccagtagtgtatattgcatcatgagatacagcccagattcaagagarcaattactggaggggaagaatgagattgggttggaccgagagggagctccactgtatctacagcatgtatttatttgtttttgtttgtgtttgttttgtttttttttgagatggagtcttgctctgtcacccaggctgcagtgcaatggcgagatctgggctcactgcaacctctgcctccaaggtttaagtgattctcctgcctcagccccccaagaagctgggattacaagcgcctgcatcacatcaggctaatttttgtatttttagtagaaatggggtttcaccatgttggccagg

SEQ ID NO: 66606 - DNA, 601 bp, Human
tagacagtagacactgaaagcttacagaaaataacatgtacgtgataccttaaaagccttctatttaatggtggaaacatatacaattcctgcttttattctatactgtattgaacaccccagctaatgcaatggaacaagcaaaagaaattagaggaataagaagtggataacaaaaaataaaattgtcatttataagtaataacgtctacttagaagatccaagaatctatacttatccaaagactcagtatccgtaatacataaggaagacttacaaatcaataagttaaaggccaasaacccaataaaaatagggacaaaggatatgaacaaggaggccacagagatgaccaaaaaaacatgtggaagcattctcaatatcaccaggtatcaatgaaacttaagatagtaatgagattttattttatattatcagattggcaaaaaatgttaaaatttccctatggtaagtgatgatgaggaatatgtgaggaattcaggaaatttcataaattgctgatgaggattataaattagcatagcgatttcaaagagaacattttaaatatagcagtaaaattgaagctgtccatgttct

SEQ ID NO: 66607 - DNA, 601 bp, Human
aacacattatatgcagatatttagcaaccaaaagaaagctcgatagctttagtaacaggagaaactagaccaaaaaagtattttcacagataaatatcactgtggaagttataataatcttgaccctgtaaacactcaacaatacatattgttgataaggtagccagatataagaaagctccatagctacaataacataagagaaactagatcaaaaaggcattttcacaaataaaaattattctggaagttatgataatcttgaacatgtatacactcaacaatacatatggttgataargtgaagaattacaaaaagaaattaattctacagtcaaactggagaatgttaacacatttgcacctgatgctagcaatgtattaagcaaaaaaaaaaaaaaaaaaaaaaaaaaattctgatcagtcagagtttatcccagcaatagtgaatggtttaacgttagaaaatctctcaatgtacttaaatacttttatggtataaaggaagaaaacctacacaatcattttaatagatgaagaagagcatctaatgatgatgaaaagaatatccattattgattaaaagaaaaaaaacttttaa

SEQ ID NO: 66608 - DNA, 601 bp, Human
gtcaagagacgtctttaaaatacagtgacatgtgaaggttgaactaaagggctggaaaacacattatatgcagatatttagcaaccaaaagaaagctcgatagctttagtaacaggagaaactagaccaaaaaagtattttcacagataaatatcactgtggaagttataataatcttgaccctgtaaacactcaacaatacatattgttgataaggtagccagatataagaaagctccatagctacaataacataagagaaactagatcaaaaaggcattttcacaaataaaaattattytggaagttatgataatcttgaacatgtatacactcaacaatacatatggttgataaggtgaagaattacaaaaagaaattaattctacagtcaaactggagaatgttaacacatttgcacctgatgctagcaatgtattaagcaaaaaaaaaaaaaaaaaaaaaaaaaaattctgatcagtcagagtttatcccagcaatagtgaatggtttaacgttagaaaatctctcaatgtacttaaatacttttatggtataaaggaagaaaacctacacaatcattttaatagatgaagaagag

SEQ ID NO: 66609 - DNA, 601 bp, Human
ataatggttaataaaagttcaaagtaaaatagcataaataagtccaaatgtagtacaataaatataaatcaattaagcttgcttgtaaaagacagaggtattctgattgagggggaaaaatttcccccaaagtcctgcacaaggtctatttttgttatgtcaagagacgtctttaaaatacagtgacatgtgaaggttgaactaaagggctggaaaacacattatatgcagatatttagcaaccaaaagaaagctcgatagctttagtaacaggagaaactagaccaaaaaagtattttcmcagataaatatcactgtggaagttataataatcttgaccctgtaaacactcaacaatacatattgttgataaggtagccagatataagaaagctccatagctacaataacataagagaaactagatcaaaaaggcattttcacaaataaaaattattctggaagttatgataatcttgaacatgtatacactcaacaatacatatggttgataaggtgaagaattacaaaaagaaattaattctacagtcaaactggagaatgttaacacatttgcacctgatgctagcaatgtattaag

SEQ ID NO: 66610 - DNA, 601 bp, Human
atgtgaggaatttaattaagtacttagaaaacccaagacggttaaagtattagaactattaagagtttcataaggtggccagatagaaaattcatttataaaattcaacattttttatatatcagcaacaaccaatccaaaaatataatgggaaatgatattttttaacagttgtcaatccttagttgccagaaatgtgctaagttctgaacagaagatcctggaactgggagagatgttaattaactgtggacttttaacatcacgagtactttgagaacttaaagggtgagttaattctttttttttttttttttttgagacggagtctcgctttgtctcccaggctggagtgcagtggtgcaatcttggctcactgcaagctccgcctctcgggttcaggccattctgcctcagtctcccgagtagctgggactgcaggcgcccacgatcacgcccagctaatttttttgtatttttagtagagacggggtttcactgtgttagccaggatggtctcaatctcctgacctcgtgatccacccgcctcggcctcccaaaatgctgggattacaggggggagccactgcgcccggccaat

SEQ ID NO: 66611 - DNA, 601 bp, Human
gcatctttgggtttttctcactccaattgactttaaaagaaccctcgttattagtgatctgataaaactggtaacatagataaggcatacaattgttggaaaaagagaagataaaaataatcattctatgtgaggaatttaattaagtacttagaaaacccaagacggttaaagtattagaactattaagagtttcataaggtggccagatagaaaattcatttataaaattcaacattttttatatatcagcaacaaccaatccaaaaatataatgggaaatgatattttttaacagttktcaatccttagttgccagaaatgtgctaagttctgaacagaagatcctggaactgggagagatgttaattaactgtggacttttaacatcacgagtactttgagaacttaaagggtgagttaattctttttttttttttttttttgagacggagtctcgctttgtctcccaggctggagtgcagtggtgcaatcttggctcactgcaagctccgcctctcgggttcaggccattctgcctcagtctcccgagtagctgggactgcaggcgcccacgatcacgcccagctaatttttttgt

SEQ ID NO: 66612 - DNA, 601 bp, Human
gagtttcttttgaattcatattctaagaactatttatgagaatgctgtattcggttgtttcctgtcacctgtattcacattaatagattataacggatttcaatctactgaagcatagtcaattctctgattgctgccaaccaaatcaccatggttgaatttgaatatttccagtcatttttgatggttgttgcctgcccacattacctgttatttatttaaactaccttatatacgaatacacttttatatataatttagaattttttcttagccatcattaaatcacacctaaatttgygatacatggtattgtcttagttgttcactttgccttttgtctctcttttcctaaacctaccttttcttccccaaagacactcaaggacttaatggcatctttgggtttttctcactccaattgactttaaaagaaccctcgttattagtgatctgataaaactggtaacatagataaggcatacaattgttggaaaaagagaagataaaaataatcattctatgtgaggaatttaattaagtacttagaaaacccaagacggttaaagtattagaactattaagagtttcataaggtggc

SEQ ID NO: 66613 - DNA, 601 bp, Human
atctgtaaaatgctccacaaattttgattgttgctacaatgacctcttgagcggtgttgtttttagaacccaatgataaaatatatagttactttctaagctgaaaaacaataattaaagcgttcattgcttaaagcttgattgtgtcacaacgaggaaatagagtttcttttgaattcatattctaagaactatttatgagaatgctgtattcggttgtttcctgtcacctgtattcacattaatagattataacggatttcaatctactgaagcatagtcaattctctgattgctgccmaccaaatcaccatggttgaatttgaatatttccagtcatttttgatggttgttgcctgcccacattacctgttatttatttaaactaccttatatacgaatacacttttatatataatttagaattttttcttagccatcattaaatcacacctaaatttgcgatacatggtattgtcttagttgttcactttgccttttgtctctcttttcctaaacctaccttttcttccccaaagacactcaaggacttaatggcatctttgggtttttctcactccaattgactttaaaagaaccc

SEQ ID NO: 66614 - DNA, 601 bp, Human
gcatcaagagcttgggccactgggtaaagagggatctggttcttgctctaacgcggttcatcttctgtgtcagaatcagatagattctgggtgtcagagacccgaatcttcctcttgttccgctcactgcccccctgtggccccttctcatttcaaatgctctgtctgtaatatgaaatgaaaagaattcctcccagacccctagccaaatttcaccttaagctcgttgactcccagaggaaatctctgtgggagactggaaagaggacgctggagccagaggctatctttgatagtgagrtgaggtttactgtttaataagaactccaaagatatgcctaatattgaaggttgtctctcgcttccttgggaaacccaaaccagaagtttaggccgtatagaaagtaagtggtttgggtgcaaaagggatgtagaacatcccttttaatggtatcatagaatatgagaactagaagagagctcaaagatcatttaggccaacctctacattttatagataagaacactgggcctgtggtcattccacaagtttgtggcaagccttggattacaacagatcaccaggttccctgactcctag

SEQ ID NO: 66615 - DNA, 601 bp, Human
aaataccaaccctggaaagagatgtgggggacagtcattttagagagcggacaccactgctgaagaagaaggatatcccggttggctgctctagagccggcaggacggatgctgaggttgttcgcagcagcgtgtgtgcagagcccccgggatcttgcagactgggatttgtcagggcaggtgtggacattgaggctatttctaacaagctcctacatgatgctggggctgcagagccccaggccgcacttggagtatgagagtttccagggagtgaagccccggctgctctctctgcccyctctccatctgcccccttggtgaggacaggactcccatccctccagtgcacagtgagtgctgctcaatctgcatccacagcggtttgtgcccagatgcttcctcactcagcgtctaacagggtgcagtggaaacgtcattgactggaggaaaggtgtgtgggtgagaaacgtttgtcggttgagtaactttttgtcgttattttttttctctgatgttcaaagtaagagaaaactcatctggcccctggagcccatgtgagcaacatgaaagataaagggaaaagggggctgataaagat

SEQ ID NO: 66616 - DNA, 601 bp, Human
attctggcaataaaagtactctggacactgttaaggtgagaaaagaaaagaaatcggggctcccaggaggagaatcctgaaccacgggctctgcggtgatgtggccttcctctttagtttttgtgccttttatgtgggcagagggaaaaagagacagccagcagtgatcattaatcctgaaaatgccgagggctttggcctgggacccacaccaagacagagtcaaaccgagttcttctagtgttgagcgtgtttcacatcttccgttggagtttgctgtggatgctcattagacagacaygggcagaatcccacttgttcctcgtccttttccacctcacctccatcattgtggctgaaatacacgatcatgggtgtatctttccttgtggatttgttgcctctaggagttctgtatgcagctgaagggtaacaccccttgggagcttttgccttgtctggctgacgccttggcaatcgcaagtgacagtgacggagagccacctcctctggaatgcatcatggaacaggtctgggagaacagagggtgcaggtgaagggccctcgacaatgcttctctttgcattgtggggtttcccct

SEQ ID NO: 66617 - DNA, 601 bp, Human
caaagccacattcaggcaggacggagctgctcttgcacacggtttcgtgggctggattttctctgttgcacacatgcttagtatctgtctctccctttgttcctgagtggtgggccgcacatgaggctctgagcaggctatatctctattctggcaataaaagtactctggacactgttaaggtgagaaaagaaaagaaatcggggctcccaggaggagaatcctgaaccacgggctctgcggtgatgtggccttcctctttagtttttgtgccttttatgtgggcagagggaaaaagagmcagccagcagtgatcattaatcctgaaaatgccgagggctttggcctgggacccacaccaagacagagtcaaaccgagttcttctagtgttgagcgtgtttcacatcttccgttggagtttgctgtggatgctcattagacagacatgggcagaatcccacttgttcctcgtccttttccacctcacctccatcattgtggctgaaatacacgatcatgggtgtatctttccttgtggatttgttgcctctaggagttctgtatgcagctgaagggtaacaccccttgggagcttttgcc

SEQ ID NO: 66618 - DNA, 601 bp, Human
tggcacgattctggatgtagacatcaccttcttttctgagattatttgaagtgtctggtgcctatggactgtgggaaaatttgagatgatcaattcgggagttggaggtgggggtgtagggtggtaaacactcaaggcttagaaattggggctccccaccctgcactagggtctcacacaaaggggttggcacagggctgagaagcagtggggctcctgtccaccctgcccagcacctactcccaccaggcaactgagtggtatttagtctgcaagactagcccagaaacttgaatgggascctgagagagccaggggttccttgggcccccgctaggggactttctgtttgccctgggtctccctgtgtgggcagggatggagagtgagggcctgccttcatggcagtaggctctgagtgggtgactggcgccaggccaagttctaggtgggcttcccaaagccacattcaggcaggacggagctgctcttgcacacggtttcgtgggctggattttctctgttgcacacatgcttagtatctgtctctccctttgttcctgagtggtgggccgcacatgaggctctgagcaggctatat

SEQ ID NO: 66619 - DNA, 601 bp, Human
ctggaatttaggatcttgacacctccaggtctgtagctcagtaaccactaaagagcttggctataatccttttccctgaaaggccttgtcaggaagtgccaaacatcacctgaaggcagcaggaggtagaagagtgtgtggaaaggtacgctggagggttgctctttttcaatctaataggaataaatttgggattttttttttagcccttctcagtgtagtgttataaaagcagcaacagaacaacatccaaaaaaagaataaaaaataatttgtctaaaagtcttgcacagtaataacaggaggattccacttatatgactccaaaatgttgaaatcatctttccctatattatcattcttttattttttaagacagcatacaactgtcctcattctctagttttactcactaacaatgccaaaaattacttctcaaaattcagctaacaagggcttttctctgcctttacacttcctcctgtctttccagacccacttcctgcttctcccaatgggtcttctcaacataaatcattctctcccggaatattttccaattcctagctctacgcactcccccagctcacaccaagggacc

SEQ ID NO: 66620 - DNA, 601 bp, Human
agtagcttatgatatagtcatactatagaaaccattcaaaaataaaaaataatgaactattgatacaggcaatattgataaatctcaaaaatgttatgttgaacaaaataagctaaacacgaaatagtgcatacactttgctttcatttatatgaagttcacaaaaagacaaaagttatatccagagatagaaagcagacagtggtttcttgtggtaggtgggtattgaccagaaggcagaagtgatgaaaacgtttttgcagctgtacacatttgtcaaaactcatcaaattgtatgcckcagatctatgcatttctttataagtaattttagctcaacaaaatgagcgagaagcatatttagctactcttttgtaattattcattagcacaaataaccaggattgacctcagatgtttttggaatctgagatgtcaatcacaagccaagaacatttctaaacacatcaatttgaaaagaaggaaacaaattgtcttggaagctattttgtgcccttagaaactcttgaattccatgagagtgcgtttttctagatgaggtcatgggcattttcagagtcatcataaattagcccgagtg

SEQ ID NO: 66621 - DNA, 601 bp, Human
gatattcaggctttctataaaactatggaaatcaaggcagcgtagtattagcataaggacaaacagtaatgaaacagagcagaaagtcctgaaatggactcaactcatgtttgttcaactgctttttttttaaacaaataaatgtgccaaggaaattcaatgagaaaggaaaaatcttttcgacaaatgcttctggagcaaatggataaatgtatgagaaaaaaactcacatcttatgcaagaattaattttattatatatataaagataaagatctatgtactaggtctatatcttataratgtaaccataaaaggcaaaactaaaaagatttcagaagaaaattaaggcaaatgactttgcaagttggagataggcaaagattgctcatagaggatgcaaaagcactgactataaaagaaaaaaattgagaatgtctactcatccagagacattaagaaaatgaaaaagtaggcagggtgtggtggctcacgcctgtaatcccagcactttgggaggccggggcgggcagatcacaaggtcaggagatggagaccatcctggctaacacggtgaaaccctgtctctactaaaaatacaa

SEQ ID NO: 66622 - DNA, 601 bp, Human
aaaagctccttagaaacacaaaagacctagaatatctaagacaatcgtaaagatgtatacatttggaggattcatgacatctgatattcaggctttctataaaactatggaaatcaaggcagcgtagtattagcataaggacaaacagtaatgaaacagagcagaaagtcctgaaatggactcaactcatgtttgttcaactgctttttttttaaacaaataaatgtgccaaggaaattcaatgagaaaggaaaaatcttttcgacaaatgcttctggagcaaatggataaatgtatgagaaaaaaactcacatcttatgcaagaattaattttattatatatataaagataaagatctatgtactaggtctatatcttatagatgtaaccataaaaggcaaaactaaaaagatttcagaagaaaattaaggcaaatgactttgcaagttggagataggcaaagattgctcatagaggatgcaaaagcactgactataaaagaaaaaaattgagaatgtctactcatccagagacattaagaaaatgaaaaagtaggcagggtgtggtggctcacgcctgtaatcccagcactttgggagg

SEQ ID NO: 66623 - DNA, 601 bp, Human
aacacaattttttagtacaaatttggaagttatttctaaaagctccttagaaacacaaaagacctagaatatctaagacaatcgtaaagatgtatacatttggaggattcatgacatctgatattcaggctttctataaaactatggaaatcaaggcagcgtagtattagcataaggacaaacagtaatgaaacagagcagaaagtcctgaaatggactcaactcatgtttgttcaactgctttttttttaaacaaataaatgtgccaaggaaattcaatgagaaaggaaaaatcttttcracaaatgcttctggagcaaatggataaatgtatgagaaaaaaactcacatcttatgcaagaattaattttattatatatataaagataaagatctatgtactaggtctatatcttatagatgtaaccataaaaggcaaaactaaaaagatttcagaagaaaattaaggcaaatgactttgcaagttggagataggcaaagattgctcatagaggatgcaaaagcactgactataaaagaaaaaaattgagaatgtctactcatccagagacattaagaaaatgaaaaagtaggcagggtg

SEQ ID NO: 66624 - DNA, 601 bp, Human
actgaaggtagggaggctgggtgcaatggctcatgcctgtaattccagcactttgggaggccaaggcgggtagatcacatgaggtcagcagttcaaaaccagcctggccagcatggtgaaaaccacagtctctactaaaaatacaaaaaaattagccgggcgtggtggcatgtgcctgtggtcccagttacttgggaggctgaggcaggagaatcacttgaacccaggaggcagaggttgcagtgggccgagatcacgccactgcactccagcctgggaaacccagcaagactctgtctcaaaaaaaaaaacgaagatagggagaaatcagacagcttggcccatctctaaccaacaagggactaagcaaaagcaatttaaatgggctccatgggccagaaattacagtggaacaggcaacataagtgctcaataaatgctggtaatctcatgataaggcaagagcagcagcatggtgggaaggagaaagatgggtttctaacttctagctccagcagcttacaagctacatagttttattattttacttctctaaggctcagcttcgtgctgtaataattattattttattgatttaatg

SEQ ID NO: 66625 - DNA, 601 bp, Human
aatgacttaatcacatatttcttcactttatttaaaagatggtatgccctactttttgtgagaaagcaactaaggctgctaccattgttctttagaaagctttgtatcagagctggctcaaaaattaactacaaccaagctcctctccaaagcacaatgtatttcaaactagatgagtagaaattaacaaggttttattccgaatatgcctcatgtcaagcaagtatggagagaggagggtcaaggaatgtgaagaaaggaagaagcaaagttacgtacatttaattgaggggcaaaataygtctgtgcaagatacttttaaggatatacgagttgttagactttctataattaatgactgtgcgccattttttgagaaatatacagaaagtgcttcactcaatgtctggcaaataggaaatgtgtatttctcacccacctgcccacctctgagttcaccaaataccttcttatattatgaagaccttaccctccctcagcctgaaaaatggactctggtatctcactaaaggcaccagaagcagtggtcaaacatcaaactattaaaaggaaaagtggcacaggtctaatcagaaaaata

SEQ ID NO: 66626 - DNA, 601 bp, Human; identical to SEQ ID NO: 18817

SEQ ID NO: 66627 - DNA, 601 bp, Human; identical to SEQ ID NO: 18816

SEQ ID NO: 66628 - DNA, 601 bp, Human; identical to SEQ ID NO: 18815

SEQ ID NO: 66629 - DNA, 601 bp, Human; identical to SEQ ID NO: 18814

SEQ ID NO: 66630 - DNA, 601 bp, Human; identical to SEQ ID NO: 18813

SEQ ID NO: 66631 - DNA, 601 bp, Human; identical to SEQ ID NO: 18812

SEQ ID NO: 66632 - DNA, 601 bp, Human; identical to SEQ ID NO: 18811

SEQ ID NO: 66633 - DNA, 601 bp, Human; identical to SEQ ID NO: 18810

SEQ ID NO: 66634 - DNA, 601 bp, Human; identical to SEQ ID NO: 18809

SEQ ID NO: 66635 - DNA, 601 bp, Human; identical to SEQ ID NO: 18808

SEQ ID NO: 66636 - DNA, 601 bp, Human; identical to SEQ ID NO: 18807

SEQ ID NO: 66637 - DNA, 601 bp, Human; identical to SEQ ID NO: 18806

SEQ ID NO: 66638 - DNA, 601 bp, Human; identical to SEQ ID NO: 18805

SEQ ID NO: 66639 - DNA, 601 bp, Human; identical to SEQ ID NO: 18804

SEQ ID NO: 66640 - DNA, 601 bp, Human; identical to SEQ ID NO: 18803

SEQ ID NO: 66641 - DNA, 601 bp, Human; identical to SEQ ID NO: 18802

SEQ ID NO: 66642 - DNA, 601 bp, Human; identical to SEQ ID NO: 18801

SEQ ID NO: 66643 - DNA, 601 bp, Human; identical to SEQ ID NO: 18800

SEQ ID NO: 66644 - DNA, 601 bp, Human; identical to SEQ ID NO: 18799

SEQ ID NO: 66645 - DNA, 601 bp, Human; identical to SEQ ID NO: 18798

SEQ ID NO: 66646 - DNA, 601 bp, Human; identical to SEQ ID NO: 18797

SEQ ID NO: 66647 - DNA, 601 bp, Human
gtctggcctaatataacccaagaagtgcctggtgtttcccctgggccttccagtcaaccaccaggtcctttttattctccctttaatgtaccacaaaggtctcaccactgctctgtatctcacgctactttgactccaccaggcaccctgatggtgtcttcagttccgactcactgactttcaattccacctccacatggctactagtgtcaaaactgaaaatacggtgggcacctgaaaatatttcaatactatttagagtacagtgtactctaaaccctgaaatgtatacgatcctctrcttacctttaccagctggactgcccagcccagacacctggctccagttaaactcaatacccatagttccctgaacatcccatgctctggctctgtgcctctgtgcacactcttcgctctgcctagaatatgcttcctcaccttatcaacctggcagactcctactcatcctttgtgcctagctcaaaggagatatataaagcactcctagtcagctggctgctccctcttctgtaggccttattcattttctacatagtatcttacagcacttcttaccctactggaattattgctaaaa

SEQ ID NO: 66648 - DNA, 601 bp, Human
actacaacttcagcaaagggcagaattactgaccagaaaccatagctctaaagattctggaaaatcccaaaatcatgagaaaaagtatatgctttctattctattcacacagacaaaaagactaaaggagctacaccaaaatgttaacaatgattaaatctctggatgttaagattatggatagtttttatattcttcattttaatatttattttctacaatgaacatgcattttttttaacaagggtgtgtgtgtgtgtgtgtgtgtgtgtgtgtgtgtgtgtgtgtgtgtgtgtttaarcaaaaggcctggcctaacctaaatgcctgtctctcagtgtaacaaaaggtgttgctagggagatacagctctacagaataccgcagaaaacctgcagggaacgagtgggtgttggcagctttaaagaggaaagaaaagcaggctgggtgcacaggaaaggagagctctcacaccagtctggcctaatataacccaagaagtgcctggtgtttcccctgggccttccagtcaaccaccaggtcctttttattctccctttaatgtaccacaaaggtctcaccactgctctgtatctcacgc

SEQ ID NO: 66649 - DNA, 601 bp, Human
ctttcaactacaacttcagcaaagggcagaattactgaccagaaaccatagctctaaagattctggaaaatcccaaaatcatgagaaaaagtatatgctttctattctattcacacagacaaaaagactaaaggagctacaccaaaatgttaacaatgattaaatctctggatgttaagattatggatagtttttatattcttcattttaatatttattttctacaatgaacatgcattttttttaacaagggtgtgtgtgtgtgtgtgtgtgtgtgtgtgtgtgtgtgtgtgtgtgtgtttttaagcaaaaggcctggcctaacctaaatgcctgtctctcagtgtaacaaaaggtgttgctagggagatacagctctacagaataccgcagaaaacctgcagggaacgagtgggtgttggcagctttaaagaggaaagaaaagcaggctgggtgcacaggaaaggagagctctcacaccagtctggcctaatataacccaagaagtgcctggtgtttcccctgggccttccagtcaaccaccaggtcctttttattctccctttaatgtaccacaaaggtctcaccactgctctgtatc

SEQ ID NO: 66650 - DNA, 601 bp, Human
atatgagccactgcacctggccacctgttggcaatttctgagtgaggctcacagaggtggctgtcgcccagcctgaaggtcctcagaattgcaaattaccatatttagataatggaaatctattgctgggacttcagccccagaattctggggcaaaaggcatctgtagaacttagtgagccgggacccacctagaaggaagtagagtcagaaggaagaaaatgtactttcaggctgggtacaagaagctcacacctgtaattccagcactttgggaagctgaggtgcaaggactgcttcrgcacaggagtttgagaccagcctgggcaatatagtgagaacttgtctctaccaaaaaaaaaagaaagtgctttcaactacaacttcagcaaagggcagaattactgaccagaaaccatagctctaaagattctggaaaatcccaaaatcatgagaaaaagtatatgctttctattctattcacacagacaaaaagactaaaggagctacaccaaaatgttaacaatgattaaatctctggatgttaagattatggatagtttttatattcttcattttaatatttattttctacaatgaa

SEQ ID NO: 66651 - DNA, 601 bp, Human
ctttcacaacaaaagaagttttaacttcccattacccatttaaaaacaatattatttccggaggatgtaagtgtcactattttaaaactacttgtattgtacatacaatatttttgcttttcaccattttgatttctggaaaagatttcctcctggccaggttatttaaaatggactctccaacttattatcaacagttttaccagaatccagcgagtctagtcctgtatatcaacacacgtacttaataaataagataccagcttccattaaaaataaatcagcataaaaataatttagrcaagaagaaagccaagacaacatttaacttccagttatttgccgtactaggatttgttgatggcaactcctgcttccaactttttgacattaccaccaccgtgattttgttttcaaacagaagagaaaggctccatttattactacaaagttataaaacagaaaagcaaaactccagtgtcccctggtgtacctgcacctcacctcaatccatcagcagaacaggggcctgacagccaaaaccaagctcaacagttgctaggtctctgatgattttcatagtatattcttgattagcaga

SEQ ID NO: 66652 - DNA, 601 bp, Human
aaagaggtggccgggaactgtggctcacgcctgtaatcctagcactttgggaggctgaggtggatggatcacgaggtcaggagattgagaccatcctggctaccacagtgaaactccatctctactaaaaatacaaaaaattagccaggtgtggtggcgggcgcctgtagtctctgctactaaggaggctgaggcaggagaatggtgtgaacccgggaggtggacgttgcagtgagccgagatcgcgccactgcactccagcctgggcaacagggcaagactctgtctcaaaaaaaaaaaagaaagaaagaaagaagaggccaggcgcagtggctcatgcctgtaatcccagcactttgggaggctgaggcgggtggatcacaaggtcaggagatcaagatcatcctggctaacacggtgaaaccccatctctactaaaactacaaaaacaattagccaggtgtggtggcacgcgcctgtagtcccagctctcgggaacctgaggcaagagaatcacttgaacctgggaggtggaggttgcagttagctgacattgtgccactgcactccagcctaggtgacagagcgagactcccatctc

SEQ ID NO: 66653 - DNA, 601 bp, Human
aaaaaaaaaagaaaagaaaagaggtggccgggaactgtggctcacgcctgtaatcctagcactttgggaggctgaggtggatggatcacgaggtcaggagattgagaccatcctggctaccacagtgaaactccatctctactaaaaatacaaaaaattagccaggtgtggtggcgggcgcctgtagtctctgctactaaggaggctgaggcaggagaatggtgtgaacccgggaggtggacgttgcagtgagccgagatcgcgccactgcactccagcctgggcaacagggcaagactcygtctcaaaaaaaaaaaagaaagaaagaaagaagaggccaggcgcagtggctcatgcctgtaatcccagcactttgggaggctgaggcgggtggatcacaaggtcaggagatcaagatcatcctggctaacacggtgaaaccccatctctactaaaactacaaaaacaattagccaggtgtggtggcacgcgcctgtagtcccagctctcgggaacctgaggcaagagaatcacttgaacctgggaggtggaggttgcagttagctgacattgtgccactgcactccagcctaggtgacag

SEQ ID NO: 66654 - DNA, 601 bp, Human
tataataacaaacgataaaataagggaaagaaaatagtctctggctgaacatagtggctcacacctgtaatgccaacattttgggagactgaagagggaggatcacttgaggccaggagttcgagaccagcctgaacaagacagtgagaccccatctctacaaaaaacttacaagttagccaggcatggcagtatgcacctgtagttctagttactccaggagactgaggcaggagtatcacttgagcccaggagactgaggctgcagtgagtcacgatcatatcactgcactccagcctsggtgacagagtgagactctgtttcttaaaaaaaaaaagaaaagaaaagaggtggccgggaactgtggctcacgcctgtaatcctagcactttgggaggctgaggtggatggatcacgaggtcaggagattgagaccatcctggctaccacagtgaaactccatctctactaaaaatacaaaaaattagccaggtgtggtggcgggcgcctgtagtctctgctactaaggaggctgaggcaggagaatggtgtgaacccgggaggtggacgttgcagtgagccgagatcgcgccactgcac

SEQ ID NO: 66655 - DNA, 601 bp, Human
tgacctgtagtttttgttgttgttgttgcatctttatatgcattgttttaaaggaaaatagttattatctgccaaaatagaggtctacttctgaatgaaacctgtttaaagacatgtgtttttcctgaactatgtctgttttcttcatctaacattgtctctacctaatacattcattaccataaccaggcttttctcccctataccttttaagaaaaccactacagttttatctctgatagggctacaaaaatccacatttgtggagagcactatgaagatatcgtcacaactatgcaawgaagcagaaatttcccaaagcctctgttttccaaatataattcttaatagtctgggatttacaagggttataataacaaacgataaaataagggaaagaaaatagtctctggctgaacatagtggctcacacctgtaatgccaacattttgggagactgaagagggaggatcacttgaggccaggagttcgagaccagcctgaacaagacagtgagaccccatctctacaaaaaacttacaagttagccaggcatggcagtatgcacctgtagttctagttactccaggagactgaggca

SEQ ID NO: 66656 - DNA, 601 bp, Human
gtaatttgttgagagtttttataataaggaaataatgaatttttcaaatgttttttatgcatgtattgagatgatgatatggtctttttccttcattctgttgatgtgatttatcaggtttactgatttgcatatgttgaaacatccttgcatccctgggatgaatggtacttgatcactgttaatgatctttttaatatgttgttgaatttggtttgctagtattttgttaaggatttttgtacctatgttcatcagggatattgacctgtagtttttgttgttgttgttgcatctttayatgcattgttttaaaggaaaatagttattatctgccaaaatagaggtctacttctgaatgaaacctgtttaaagacatgtgtttttcctgaactatgtctgttttcttcatctaacattgtctctacctaatacattcattaccataaccaggcttttctcccctataccttttaagaaaaccactacagttttatctctgatagggctacaaaaatccacatttgtggagagcactatgaagatatcgtcacaactatgcaatgaagcagaaatttcccaaagcctctgttttccaaat

SEQ ID NO: 66657 - DNA, 601 bp, Human
ttatcaagtctacaatagcaaaaaaataaaataagttagctgggcatggtggcatgtgcctgtagtcccagttactcgagaggctgagacaggaggatcacttgagcccaggagtttgaggctgcagtgaactatgattgtgccactgtactccagcctgggcaaaagaacaaaattctattaaaaaaaaagacagtctacagtagtgtacaataatgtcctaggccttcacattccctcactgcccactcgctggcacacccaggacaacatccagtcctgcaagctccactatggtttygtgccctatacagatgtgccatttttatctttgataccgtatttttactgtacctttcctatgtttagatacacaaatacttattattgtgctccaattgcctgtagtattcagtataatcgcatcctatacaggtttgcagcccaggaataacaggctgtaccatacagcttaggtatgtagtgggctataccatccaggtttgtgtaagtacactctagatgtttgcacaaagatgaaatcaccacaccattggttctgttggatcataagggaaaaaaaaaagatgaaattgcctaa

SEQ ID NO: 66658 - DNA, 601 bp, Human
gcagctgtgtaatatgtttgtgttttaagctaagtgttattacaaaagtcaaaaagtaaaaaacttacagtaagctacagttcattgaagaaatgatgttttatgaatttagtgtaacctaagtgtacaatgtttatcaagtctacaatagcaaaaaaataaaataagttagctgggcatggtggcatgtgcctgtagtcccagttactcgagaggctgagacaggaggatcacttgagcccaggagtttgaggctgcagtgaactatgattgtgccactgtactccagcctgggcaaaasaacaaaattctattaaaaaaaaagacagtctacagtagtgtacaataatgtcctaggccttcacattccctcactgcccactcgctggcacacccaggacaacatccagtcctgcaagctccactatggttttgtgccctatacagatgtgccatttttatctttgataccgtatttttactgtacctttcctatgtttagatacacaaatacttattattgtgctccaattgcctgtagtattcagtataatcgcatcctatacaggtttgcagcccaggaataacaggctgtaccata

SEQ ID NO: 66659 - DNA, 601 bp, Human
atgcacgactgtaatcccatactcgggaggctgaggcacgcgaatagctttaacccaggaggcggaggttgcagtgagccgagatcacatcaccacacaccagcatgggcaacagagtgagaccctgtctcataaataattaaataaaagcatagcaatgcaattatgtacagtacatatgcttgataataaaaaaatgactgttactggtttatgtatttaccatactttttattattattttacttcaagttattttaaaaagttaactgtaaaacagcctcaggcaggtctttcagcragtatccagaagaaggcactgtcataagagatgacagctccatgagtgttctttccctgagaaccttccaatgggacaggatatgaaggtggaagacagcaatacagatgatcctgacactatacaggcctaggccaacatgtgtgtttgtgtctcagtttttaacaaaaaagtttaaaaataaaaaaaataaaaaatttcaaacacagaaaaggtttacacagcataagcatagaagaaaacatttttatgcagctgtgtaatatgtttgtgttttaagctaagtgttattacaaaagt

SEQ ID NO: 66660 - DNA, 601 bp, Human
taaatgttcttactttacattttgaattgacagaaaaaattgcatttatcatgtacaacatgatgttttggagtatatatacattatgtaatagttaaatctagctaattaataatagcattacctcacatagttgtttttgtggtgagaacattattaacattcaactatctctgcatttttcaacaatacattgtccttaactatagtcaccatgctgtatgatagctctcttgaactcattcctcctaactgtaattatatattcttggaccaacatttccccatccttccctctgcmtaagcacccccacctctggtaaccaccattcttccctctaattctatgagaactttttagactccacacatgagtgagagcatgcagtatgtgtctttctgggcctggcttattcacttaacagaatgacttccagattcctccatcttgttgcaaatgacacttcattcttttttatggttgaatagtattccattgtgtatacataccatactttctttatccattcatccactgatgaacaccgaggctgattccgtatcttggccattatgcatagtgctgcaataaatatggaag

SEQ ID NO: 66661 - DNA, 601 bp, Human
catggtctccctatgttgtacaggctggtctcgaactcctgtgctcaagcaatcatctcatctcggcctcccaaagtgttgggattacaggcatgagccatcatacctggcctctttttatgtatgaagcagtaaacaagcccttggagatgagaaaatgagaaagctctaggaacaaaagacaggggagaccaacttacaaaggcaatacctaccatggtatattaccatatccaatagtaaatacgcacacatttaatatttttgttctctatttttttttatttttgttttttgttgygttgagacagggtcttgctctgtcacccaggctggagtgcggtggcatgatcacgaatcactgcagcttcaatcaacctccagggctcaagagatcctcccatcttagcctcctgagtagatagcactacaggcaagtgccaccatgcctggctaatttttttttttgtagagatggagtcttaccttgacccaggctggtcttgaactcctgggctcaagtaatcctcctgacttggcctcccaaagtgctgggattacaggcatgagccactgctcctctcccattaattattatttt

SEQ ID NO: 66662 - DNA, 601 bp, Human
tcccgggttcaagcgaatctcccgcctcagcctcccgagtagctgggattacaggtgcccaccaccatgcctggctactttttgtatttttaatagagacaaggttttaccatgttgttggccaggctggtcttgaactcctgacctcaggtgatctgactgcctcagcttcccaaagtgctgggattacacgtgagccactgcacctggcctaagtttttaatttttcatagagacatggtctccctatgttgtacaggctggtctcgaactcctgtgctcaagcaatcatctcatctcrgcctcccaaagtgttgggattacaggcatgagccatcatacctggcctctttttatgtatgaagcagtaaacaagcccttggagatgagaaaatgagaaagctctaggaacaaaagacaggggagaccaacttacaaaggcaatacctaccatggtatattaccatatccaatagtaaatacgcacacatttaatatttttgttctctatttttttttatttttgttttttgttgcgttgagacagggtcttgctctgtcacccaggctggagtgcggtggcatgatcacgaatcactgc

SEQ ID NO: 66663 - DNA, 601 bp, Human
tcaggtaatctacccgccttggcctcccaaagtgctgagataacaggtgtgagccactgtgtctggcctagctgttttttttgttttgtttttaagatagtgtggctaacaaattgcaaattcaatgcatttaaattttaccttaagaatatatgttgaaaatatttgttacaaagagataagccaagtatgattattatttctatatttactatccattatcttctaaagagatgttgttgttgcctccaatccttttttttatgtatagcgcataagctgaaatccataatctgaattraaaagggggaaaaggatcattgtttctgatactgtaaacgtaaatggtcaaatttcatgtttctaaaaaattcacttcttgaaagcaaagcaagtgttataattcagtcattcttaattatccagaagggtttaaataatctattttgataatgcttccagtaagcacttaaattaaaattagggttctttatcctttgagaacagtgccctagctaaacttttttttttctagctaatctgtacagtatcttggatttcctatttatagtatttggggcatcattttatattctaacca

SEQ ID NO: 66664 - DNA, 601 bp, Human
tcttgctctgtcacccaggatggagtgcagtggtgcgatctcggctcactgcaacctccacctcctgggttcaagcaattctcctgccttagccacccaaatagctaggattataggcatgtgccaccacgtctggctgatttttgtatttttagtaaagacagggtttaccatctctgccaggctggtcttgaactcctgacctcaggtgatccatccaccttggcctctcaaagtgctgggattacaggtgtgagccaccgtgcccggcccactttaatttttaaaagtcatatttgaytgtgctgagtaagacaaacacaaaatgaaaaatgtagttggtcttcatttcggttatcttgagtgacttccttcccatgaaggtgttttttgttttgagttggagacagagttcagctctgttgctcaggctgcggttcagtggcacaatgttggctcactgcaacctccaccttccaggctcaagcaatcctccagcctcaaactcccgagtggctgggattacaggtgcccgccaccacaccctggtaatttttttttttttttgatacagactcttgttctgtcgcccaggctggag

SEQ ID NO: 66665 - DNA, 601 bp, Human
aatacaaaaattagccgggtgtggttgtgcgcacctgtaatcccagctactcatgaggctgaggcatgagaatttcttgaacccaggagttcgaggttgcagtgagctgagatcatgccaccgcactccagcctggatgacagagcgagactgtgccttaacaaaaaaaaaaaaaaaaaaaaaaaaaggcttggttaagaatacctgctgcagaaaaagaacttgtacccgctaacataaaccatatccttacaattctggagataggttatacagattctgtaactacaaggaaacttcyatatgtccaaactctaggcaggccaaaagctcatgagacaattttttcattaaaatgctaaaataaaggctgagaacctgcataaatgacgcatctggaggtagaattcaaatgtctccttttaaaaaagaaaactcttatatctggagaactatcattctacattctcactggttaggccaaaacttataagcaagagcgtcaaccttataattatactggtagagttaataggttaaactccaataaagaagaaaagagagaagaatcaaatagatgcaataaaacatgataaagggg

SEQ ID NO: 66666 - DNA, 601 bp, Human
tatagcgggggaaacccaggggtcctacaagtattctcacaaactagacctgtgggttgagatggcaggtggtgtccacattcattttttgtggggaaatgcccagcttcaaagaaatcagattattatggagaacagaaaaacaattcaacaaagattcatgggcatctgataggcataaatcatcctttacattgctttaatcatctttcaagtacaattatcagaattttaattaaacaataactctatcaaaaatggctaagtcctcatgactgtaatcccagcacttcaggaggcygaggcaggtggattacctgaggtcaggagttcaagaccagcctggccaatatggtgaaaccctctctctactaaaaatacaaaaattagccgggtgtggttgtgcgcacctgtaatcccagctactcatgaggctgaggcatgagaatttcttgaacccaggagttcgaggttgcagtgagctgagatcatgccaccgcactccagcctggatgacagagcgagactgtgccttaacaaaaaaaaaaaaaaaaaaaaaaaaaggcttggttaagaatacctgctgcagaaaaagaacttg

SEQ ID NO: 66667 - DNA, 601 bp, Human
cagctccagtagagcagcagagacaaaataaacatatccagtaaccctgacagagcccatgtgtcagagactggcaaaatagaaattatgctttataactacataaaacaaaagaaaacaaaggaaaaaaattaacacaaaaagaagacttcattgaccagcttctatcccatcagctcaggaaattgggacatgatctttagttccagattccaaactgagctctctggaggacccagtactccaccaccacttctcccacccaccaccatgtgtagggacaagccacaggtaagtaagragggtagagtgacttgattttcctctgttcctttccttttttaaaaatgcagtcacatagctgggtggtggaaatttctgaagatattacattttctcaaatcaaaataattttctttttagaattaaggagctcccaaagcttgtcagatcccagtggctctcaatgttttactcttttttccaagtacatagaataaggtatctgaagacaatgtacttgaaactatagcgggggaaacccaggggtcctacaagtattctcacaaactagacctgtgggttgagatggcaggtggtg

SEQ ID NO: 66668 - DNA, 601 bp, Human
taatctagcccctacaccctggctttcagcttaaagaactgctcagacaggctgagatttcagctccagtagagcagcagagacaaaataaacatatccagtaaccctgacagagcccatgtgtcagagactggcaaaatagaaattatgctttataactacataaaacaaaagaaaacaaaggaaaaaaattaacacaaaaagaagacttcattgaccagcttctatcccatcagctcaggaaattgggacatgatctttagttccagattccaaactgagctctctggaggacccagtrctccaccaccacttctcccacccaccaccatgtgtagggacaagccacaggtaagtaaggagggtagagtgacttgattttcctctgttcctttccttttttaaaaatgcagtcacatagctgggtggtggaaatttctgaagatattacattttctcaaatcaaaataattttctttttagaattaaggagctcccaaagcttgtcagatcccagtggctctcaatgttttactcttttttccaagtacatagaataaggtatctgaagacaatgtacttgaaactatagcgggggaaa

SEQ ID NO: 66669 - DNA, 601 bp, Human
caccgtgaaaatggttttgacctagcaagcctcatgaaaatgtctcagagtcacccccagggttctgcacaccacactttgaaaacagctattccacactaatctagcccctacaccctggctttcagcttaaagaactgctcagacaggctgagatttcagctccagtagagcagcagagacaaaataaacatatccagtaaccctgacagagcccatgtgtcagagactggcaaaatagaaattatgctttataactacataaaacaaaagaaaacaaaggaaaaaaattaacacaaaragaagacttcattgaccagcttctatcccatcagctcaggaaattgggacatgatctttagttccagattccaaactgagctctctggaggacccagtactccaccaccacttctcccacccaccaccatgtgtagggacaagccacaggtaagtaaggagggtagagtgacttgattttcctctgttcctttccttttttaaaaatgcagtcacatagctgggtggtggaaatttctgaagatattacattttctcaaatcaaaataattttctttttagaattaaggagctcccaaag

SEQ ID NO: 66670 - DNA, 601 bp, Human
gaagaggttggaaagactttcttgttttataattagtgtcagaaagaattagaaactcttggaatcaggggccatcacaggaaaaaaagataatgatgagaattattcttacacttctgggaaacacaggagaaaatacccatgccacaaagataatcaagcttttaatgtatgtgaatttgtcacatcaggtatcttgtcgccactcttatcattctactgtgataaactacttgaacacgcaagaaaaggactatactatgtatacgtgtctccattttcctcacagatttttttttttgtcatcaattaggttcaaataatttcagcatttaaaggataataactgaccttaaaaatgaacaaaaataaattcagtaattaagatgcatactttaaaaaatgcatatttaataatttacatctattgatggaaaaaatgttttaacttcaagaaatgttaagggtaaaatacatctctggatcacaaccacaataataatcatatctacaaaagccaaggtttaatcgagagggatacattaataatatcatcttaccaagaattatgtataccgaatttaaaataaatttatatcta

SEQ ID NO: 66671 - DNA, 601 bp, Human
aaagactgaggcaagaggatcacttgaggccagggcctcaacacaaacctgggtaacatactgagaattctgtctctattaaataataaataataataatagacaatactttcttccaataccagccaggttaaaactaagtagaaatatgtggacctcaataaaagtcataaaacaaagaagaggttggaaagactttcttgttttataattagtgtcagaaagaattagaaactcttggaatcaggggccatcacaggaaaaaaagataatgatgagaattattcttacacttctgggmaacacaggagaaaatacccatgccacaaagataatcaagcttttaatgtatgtgaatttgtcacatcaggtatcttgtcgccactcttatcattctactgtgataaactacttgaacacgcaagaaaaggactatactatgtatacgtgtctccattttcctcacagatttttttttttgtcatcaattaggttcaaataatttcagcatttaaaggataataactgaccttaaaaatgaacaaaaataaattcagtaattaagatgcatactttaaaaaatgcatatttaataatttac

SEQ ID NO: 66672 - DNA, 601 bp, Human
ttcatgcacagagattaagtggcttgaccatgatccaacacgtaagtattctaggacaagatccactggcacctctttctacaaggacaattaaatcgttcacttaacaaaatccaaacaaagtctactgaatataacagaatactttctttcagccgggtgctgtggctcacatctgtaatcccagcactttgaaagactgaggcaagaggatcacttgaggccagggcctcaacacaaacctgggtaacatactgagaattctgtctctattaaataataaataataataatagacaayactttcttccaataccagccaggttaaaactaagtagaaatatgtggacctcaataaaagtcataaaacaaagaagaggttggaaagactttcttgttttataattagtgtcagaaagaattagaaactcttggaatcaggggccatcacaggaaaaaaagataatgatgagaattattcttacacttctgggaaacacaggagaaaatacccatgccacaaagataatcaagcttttaatgtatgtgaatttgtcacatcaggtatcttgtcgccactcttatcattctactgtgataa

SEQ ID NO: 66673 - DNA, 601 bp, Human
aattattctaccattttggaaaaagtatctttacattaggaaacttggttaacttacctataagagggtcttcgtgaaaggatttctctacgtttatgagaatcaattacaccttctgattctgcagattcatctgtctctgcaattgctgctacctataatacaagattttctgaaatgtatcataaaatatatgctcttttccctcattcaaaaaattgaggctaagagtctgtgtgtgcagcactgagccaggagctgtggaagcaactgagcaatagaacacagtgaatctgcactraaggagtctggctcaagaaaggaagcgcagacgcaaacatttcagttataaaacaaatgtgtgtggaaaggaatgttacgggtactctatactacagaaatactagggaaagagtggttgggatgtcaaatgaggcattgcaggaaagaacaaaatgtaaaatacccaagacctaagctcctcaacctgaaagtgctcctacgaatccaggagggagccagcgaggggccaacgcagaagagagctcccggatcacactgctgttcccacactctcacagctggcgctggcgtgagctgg

SEQ ID NO: 66674 - DNA, 601 bp, Human
ggaaaaacaaagaatatatctaaaatcttaataccttatttggataaacacattatttaatatcacatatattccagtacctaagtagctctttttaaagtcagaaaactaaaattatgaatctcttcaacaacatgactgctgtcaatatatttgttcaattactttgaggacctagggtagcagagtttacaaaactcactttacttcatattataattacatgggaaattgatttagacaacttccatggacaatttatacttcagaaaggacaggaatatcacattattccagtacctaaggggctagcttaggatatgtgatatccctaacctttctcctcctttttcttttctttctagctcttgctttttacgtatcaaacactcttcttttgggaaaaaaactagtgctttaatcagagcaaaaagcacagaattaacggtccattaaaatgcacaagactgaatgtgaatgtatctgtttatttagagctttcagtgtgtaaaatttcaaataaaattatctatccaattgctacagtttaaaaaattaaatcatttttccattctcttttaggaaaaactgtagcacaaat

SEQ ID NO: 66675 - DNA, 601 bp, Human
ttagattgacccacttacctttcatgtataagaattccagaaagatgagttaatactctaataagattcctcgtaaaatacaataggcacaagcagagacaagggccatttgtgggaaaaaaactgaagtcttgggtgatagtctttaattggtacaggaagaggttgggtatagtaggatggaggatttaagtaacctttgtttcaagaggaaatttaatgaattaggaagcttcaaacattttaatttcctcggttgcttttacaaattcactcatttactgcctatcttaactgtctyatgcagcaagtaacattctttgttaattctaaggctgtctctctcccgccatctctcgggtatatgcttctgaaataaaagactttcttcgaccagctcaactgttatgcaacacacctatcactaagatctgtacttccagtgaggattctgcaggtacagctcacttacttggtgttgtaataatggatccctgtctattttatgctttttcctactccccagggagcagcctattccaactttcactttttagtttttgtgataatagtaagtcaatataataaggccaacttctgc

SEQ ID NO: 66676 - DNA, 601 bp, Human
tctgtattcagagatttgaggagaaaactgtttaggtttcaaaatagtcaaggatagcataacatgtgctttcaataaacataaatcaagatagaaaaaataagatgaaattaactgaatgaatttagacatatcttctattttagctatttatttaagagatggggtcttgctgtgttgccccacatcctgatattggtctagctggtcttaaactgctaggctcaagcaatccttctgcctcagccttctgagtagctgggactacaggcacaaaccaccaagcctggcgatgttatayacttcttatttatttatttgttcatttattttgagatggactttcactcttctcgcccaggctgaagtgcaatcgtgtgatctcagctcactgcaacctccacctgctgggttcaagcgattctcctgcctcagcctccaaagtagctgggattacaagtgtgcaccaccacacccggctaattttgtattttcagtagagatggggtttcaccatgttggccaggctggtctcgaatgcctgacctcaggtgatccgcccacctcagcctcccaaagtgctgggattacaggcgtgaac

SEQ ID NO: 66677 - DNA, 601 bp, Human
ggtaagaacccctaaataggtagataacaaagacctttacttccttttttctctttctttttgctttactcgtttccttttttcttttcagtaatgtttccccacagttctgatcaaaaaactttgttttcacaatatgaacagctgacacatcaagaatctgtttctcattttattttctggggaagtcattatataattagatatggaaaacaaaagctaaacaaacacacacacacacccctcacacactggctctagtgagaaaacatttctactgattaagtcaggcacgtcagcytcattttcatttttatgccaaaggtgctcttgattttgttgttatcaaatgacagaggaccttcccattgaaaatgttctctctcatctgacaataaacaaaatttcccagtgcctcaggatcctggaaataggttttacgtgggcctgtctgtattcagagatttgaggagaaaactgtttaggtttcaaaatagtcaaggatagcataacatgtgctttcaataaacataaatcaagatagaaaaaataagatgaaattaactgaatgaatttagacatatcttctattttagctatt

SEQ ID NO: 66678 - DNA, 601 bp, Human
ctaaaaatacaagaaattagccaggcgtggtggtgcatgcctgcaatcccagctcctcgggaggctgagggaggagaatcgcttgaatctgggaggcgggggttgcggtgagcagagattgcaccattgcacaccagcctggacaagagcaaaactccgtctcaaaaaaaaaaaaaaaagaagtacaaagcctagaacagagcagccactcaaaaaatagaatgaatgaatgaatgaatgaatgaatgaatggctatcatttcctcatgacagatgatattataaaaaacttaagcccccygtgaatctaggagagttaaatgaggtatggtttcaaattccaatcatagaacctagtttttcaacaccaaattatcaagcttttaaataacgatcaagtcaatctgaggtgagagtagctgcctcagggtaagaacccctaaataggtagataacaaagacctttacttccttttttctctttctttttgctttactcgtttccttttttcttttcagtaatgtttccccacagttctgatcaaaaaactttgttttcacaatatgaacagctgacacatcaagaatctgtttctcattt

SEQ ID NO: 66679 - DNA, 601 bp, Human
aaaccccgtccctactaaaaatacaagaaattagccaggcgtggtggtgcatgcctgcaatcccagctcctcgggaggctgagggaggagaatcgcttgaatctgggaggcgggggttgcggtgagcagagattgcaccattgcacaccagcctggacaagagcaaaactccgtctcaaaaaaaaaaaaaaaagaagtacaaagcctagaacagagcagccactcaaaaaatagaatgaatgaatgaatgaatgaatgaatgaatggctatcatttcctcatgacagatgatattataaamaacttaagccccctgtgaatctaggagagttaaatgaggtatggtttcaaattccaatcatagaacctagtttttcaacaccaaattatcaagcttttaaataacgatcaagtcaatctgaggtgagagtagctgcctcagggtaagaacccctaaataggtagataacaaagacctttacttccttttttctctttctttttgctttactcgtttccttttttcttttcagtaatgtttccccacagttctgatcaaaaaactttgttttcacaatatgaacagctgacacatcaagaa

SEQ ID NO: 66680 - DNA, 601 bp, Human
ggtcaggagttcaagaccagcctgaccaacaaggagaaaccccgtccctactaaaaatacaagaaattagccaggcgtggtggtgcatgcctgcaatcccagctcctcgggaggctgagggaggagaatcgcttgaatctgggaggcgggggttgcggtgagcagagattgcaccattgcacaccagcctggacaagagcaaaactccgtctcaaaaaaaaaaaaaaaagaagtacaaagcctagaacagagcagccactcaaaaaatagaatgaatgaatgaatgaatgaatgaatgaaaggctatcatttcctcatgacagatgatattataaaaaacttaagccccctgtgaatctaggagagttaaatgaggtatggtttcaaattccaatcatagaacctagtttttcaacaccaaattatcaagcttttaaataacgatcaagtcaatctgaggtgagagtagctgcctcagggtaagaacccctaaataggtagataacaaagacctttacttccttttttctctttctttttgctttactcgtttccttttttcttttcagtaatgtttccccacagttctgatcaaaaaact

SEQ ID NO: 66681 - DNA, 601 bp, Human
cctaggccgggcgcggtggctcacatctgtaatcccagcactttgggaggccgaggttggtggatcacctgaggtcaggagttcaagaccagcctgaccaacaaggagaaaccccgtccctactaaaaatacaagaaattagccaggcgtggtggtgcatgcctgcaatcccagctcctcgggaggctgagggaggagaatcgcttgaatctgggaggcgggggttgcggtgagcagagattgcaccattgcacaccagcctggacaagagcaaaactccgtctcaaaaaaaaaaaaaaaagaagtacaaagcctagaacagagcagccactcaaaaaatagaatgaatgaatgaatgaatgaatgaatgaatggctatcatttcctcatgacagatgatattataaaaaacttaagccccctgtgaatctaggagagttaaatgaggtatggtttcaaattccaatcatagaacctagtttttcaacaccaaattatcaagcttttaaataacgatcaagtcaatctgaggtgagagtagctgcctcagggtaagaacccctaaataggtagataacaaagacctttacttccttttttc

SEQ ID NO: 66682 - DNA, 601 bp, Human
gtagcgtaacagtagtgtttaaaatacactctgaatattttcaagtcatttccaaacgtttttaaaggcatctaggcaaaaaagcacttaggcgataacctgataggacaaacctatgagaattatggaaagagtaacaacaacaaattttcacttctttcacctaaggtgccagtgtctacacaggaagatagattaacatttttaaaaagacttccacatgctgcgttctctgtgttttatttcactgacaggccagtgtggcagaaactgaagagtcagttacagaatgtcaatagarctgaggttgagacaccctgatgtaacagcactttatctggctcacctagagcagttattttctgtacacactttaaaaacagggtatttttaaaccatggctttccaaagatttcatgggtctcaggattcagccctcatagtaaaagggtttgagagagatctaactaacttcttacaagtatgaaaatgtcaaaagacactgctttcttggccccttgtggctagacatgagtaaattgtgtatgttttcatatatttgaatgtgtatttttcagctgataattagtttgatgtcaca

SEQ ID NO: 66683 - DNA, 601 bp, Human
aaggccaggtgtggtggctcatgcctgtgatcccagcactttgggaggccaaggcaggaggatcacttgagcccaggagttcaaggccagcctgggcaacacaggaaaaccctgtctctaaaaaaagaaaagaaaagaaaagaaaaattcccatttaatattgcaattaaaatgaatttctaccttcattcagctaactacttttctgatttgtcatcaaaagaaagtagtttttaagaaatatataggcaaggtgcagtggctcacgcctgtaaacttaggactttgggaggccaaggtrggcagatcacctgaggtcaggagtttgagaccagcctgatcaatatggtgaaaccccgcctctactaaaaatacaaaaattagccaggtgtggtggcaggtgtctgtagtcccagttactcgggaggctgagacaggagaatcacttgaacccgggagttggaggttgcagtgagctgagattgcggcactgcactccagcctgggcaacagagactccatctaaaaaaaaaaaccaacatacatataattatatatgttatatataattatatattttatatatataaatatataatat

SEQ ID NO: 66684 - DNA, 601 bp, Human
accagcctgcccaacatggtgaaaccccgtctctactaaaaatacaaaaattagccaggcgtggtggctcatgcctgtaatcccagctccccgggaagctgaggcagaagaatcacttgaacccaggagacaggttgcagtgagccgagatcacgccattgtactccagcctgggcgccagagcgagactccatctcaaaaaaaaaaaaaaaaaattcattcatgtttctatctctctttttctatcatgctactctgaatttggcctttctccagagccagtaaaacctgctaaaaggcraaaaatgataaaacttaatttgctgtttaatgtattaaaatatttcttctgtaagcctttttaagtgcctcccaaccccccaccatctaccttcgatctatttcaaaaaactataaaatcaccactcaatggtgtgatatagtaatccataggtattctaaatgtattagattaataaaatataccttgaacaacaacctggctgcctgggacaaagaactgctgtgtgccatcagctgattgtgctgcgtactgtacaattgtagcacctggtggaggagctcctgaatttgtcattgt

SEQ ID NO: 66685 - DNA, 601 bp, Human
ggctcacgtctgtaatcccagcactttaggaggctgaggcctccacctgaggtcaggacgactccatctgaggtcaggagtttgagaccagcctgcccaacatggtgaaaccccgtctctactaaaaatacaaaaattagccaggcgtggtggctcatgcctgtaatcccagctccccgggaagctgaggcagaagaatcacttgaacccaggagacaggttgcagtgagccgagatcacgccattgtactccagcctgggcgccagagcgagactccatctcaaaaaaaaaaaaaaaaaattcattcatgtttctatctctctttttctatcatgctactctgaatttggcctttctccagagccagtaaaacctgctaaaaggcgaaaaatgataaaacttaatttgctgtttaatgtattaaaatatttcttctgtaagcctttttaagtgcctcccaaccccccaccatctaccttcgatctatttcaaaaaactataaaatcaccactcaatggtgtgatatagtaatccataggtattctaaatgtattagattaataaaatataccttgaacaacaacctggctgcctgggaca

SEQ ID NO: 66686 - DNA, 601 bp, Human
ttaaaaattcattcatgtggccgggtgcggtggctcacgtctgtaatcccagcactttaggaggctgaggcctccacctgaggtcaggacgactccatctgaggtcaggagtttgagaccagcctgcccaacatggtgaaaccccgtctctactaaaaatacaaaaattagccaggcgtggtggctcatgcctgtaatcccagctccccgggaagctgaggcagaagaatcacttgaacccaggagacaggttgcagtgagccgagatcacgccattgtactccagcctgggcgccagagygagactccatctcaaaaaaaaaaaaaaaaaattcattcatgtttctatctctctttttctatcatgctactctgaatttggcctttctccagagccagtaaaacctgctaaaaggcgaaaaatgataaaacttaatttgctgtttaatgtattaaaatatttcttctgtaagcctttttaagtgcctcccaaccccccaccatctaccttcgatctatttcaaaaaactataaaatcaccactcaatggtgtgatatagtaatccataggtattctaaatgtattagattaataaaatat

SEQ ID NO: 66687 - DNA, 601 bp, Human
tttcattactgacagcttccataagagctagaatggatacttcagaattcaaacaactaagaacagtcagtcaaaaaaacaaacaaacaaaaaaaaacaaaaaacccaaagtcagcatttgttttgaaatgagttgcctagaaattagacttgaaagtaacagctagggaaaaaaacaaatttggggcatcatagcctgaatacttaaattgtcatagattaggtaatagaaatctattaggtacaacatttgcaacccccaaatgaaggatatctaattaatttaaaaattcattcatgyggccgggtgcggtggctcacgtctgtaatcccagcactttaggaggctgaggcctccacctgaggtcaggacgactccatctgaggtcaggagtttgagaccagcctgcccaacatggtgaaaccccgtctctactaaaaatacaaaaattagccaggcgtggtggctcatgcctgtaatcccagctccccgggaagctgaggcagaagaatcacttgaacccaggagacaggttgcagtgagccgagatcacgccattgtactccagcctgggcgccagagcgagactccatctcaaaa

SEQ ID NO: 66688 - DNA, 601 bp, Human
aagcaaatttttaaaaaatagtgctatatcctaaatcctaagcgaatggaccaagaggaatagaattcaattaaaacacaggagttttgaaagctgtattaaatacatctattacagttatcataggcacaactgaattaaaataatgtataacgcaaatccagttgaaatctcaggtaaccctaaaagcttagggctacatctcaacttttatttcattactgacagcttccataagagctagaatggatacttcagaattcaaacaactaagaacagtcagtcaaaaaaacaaacaaamaaaaaaaaacaaaaaacccaaagtcagcatttgttttgaaatgagttgcctagaaattagacttgaaagtaacagctagggaaaaaaacaaatttggggcatcatagcctgaatacttaaattgtcatagattaggtaatagaaatctattaggtacaacatttgcaacccccaaatgaaggatatctaattaatttaaaaattcattcatgtggccgggtgcggtggctcacgtctgtaatcccagcactttaggaggctgaggcctccacctgaggtcaggacgactccatctgaggt

SEQ ID NO: 66689 - DNA, 601 bp, Human
tacctgagtataattatcaagagactcatcaattataatatgcttatcatacctgcaagacattcgaactaaaataactgattttactttccttaacgttagtgctgcctgtaatcccagcactttgggaggccaaggtgggtggactgcctgagctcaggagttcacgaccagcctgggcaatacggtgaaaccccgtctctactaaaatacaataaattagccgggcatggcgttatgcacctgtagtcccagctactcgggaggctgaggcagaagaattgcttgaacctgggaggcrgaggtcgcagtgagccgagatcgcgccactgcactccagcctgggcaacagagcgagactctgtctcaaaaataaataaataaataaataaataaacaaacaaacaaacaagcaagcaaatttttaaaaaatagtgctatatcctaaatcctaagcgaatggaccaagaggaatagaattcaattaaaacacaggagttttgaaagctgtattaaatacatctattacagttatcataggcacaactgaattaaaataatgtataacgcaaatccagttgaaatctcaggtaaccctaaa

SEQ ID NO: 66690 - DNA, 601 bp, Human
tcctggcgaacatggtgaaaccctgtatctactaaaaatacaaaaaaattagtcggacatggtggcaggcgcctgtagtcccagctacttgggaggctgaggcagaagaatggcgtgaacccgggaggtggagcttgcagtgagccatcgtgccactgcactccaggcagggcaacagagcgagactccatctcaagaaaaaaaaaattaatgcagtctcatcattggttttattattattattattactactactatttagaaactcaaacttattccaaatgcatatgaaagaataatmgtgcacaaaaaactaactctgtatcaaactgagaaaaaagacaaggggaacttgttttatgagataacaaacatgtatggcgctgggattcagaaaaagatgaatcagacagaagactggccagatccaggtgcaaaagcaaacccactgtctaattaaggctgccccatacaccagtgaggaaacaacaaacccttgggagtggctccatatacggagaaaaaagttaaaaatgaattcccaccaaatactatatacagaagtgaagcccagatacattaaagacataaatgtgaaagg

SEQ ID NO: 66691 - DNA, 601 bp, Human
gtataaacattcacataggatcacagaccgaatcacaaagaatcagtaaattattagaagtaattagagttcagcaaagttaatagataaaagatcgacttaaaataatccgtatttctctacaccagcaacaattagaaaatacaatacaaaataaggtaccattgtaatggcaacaaaacccataaagtacttaggaaccaactaaagaaagaatatgcaagatctccgtgaagaaaaatgttcaactgttccctaaaacttaaagtataataaataaataaataaataaataaataataagaaaaatgttcaactgttaaaagaagtaaaatgagatctgaataaacaagactttctatggtttgggataggtcaacttaacattatgaagacttcagctctccctaaattaaatgcagtcttggctgggcatggtggctcatgcctgtaatcccagcacttcgggaggctgaggtgggcggatcatgaggtcaggagatcgagaccatcctggcgaacatggtgaaaccctgtatctactaaaaatacaaaaaaattagtcggacatggtggcaggcgcctgtagtcccagctactt

SEQ ID NO: 66692 - DNA, 601 bp, Human
agttgattactgctcttagtagttttaatgtattccctggaccagttaatctcaagtcaatcagcacacagaacaaatcacattttcagaggaagaacagttcactttcatttggtaaatgcttactgaacatttatcacatgccagggtctgtgctaggtatttgtccaaatagaacttaccatctagcaagacagagagccacaacacaacatgatatgtgcctaaggaagtacagtaggaactcacagaaggttgcctaagccagatgtggaggatgggcaaggcttcctcggggaamgtattcttatcaggcaatcggtatgtgtgaagaaggccctggagggagagagggcatggcctatcccaggaaatgaaagaaagagctgtattacaaaagagggagaagtggagaggtaggcagctattaaagaatgcaaggcttggatcaagcaaagatttgggccacatgaaagatttggagctttgtctaacaggtcacagacattgatggatgcttttgagtggatgctatagactgaatgtttgtatccccacccaatttcctctgttgaaatcctcacctccaatgcaatagtat

SEQ ID NO: 66693 - DNA, 601 bp, Human
tcacaggcgagctcactgaaacccaagccctataaaaactcttcctgtaataaaccatcttaatgctcttgtttctcatttttacatagaaatctgtttgaggtgggctctagcaaataataataataataataataataatgtctcttttagcattaaaagttacatgattgtatcttacagggctacttctttattattgttgtgtccaaggcttctaggtaaactaagggagaataaacccaacataatttcctaactcataagagaaaaaacacttggagatttaaaaaaaaaaaaacacattgactatcagcaaagaaataccatatttcatagtcacttctaaactcaccaagaaatatccagccacctgtgttcacttaacatttttatttgctgagccatttgctacaccatcaaaaaatccaactcttcctaaggtgatacagaatttgctactttcacttaaagggagtagataattaaattttaaaaattcactgtgccaatggagcaagtattatgtagtattctcccataactactagattgaatcacatgaacttgctgatatttgaactttctggcctacaaaaat

SEQ ID NO: 66694 - DNA, 601 bp, Human
gtgaaaaattaccgattacaaatttaaataccagaggctgggagaacaagtaaaagacaagcacttccctgactgaacactagaggagctctgaatcgcaagttcctatagatggagtaagaggatggagtaagagtaaagaacccgccagcttatacaatacataatccatttctcaccaggcgcatgcagggacggcctcagtaggaggctcgatcttaccactaagctggccagacaactcctgagttctgttcatgcattacagtttcatgacgtgtttccctcttcaagcagacamccacttcaaaagaaatgttaaagtagggctaacaagaaaagctattcagtctaaaaggcagcttggaggcagaggcagtggtgagctagttaactctaaatctgtcagcagcattttacaaagcggaaaggaactgactaaatcacaacatgactcggagctgacgtcaatgtgcagctcgcttggagttttaacttttccacttcccctgctgaaatacgattccaggaaatgtaatgacatcagccttttgaactcaattagctgaacagaccattttaaatacaggaggaaagaaac

SEQ ID NO: 66695 - DNA, 601 bp, Human
tgggacgccgaggcaggcggatcacgaggtcaggagatcgagaccattctggctaacacggtgaaaccccgtctctactaaaatacaaaaaaacaaaattagccgggcgtggtggtgggcacctgtagtcccagctactcgggaggctgaggcaggagaatggcgtgaacccgggaggccgagcttgcagtgagccaagatccagccactgcactccagcctgggcgacagagcgagactccgtctcataaaataaataaataaataaataaataaataaataaataaataaataaataaagtaaaatgaaataaaatttattactcatttttcaaatagcactgattctgtaagaaatgaccagatttttaaaaatatgatttccaaaggcaaaatcaggtcttgtgaaaaagtgttttaagttgtttgacattttaaagtttcagcattttgaaaagtttaaattggaaaaggaaaatcaatcatgtgtagcattattggtaaaactgtgaaaaaaactttcaaggatgttatgttcattctgtaaaaacaaatgtcaaaaatgtttgtttatttatatgtagtggttaaaagtataca

SEQ ID NO: 66696 - DNA, 601 bp, Human
cagaggtctggttcctaaagctactctactacaccttcaaaaaagtcccttaaccctgtgctcttctggctttaaaaaaataaagtaaaatgaggccgagcgcggtggctcacgcctgtaatcccagcactttgggacgccgaggcaggcggatcacgaggtcaggagatcgagaccattctggctaacacggtgaaaccccgtctctactaaaatacaaaaaaacaaaattagccgggcgtggtggtgggcacctgtagtcccagctactcgggaggctgaggcaggagaatggcgtgarcccgggaggccgagcttgcagtgagccaagatccagccactgcactccagcctgggcgacagagcgagactccgtctcataaaataaataaataaataaataaataaataaataaataaataaataaataaagtaaaatgaaataaaatttattactcatttttcaaatagcactgattctgtaagaaatgaccagatttttaaaaatatgatttccaaaggcaaaatcaggtcttgtgaaaaagtgttttaagttgtttgacattttaaagtttcagcattttgaaaagtttaaattgg

SEQ ID NO: 66697 - DNA, 601 bp, Human
gccagaatgcaacgtcagaatgcaacgtcagactcagagtctaaaagataggaaattatgctcctaacagaatcagtttatgaataaaacaaaggcaatttctaataaaaatgtaaattatgccccacaaaatcaataatataatcccataaactatagtcatttactttttttttttttttgagatggagtctcgttctgtcacccaggctggagtgcagtggtgcaatgttggctcattgcaatctctgcctcccggtttcaagccattctcttgcctcagcttcccgagtagctgagattacaggcgcgtgccaccacgcctggctaatttttgtatttttagtagagacggggtttcaccatgttggccaggctggtcttgaactcctgaggttgtgatccgcccgccttggcctcccaaagtgctgggattacagacgtgagccaccgcgcccggccagtcatttgcttttaatatttcacttcatgatcctgtaggtaaatgctgctaatatcttttccaggccagccattagtgctaggagcctgattttggtctagatcaaagtttttcaaactgtaagctgtagaccattaa

SEQ ID NO: 66698 - DNA, 601 bp, Human
gtgagaatgcctgtaaactgccttttttagcatttgaacatggtttcctagtgaggcctacctgatcccttaacctgtatgtcctgtttctgtgtcagtcacaatctgatagtttctttgacagcactttctatagttggtattcatgtttatttgtaacattaagtgatttttttattttaaagtttacataaatgcaaagtatattttattagaatataaatgaataaatatatttgcctaatatattcatataaacagggcaaagtgaaataaatatcccaaattacatttcgttatrcatttttcaaaagtagtaggaaaataacatgagtaatttccaatttcaccctgcagatttggtttactgaatcttaaggtagataaatgccttgttattttcacttccaaagtgattataacttgttcagttaccaacttcaagaagctgtcacacctaaatgaaattattcttttttgttgttgttgagacggagtctcgctctgtcacccaggctggagtgcaatggcactatctcagctcactgcaacctccacctcccaggttcaagtgattcttccgcctcagcctcccgagtag

SEQ ID NO: 66699 - DNA, 601 bp, Human
tcattttatatgttttataagcagtgtgtagcagcatgtactcacgtgacactgcattcatgtgtcaatgtcaggtgacttttgaggagtcacattaatatgctatgagcagaacccgaggattctgaagactcgaacgggtccactacttgctagctttgtaaacttggaagtcatttacccagtctgacctgggtgtagttgggcatgtatcagtgagaatgcctgtaaactgccttttttagcatttgaacatggtttcctagtgaggcctacctgatcccttaacctgtatgtcctrtttctgtgtcagtcacaatctgatagtttctttgacagcactttctatagttggtattcatgtttatttgtaacattaagtgatttttttattttaaagtttacataaatgcaaagtatattttattagaatataaatgaataaatatatttgcctaatatattcatataaacagggcaaagtgaaataaatatcccaaattacatttcgttatgcatttttcaaaagtagtaggaaaataacatgagtaatttccaatttcaccctgcagatttggtttactgaatcttaaggtagata

SEQ ID NO: 66700 - DNA, 601 bp, Human
ggctgggtgtggtggctcatgcctgtaatcccagcactttgggaggctgaggcgggtggatcgcttgaggtcaggagttcgagaccagcctgaccaaatggtgaaaccctgtctctactaaaaatgcaaaattagccgggtgtgttggtgggtgcttgtaatctcagctacttgggaggctgaggcaggtgaatcgcttgaacctgggaggcagaggttgcagtgagccaagatcacgccactgtactccagcctgggcaacaagagtgaaactctgtcttaaaaaaaaaaaaaaaaaaaagccattttaacgacttaaaataatattaacctaacctcattttatatgttttataagcagtgtgtagcagcatgtactcacgtgacactgcattcatgtgtcaatgtcaggtgacttttgaggagtcacattaatatgctatgagcagaacccgaggattctgaagactcgaacgggtccactacttgctagctttgtaaacttggaagtcatttacccagtctgacctgggtgtagttgggcatgtatcagtgagaatgcctgtaaactgccttttttagcatttgaacatggtttcct

SEQ ID NO: 66701 - DNA, 601 bp, Human
tacacagacaactcaatgagtcgtacaaaactgtatagctttgagatagttaacaaggtcacgttaagccagttataaactaacttaatagattgtttaacatatcttcatcgtattgtcagaagagatggagtggagcagagaataacatagctctcctcttttttctcttcacccacatccagggaagaaggttatggggtaataaaggctgaaacaatagaacagctggtggtcacctaggtcttctaaaattggaacaatagccagtgacgaatgagaagtttacatgacaccaggytgacacatgcaggcagcatggatatggaccttggtctaggatcattctttccaaacactgctcacacagacgtgtagtaaaattaatgggtagagaggggctcattacactctagttctgtagacgtttgctgttttcttgtaatatgaagttagagcaggatggttccatgatatatacaaaagctagtttaaaaaaaaacaaaaaacaaaaaaaaaaactttttactttttatttttattttgagacagagtctcacgctgccacccaggatagagtgcagtggcacaatctcggctc

SEQ ID NO: 66702 - DNA, 601 bp, Human
ggaataattgatttttttttttttttttttttgagacgtagttttgctgacaccaggctggagcgcactggtgcaatcttggcttactgcaaccttctactccctggttcaagtgattctcttgcctcagcctcccgagtagctgggattacaggcacgcgccatcatgcccagctaatttttgtatttttagtagaaacagggtttcaccatgttgcccaggatggtcttgatctcccgacctcgtgatctgcctgccttggcctcccaaagtgctgagattacaggcgtgagccactgygcctggcctaattgtgattaatgatcaccagcatatgaataaacttgggaaaagtcctaaatttgtttttgtgactatacaaaataatgtatacacagacaactcaatgagtcgtacaaaactgtatagctttgagatagttaacaaggtcacgttaagccagttataaactaacttaatagattgtttaacatatcttcatcgtattgtcagaagagatggagtggagcagagaataacatagctctcctcttttttctcttcacccacatccagggaagaaggttatggggtaataaa

SEQ ID NO: 66703 - DNA, 601 bp, Human
ctttgtcagctaaataggatattatcactgaaactttgtttaaaaaagttaaacaaagattaactgatttatgtgcttctatttgggtatatgccagatttctgccttctaaggcttgagaattaggtgaaagaatacaacagttaaaaacatggctttcaaggaagctcacttaaagattttcatagaattaataaaaatattgtttataaggttgtactgccttttccttctacatgtaattttaaaacattggtgatagggaataattgatttttttttttttttttttttgagacgkagttttgctgacaccaggctggagcgcactggtgcaatcttggcttactgcaaccttctactccctggttcaagtgattctcttgcctcagcctcccgagtagctgggattacaggcacgcgccatcatgcccagctaatttttgtatttttagtagaaacagggtttcaccatgttgcccaggatggtcttgatctcccgacctcgtgatctgcctgccttggcctcccaaagtgctgagattacaggcgtgagccactgtgcctggcctaattgtgattaatgatcaccagcatatga

SEQ ID NO: 66704 - DNA, 601 bp, Human
aattttttttttttaagacggagtctcactgtcacccaggctgcagtccagtggcgcgacctcagctcactgcaagctccgccttccaggttcaagtgattctcttgcctcagcctcccgagtagctgggattacaggtgcacaccaccacacccagctaatttttgtatttttagtagagacagggtttcgtcatattggccaggatggtctcaatctcttgaccttgtgatctgcccgccttgacctcccaaagtgctgggattacaggcgggagccactgcgcccagctgaaaactgkaatttttatttttatttttatttattgatattatttttatcattattttattatcatttattaatatttaatattgttttattatttttttgagatggagtctcgctctgtcgcccaggctggagtgcagtggcacgatcttggctcactgcaacctccgcctcccaggttcatgccattgtcctgcctcagcctcccaagtggctgggactacaggcacctgccaccacgcccggcgaatttttttgtattttttagtagagatggggtttcaccgtgttagccaggatggtcttgatc

SEQ ID NO: 66705 - DNA, 601 bp, Human
ctcagacttctcagctggttaacaaaagaaatttaaaatgtaaaattgaaaagaatgttatagtgactaatttaatctaaatgatgcaattggaaaagttaagaataaatccaaacacacacatttgccaatttggggacataatttaactcttttccacaaaggcactgaaattcatttatgaataccaacgttttcatgattaaattatattaaattctagacctagaaggaagatagtcattttacaaaacatggttaccattaaatgaaaaatttaaagacctaatagcggtgttgygggtgtttaaacattttctttaataagctattataaatactcatacttcatcttctacatttgagtgtgcatgtgtgtgtgtgcatgcacagacacacatattactagagtcaaaatgttgcaggcacaaagctttccccgatcacatcagtagatggtacattcctaagcactcctcagccatggaaaacacctgtttcttctattaatagtgagctcggttttcaggcttgcatgtgtctgggtgtatcctcagcacggagaggaagtgcaaggcaaggaagaaactctgacaaggct

SEQ ID NO: 66706 - DNA, 601 bp, Human
aaaaagcagtgttgaatgtctaaacaccagtttctgtaatgccagctagcatcctgaaccacatgtgatgtatacatgattttttttttttttttaagatagctgactctcactgagtggatatctgtgttttcactatggaagcaagagtcagcaaagaagaaccttcaatccaaatgaactgcaggaaaagatcaacccctgcttcctagccaggaacaatggactcaccctgtgaacatacaaagttctcagacttctcagctggttaacaaaagaaatttaaaatgtaaaattgaawagaatgttatagtgactaatttaatctaaatgatgcaattggaaaagttaagaataaatccaaacacacacatttgccaatttggggacataatttaactcttttccacaaaggcactgaaattcatttatgaataccaacgttttcatgattaaattatattaaattctagacctagaaggaagatagtcattttacaaaacatggttaccattaaatgaaaaatttaaagacctaatagcggtgttgcgggtgtttaaacattttctttaataagctattataaatactcatacttca

SEQ ID NO: 66707 - DNA, 601 bp, Human
aaagcctgcactgaaacagacactatcattcaaatatgttaaaaaaagcagtgttgaatgtctaaacaccagtttctgtaatgccagctagcatcctgaaccacatgtgatgtatacatgattttttttttttttttaagatagctgactctcactgagtggatatctgtgttttcactatggaagcaagagtcagcaaagaagaaccttcaatccaaatgaactgcaggaaaagatcaacccctgcttcctagccaggaacaatggactcaccctgtgaacatacaaagttctcagactgctcagctggttaacaaaagaaatttaaaatgtaaaattgaaaagaatgttatagtgactaatttaatctaaatgatgcaattggaaaagttaagaataaatccaaacacacacatttgccaatttggggacataatttaactcttttccacaaaggcactgaaattcatttatgaataccaacgttttcatgattaaattatattaaattctagacctagaaggaagatagtcattttacaaaacatggttaccattaaatgaaaaatttaaagacctaatagcggtgttgcgggtgttt

SEQ ID NO: 66708 - DNA, 601 bp, Human
acaaacagatgagttgacttagtcattttcatacataaccccaccaaaacaataaatagagccaacattttctctttttctttttttcagggtgggagggatggcaaccacttcccttaactcctatgtagaagacaccctttaattggcctcattttggaggattcaattccagaataactgcctttgaggtagatcacccttcatgtcaaaaaagcctgcactgaaacagacactatcattcaaatatgttaaaaaaagcagtgttgaatgtctaaacaccagtttctgtaatgccagytagcatcctgaaccacatgtgatgtatacatgattttttttttttttttaagatagctgactctcactgagtggatatctgtgttttcactatggaagcaagagtcagcaaagaagaaccttcaatccaaatgaactgcaggaaaagatcaacccctgcttcctagccaggaacaatggactcaccctgtgaacatacaaagttctcagacttctcagctggttaacaaaagaaatttaaaatgtaaaattgaaaagaatgttatagtgactaatttaatctaaatgatgcaattggaaa

SEQ ID NO: 66709 - DNA, 601 bp, Human
aacaatttctcacttcattgatcatttctagttggagacactttgcagcagagtaatattacctccttttagcatgatccgacccagttgttttcttgactttgttttagaatgaatctcttctgcatcatctaatacaaggttcatatactcatcaaaaccaatgatacagccttctatccgcatattcacttgctcatagagccacacctgaatccgcgatctattttgtaagtatctgaagatgaggctgatgggctgcaccataaccttctgcactttctggccctggccacggtaygccatggtggaatttcacccattttttttttttttttataatttattttgttttgttttgttttttgagacagagtctcactctgttgcccaggctggagtgcagtggcgcgatctcggctcgctgcaggctccgcctcccgggttcaggccattctcctgcctcagccccccaagtagctgggactacaggcgcccgccaccacgcccagctatttttttttagcagagacggggtttcaccatgttagccaggatggtctcaatctcctgacctcgtgatctgcctgccttggcctcc

SEQ ID NO: 66710 - DNA, 601 bp, Human
ggataaagagctctcgtgccgccagcaggcggccaacctcatccaggagatgggacagcgtctcaatgtgtatccttttctgttcgccgccgctcacgccctgtttcccttgcccggtcgccgggcctggtgccccgcgaacatggcgccgccggcctcggccttcgctgggcctcggcgccgcggtcagggaagtaatgttccggctcgggcagtcgcgaggggtcagcagaggaagggaggaggagataggaccccaggaatgcgggccaggagcctgcgttgtgtaatctgtttgggscagcgcgtggtggtggcggcgggggttgggagtgtggctcaggcgaaagaggaattttagggattattgcagaaaaggggcggctccctggacttgtccctgaccccgaagggtttgagaggtaggagggttagcgatgctgaaaggcctaagtgtttgccgcagcctttcccggctctcgtcgccggcttgatggcggctctcttctaccttgggagcgtactggagttctttatgttcttggcgtggttttgtatgggtgtgtgcgcgcgcgtttcaactgtttcattttgagtttag

SEQ ID NO: 66711 - DNA, 601 bp, Human
cctttacctaaactagagtcataaagatttatttgtcttttcttccaagagttttatagatttagctcttacatttaggtctgtgattcctttagagttagtttttatgtatgatgtaaataaggatttgaattttttttttttttgagacatctcactctgtccctcaggctggagtgcagtggcgccatctgggctcactgcgtgctccacctcccaagttcacgccattctcctgtctcagcctcccaagtagctgggactacaggtgcctgccgccacgcccggctgattttttgtrtttttagtagagacggggtttcaccgtgttagccaggatggtctcgatctcctgacctcgtgatttgcctgccttggcctcccaaagtgctaggattacaggcataagccaccatgcccggatctttttttttttttttttttttttttggtatttgaatatacagttgtcccagcaccatttgctgaaaagagttctttctcccactgaattttcttgggattgttagtgaaaatcaatggatcataaatgtaagcatttatttctggactctggattctattccatccccttatgcag

SEQ ID NO: 66712 - DNA, 601 bp, Human
ttaatcttgaactcctgacctgttggtctcaaactcctgacctcaggtgatccgcccgtcttggcatcccgaagtgctgggattacaggcatgagccaccacgctcggctgatattttttcttttttagaaacattcataatgctcaggtactccccactaaataattttttaaatgccggttatgttaaccattttcagtatattgtttaagtataatgtagttactctatggaagtcaagccttattctcttaatcagtactgcttttcagcaatattgaatactgatattttggggcygttattaacccagctttcttttaaatgtaattaggtatcttaacatccagcttgaagattttttttaattttttaatataaatttgctttcatgtcagtctttcactcacataattatttgagtaagaaaactaaaatgccacactgggttaataacattttctgcaattccttagtgctggtgtttctagtgcagcaaaattaaggatttaaaccactttttaacaatgtgctggaattttggtttgataggctcacacttggcaaatgccaattaacaaatgggcattttgacttatt

SEQ ID NO: 66713 - DNA, 601 bp, Human; identical to SEQ ID NO: 21300

SEQ ID NO: 66714 - DNA, 601 bp, Human; identical to SEQ ID NO: 21301

SEQ ID NO: 66715 - DNA, 601 bp, Human; identical to SEQ ID NO: 21302

SEQ ID NO: 66716 - DNA, 601 bp, Human; identical to SEQ ID NO: 21303

SEQ ID NO: 66717 - DNA, 601 bp, Human; identical to SEQ ID NO: 21304

SEQ ID NO: 66718 - DNA, 601 bp, Human; identical to SEQ ID NO: 21305

SEQ ID NO: 66719 - DNA, 601 bp, Human; identical to SEQ ID NO: 21306

SEQ ID NO: 66720 - DNA, 601 bp, Human; identical to SEQ ID NO: 21307

SEQ ID NO: 66721 - DNA, 601 bp, Human; identical to SEQ ID NO: 24698

SEQ ID NO: 66722 - DNA, 601 bp, Human; identical to SEQ ID NO: 24699

SEQ ID NO: 66723 - DNA, 601 bp, Human; identical to SEQ ID NO: 24700

SEQ ID NO: 66724 - DNA, 601 bp, Human; identical to SEQ ID NO: 24701

SEQ ID NO: 66725 - DNA, 601 bp, Human; identical to SEQ ID NO: 24702

SEQ ID NO: 66726 - DNA, 601 bp, Human; identical to SEQ ID NO: 24703

SEQ ID NO: 66727 - DNA, 601 bp, Human; identical to SEQ ID NO: 24704

SEQ ID NO: 66728 - DNA, 601 bp, Human; identical to SEQ ID NO: 24705

SEQ ID NO: 66729 - DNA, 601 bp, Human
tacctgaggtcacgagttcgagaccagcctggccaacatgatgaaaccccatttctactaaaaatacaaaaattagctgggcatggtgacacatgcctgtaatcccagctacttgggaggctgaggcaggagaattgcttgagcccaggaggtggaggttgcagtgagctggtatcataccactgcactccagcgtggccaacagagctagactctgtctcaaaaaaataaaaaatgaataaaaaataatgatacaaaagaatttagtgtatatttgcaaaaagctagaaaagaggactcsgaattttcccaacacaaagaaatgatgaatgtttgaggtgatgaatatactaattattctgatttcatcatcacacattgtatacatgtatcaaaatatattttgtactccatacatatgtacaattattgcatgtcaaccaaagttaaaagaaaaaaaatcttttagggtcagatgtgttttggaattaaatgtttcctttgagaaaagtacctatcagccccatgggccgcagacagctagctctccatagtcaagcacactgatatctctgcagcagaacttaggaatgtttgctca

SEQ ID NO: 66730 - DNA, 601 bp, Human
gtgaaataagtcaggcacagaaaggcaaatactgcatgttcttactcacatgtgggagctaaaaagatgagctcctagcagcagagaatagaattgtgattattagaggatgggaagggtagtagggagggaggacagggagaggttggttaatggatacaaagttaagctagataagaagatgaagttctagtgatgtgtggcactgtagagtgaatgtagttaacaataatttaggctgggtgcagtggctcacatctgtaatcccagcactttgggaggctgaggcgggcggattacytgaggtcacgagttcgagaccagcctggccaacatgatgaaaccccatttctactaaaaatacaaaaattagctgggcatggtgacacatgcctgtaatcccagctacttgggaggctgaggcaggagaattgcttgagcccaggaggtggaggttgcagtgagctggtatcataccactgcactccagcgtggccaacagagctagactctgtctcaaaaaaataaaaaatgaataaaaaataatgatacaaaagaatttagtgtatatttgcaaaaagctagaaaagaggactccgaa

SEQ ID NO: 66731 - DNA, 601 bp, Human; identical to SEQ ID NO: 24706

SEQ ID NO: 66732 - DNA, 601 bp, Human; identical to SEQ ID NO: 24707

SEQ ID NO: 66733 - DNA, 601 bp, Human; identical to SEQ ID NO: 24708

SEQ ID NO: 66734 - DNA, 601 bp, Human; identical to SEQ ID NO: 24709

SEQ ID NO: 66735 - DNA, 601 bp, Human
aaagtctggtagagctcctcgggctccagctgcagctccagcagggcgcggtccatcttgttcatcatcagcacaggcttgatgcgctcggcaatggcctgccgcagcactgtctccgtctgcacgcacacgcctggggacacgggggacagggcggcgctgtcatcctcaagcaaggatggcccccggttccaggccgtgcctcagggggacccactgcttacctgacacgcagtccaccaccaccaatgcgccatcggtgactcggagggcagcagtcacctccgaggagaagtcgacrtgcccgggggagtcaatgaggttgatgaggaagccggcaccgtccttgctctgcttgatgaagttcaagtcattctccgagagctcgtagaagagggagatggcactgatggagggagggactcgtcagggggacaggagccacacacctggcccagggagtctgggatgctgtcagaagccaggctgctcctccctccatgactcatccctggagaggctcccacaagagccaacccacccttgtcctttgcctctgtccgagacatgccacccccatgacagggaactcctggtacca

SEQ ID NO: 66736 - DNA, 601 bp, Human
ctgggcgccttgggcatgggcctcagacgcaggctttcttcagtagacatctggtcaaagtgaagaaatgatcagtcatcacgaataggggggccagcccctccaccacccagggcagcgttccctgagctcgtctcttccagctgcccaaagatcaagggctgggtcaagtcggatgaaaacattccagcccccttctctgtcacccaacattcctggcaaaaacacacttccagtccccctcagctcaactccactccccaccggctcctgcagatcccgctgcggcaagcccaccacycagctagggagggccgtaccatgatgttgcccatggggccgctctcgccctcgccgtaggtggagatgatgacgttcacgttctccacgatgcgctggaaagtctggtagagctcctcgggctccagctgcagctccagcagggcgcggtccatcttgttcatcatcagcacaggcttgatgcgctcggcaatggcctgccgcagcactgtctccgtctgcacgcacacgcctggggacacgggggacagggcggcgctgtcatcctcaagcaaggatggcccccggttccaggccgtgc

SEQ ID NO: 66737 - DNA, 601 bp, Human
acaaaaacagccccacatgcctgtggaagactgcaaagaagaaacttgaggaacttaagaagctgagaccaagaccgagatcaagtctaggcgtctgcagagcctagctcagctcagctttaaagcagagggcaggtgtccggggtggggcgtggggaaggctggtcactggcgcctcaccttgatggggatgcaggcgtggtcctcctccaggtccttcaggcagatctccaggtgcagctcgccggcgcccgcgatgatgtgctctcccgactcctcgatgatgcactgaaagggatgygggtcagcaccaaaggggtaggcggctcggaacaggcgggaccaggctcccagcttccctttagctagggaccccgccagaacaagatttcagggaaggtgctgggaaactgggaccagcacaaactcctgaagaaatgttaagtcccacaagctacagtgaacacgcgcagagcagcctaggagagggtggtggctgcctgggcaggagtctccatttacagccacagccaagaacccctcctttcatgaccagtcaccccaatccaccaaccacagcaacccacacagccacaactca

SEQ ID NO: 66738 - DNA, 601 bp, Human
ccctggccaatgtcttaacgaagttctcaagtctacttcttttgttgttggtgttgttgttttttgagaaggagtctcgctctgtcgccctggctggagtgcagtggtgcaatcatggctcactgcagcctggaactccaaggctcaagcgatcgtcccaggcctcccaaagtgctgccattccgatcaaaattcccaagttactaccttaacccctcctggtccttgccctcggcaggtctcttaagaccctcatcgatggaacacccccgcccacccccaaccatctctgactccctcyaattctgaattttccaagaaccggacgacgccttccacgctcctgaaagcccactttgcctccctcccccgctgacctccactgtcctcgcaagattaacctcttcctccacgctccatgtatcaaagtcccccaaccgccgtctcccctaccccccaaaacgggcctccaaaaagggccccatctgagtctcctccaccgtcctctgccccttctcgcccgcaatctccgcacaagcccctaggcagaccccagtggctccctttgcagaacctccccccgcccccaaggccttgccca

SEQ ID NO: 66739 - DNA, 601 bp, Human
cttctctcaacctgctcagccaaaatcccccaccattcctgcacgttctcctcaacctcaaatcccagggctaccttactccctggccaatgtcttaacgaagttctcaagtctacttcttttgttgttggtgttgttgttttttgagaaggagtctcgctctgtcgccctggctggagtgcagtggtgcaatcatggctcactgcagcctggaactccaaggctcaagcgatcgtcccaggcctcccaaagtgctgccattccgatcaaaattcccaagttactaccttaacccctcctrgtccttgccctcggcaggtctcttaagaccctcatcgatggaacacccccgcccacccccaaccatctctgactccctccaattctgaattttccaagaaccggacgacgccttccacgctcctgaaagcccactttgcctccctcccccgctgacctccactgtcctcgcaagattaacctcttcctccacgctccatgtatcaaagtcccccaaccgccgtctcccctaccccccaaaacgggcctccaaaaagggccccatctgagtctcctccaccgtcctctgccccttctcgcc

SEQ ID NO: 66740 - DNA, 601 bp, Human; identical to SEQ ID NO: 21762

SEQ ID NO: 66741 - DNA, 601 bp, Human; identical to SEQ ID NO: 21763

SEQ ID NO: 66742 - DNA, 601 bp, Human; identical to SEQ ID NO: 21764

SEQ ID NO: 66743 - DNA, 601 bp, Human; identical to SEQ ID NO: 21765

SEQ ID NO: 66744 - DNA, 601 bp, Human; identical to SEQ ID NO: 21766

SEQ ID NO: 66745 - DNA, 601 bp, Human; identical to SEQ ID NO: 21767

SEQ ID NO: 66746 - DNA, 601 bp, Human; identical to SEQ ID NO: 21768

SEQ ID NO: 66747 - DNA, 601 bp, Human; identical to SEQ ID NO: 21769

SEQ ID NO: 66748 - DNA, 601 bp, Human; identical to SEQ ID NO: 21770

SEQ ID NO: 66749 - DNA, 601 bp, Human; identical to SEQ ID NO: 21771

SEQ ID NO: 66750 - DNA, 601 bp, Human; identical to SEQ ID NO: 21772

SEQ ID NO: 66751 - DNA, 601 bp, Human; identical to SEQ ID NO: 21773

SEQ ID NO: 66752 - DNA, 601 bp, Human; identical to SEQ ID NO: 21774

SEQ ID NO: 66753 - DNA, 601 bp, Human; identical to SEQ ID NO: 21775

SEQ ID NO: 66754 - DNA, 601 bp, Human
gggaacgtgcgcacctgtcccccgcccccggcacacacacagccgccccacactggaacacctgggcgccagcgccgggccactcgggcacgcagggcgctacgcagggccgcgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgckcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggccc

SEQ ID NO: 66755 - DNA, 601 bp, Human
gtgggaccggggaggaggagaaaggctggtttccataggaacgggaaaggaggcaagccaaaaggagggggagtcctctggattggtatcaacttggggggtcctggggggtccccagaggagtcactctagtccctggaggtagaaccaggctgactcaggccacctgtagattgggcagtccatagggatcagcccccctatttctgcattaaggggaatcctactgtgggggtcctcctgtctgcccatctgagatgggatgggggcctgggggtgcctggggggccctggggaatacccccttcatctccacattggggaagcacagagctcagggggtcccgggtgatcagcacaggaggtagggatggtgtctgcccagctgctggggaagggatggaggtcaggtgacccgcccctctatctctacgtaggggagtctccggagtccctgggctgccccactgcagggacggggtggggcctctgggtggcagcacctccaccatgtccatgaggttgcagaagaacacggcctcatcgattgtgaggtggccgtcgcggtgcagcacgcggtagtggatgacgtcgcggccaa

SEQ ID NO: 66756 - DNA, 601 bp, Human
tcccagtcaggcccaaggggtagtgccaggaaacacttcagttctcagagataagagctgcccttttctctttggctctcttgtccctccaaataccctctgggctcttccctacacagttctttacctctgaccaccccagaaacacacacagagcaaaaaaacacaacatggagacccataaaggttccagaatattccagggctctagcctccctgacccttctcccaagcactcctgtgttgtcccctccactgccctctggtcggttctgcagacgttctcttctccctccagaamgtgccccctccaaatgccacggtcttaagagatcattggccagggtgatgctagtctccacctggatgccatccctgatgggtacagacttccccagcagagagatactttcaaggagacagacatggggtcagaggaggcatttgcttttgaccttaaatattgaggatttcactacttaggggctggaaaagcatttcaggtgaagggaacagaatatacaatggctcagaggcatgaagaaaacgatgatcacagttgacctgggagggggtggatgtgtggaggaagggctttgca

SEQ ID NO: 66757 - DNA, 601 bp, Human
gccgacccctgatctaaaccccagagccttccagaataataatttcagggaatggtgtttcaaacattccaaacagtgggactgaccatacaagaccctggcagtgtgaagaagtcactaacgttgactgagcgcctgcttgagttcacttactcctcatgacagctgccattaccccctgttccagagggggaaactgaggctcagaggatttgcacgtcttcagctgcacaactagtaggtggttaagtatgggtttgaattcagctctgtgactccaaagcctcaatatgcacctccmatcttccttcagcacccccaacccagtccgccactcacctccaaactctccctctccgatctgtgctcccaatgtcaaatgctgcaggttcagtaaccagcccgctgtggagtgaagacccagtcagaggggtaatgggccccctaaatcctcccattgggggttctacttggtgagagactaggtgatgtctctcacagtgctgcagctgtggatacacatttgagtggctgctgggcctggcaatgcccctaggacatatcagagacaccccactcctggtaccaattattgttgttg

SEQ ID NO: 66758 - DNA, 601 bp, Human
agagagtctgccgacccctgatctaaaccccagagccttccagaataataatttcagggaatggtgtttcaaacattccaaacagtgggactgaccatacaagaccctggcagtgtgaagaagtcactaacgttgactgagcgcctgcttgagttcacttactcctcatgacagctgccattaccccctgttccagagggggaaactgaggctcagaggatttgcacgtcttcagctgcacaactagtaggtggttaagtatgggtttgaattcagctctgtgactccaaagcctcaataygcacctcccatcttccttcagcacccccaacccagtccgccactcacctccaaactctccctctccgatctgtgctcccaatgtcaaatgctgcaggttcagtaaccagcccgctgtggagtgaagacccagtcagaggggtaatgggccccctaaatcctcccattgggggttctacttggtgagagactaggtgatgtctctcacagtgctgcagctgtggatacacatttgagtggctgctgggcctggcaatgcccctaggacatatcagagacaccccactcctggtaccaatta

SEQ ID NO: 66759 - DNA, 601 bp, Human
gctgggactacaggcatgctccactgtgcctggctttttttttgtacagatgggggtctcgctacgttgtccaggctgcacctgaactcctgagctcaagggatcctcctgccccgacctaccaaagtgctgggattccaggcatgagccaccgtgcctggctggtttttgcatgtttaaatggttgtaaaaacaaatcaaaagatgagtgctgtttcaggacatgtgagcattacacaaaattcaaatttctgggtcatagttttcatggccacgcccatatgtttacatattgtctgtrgtcgctttcactccacaagggcaggattcagtagtggtgacagcagctacctggcccacaaagcaggaaatatttacaatctggccttttacagagagtctgccgacccctgatctaaaccccagagccttccagaataataatttcagggaatggtgtttcaaacattccaaacagtgggactgaccatacaagaccctggcagtgtgaagaagtcactaacgttgactgagcgcctgcttgagttcacttactcctcatgacagctgccattaccccctgttccagagggggaaactg

SEQ ID NO: 66760 - DNA, 601 bp, Human
tagctgggactacaggcatgctccactgtgcctggctttttttttgtacagatgggggtctcgctacgttgtccaggctgcacctgaactcctgagctcaagggatcctcctgccccgacctaccaaagtgctgggattccaggcatgagccaccgtgcctggctggtttttgcatgtttaaatggttgtaaaaacaaatcaaaagatgagtgctgtttcaggacatgtgagcattacacaaaattcaaatttctgggtcatagttttcatggccacgcccatatgtttacatattgtctrtggtcgctttcactccacaagggcaggattcagtagtggtgacagcagctacctggcccacaaagcaggaaatatttacaatctggccttttacagagagtctgccgacccctgatctaaaccccagagccttccagaataataatttcagggaatggtgtttcaaacattccaaacagtgggactgaccatacaagaccctggcagtgtgaagaagtcactaacgttgactgagcgcctgcttgagttcacttactcctcatgacagctgccattaccccctgttccagagggggaaac

SEQ ID NO: 66761 - DNA, 601 bp, Human
taaaatattgatacagggtctcactctctcacccaggtagagtgcagtggcgtgatcacagctcactgcaggttcaaattcctgggttcaagggatcctcccatcccggcctcctgagtagctgggactacaggcatgctccactgtgcctggctttttttttgtacagatgggggtctcgctacgttgtccaggctgcacctgaactcctgagctcaagggatcctcctgccccgacctaccaaagtgctgggattccaggcatgagccaccgtgcctggctggtttttgcatgtttaartggttgtaaaaacaaatcaaaagatgagtgctgtttcaggacatgtgagcattacacaaaattcaaatttctgggtcatagttttcatggccacgcccatatgtttacatattgtctgtggtcgctttcactccacaagggcaggattcagtagtggtgacagcagctacctggcccacaaagcaggaaatatttacaatctggccttttacagagagtctgccgacccctgatctaaaccccagagccttccagaataataatttcagggaatggtgtttcaaacattccaaacagtgg

SEQ ID NO: 66762 - DNA, 601 bp, Human
agatcaggacccccaacaaacagggacagagagacagacggacaggcccgctcacaccggtgcccatgtaacattcacacagctgcgggtccccagaccttgaaacacagcccccatgctcctcacccctgccgcccttgcaagctccagacccaagatcagagaaccatctggctctggcgcggtggctcacgcctgtaatcccagcactttgggaggctgaggcaggcggatcacctgaggtcaggagttcaagaccagcccgactaacatggagaaaccctgtctctaatgaaaatasaaaactagccaggtgtggtggcacatgcctgtaatcccagctactcgggaggctgaggcaggagaatcacttgaacccgggaggcagaggttgcagtgagccaagattgtgccattgcactccagcctgggtgacagagcgaaactccatctcaaaaaaaaccccacaaaaaacaaaaacaaagagagaaccatctaagccaggggtctgtgaacccccaccccctcggggccaaatctacctatcacctctttttgcaagacccttcagctcaaaatgttttttgcatttttattttta

SEQ ID NO: 66763 - DNA, 601 bp, Human
gacagagggagaatcagagaggtatagagagaaagttggagagagagaaaatcaggagacagagagagacagggagacagagagagggaatcagaaacagaaatagagggtgagttgcaagaacagggagagggggatagaacaagacacagacagagagataaagagttaaagacaaagcaagtcagagacagaattggagagagacagagagagggagaggcagagagagagagatgaattcacacgaaggcaaaaatgacttattctattcaaccaacactgctgctgcaatgagccygacgatgctcacatgggcccaagccctgccctccagaagcccttgatcttgggggagacaggtggacacagatcctctggccccaagagtcaagcctggatcagaggaggtacctgggcctggggaagccccgtggaggtgggggccctggggcacgtggaagggcttcctggaggaggctaagcagtttcttgaagggtgagagggaagatcagacagaaggggtaaacaaaggcctgggtgctgggaagagcccatgagtttaggagaaaatgcaagtgttttgggggctgcagcagg

SEQ ID NO: 66764 - DNA, 601 bp, Human
tggcactcacgtcttacacttggcacattcttccacaaacatgttcccgtggagctctgccagtttgtccctgtgggaagagcaggaagaggcttgatggtgggaaaggatccctggatgcccaggctttggagctggtgctaagcccctctcctccaggaaggcttcccggactcctctcccacaacattgatcaactccttctttctggctcttctagctcctggctccaccattcatctgctgtgcatctctgggcaagtggcccaacctctctgagcccaaggaatcattaaccccmaaggctgaacccaccttagataacgggaagccctttccactcacaaaatgcccgtccccctccgagagcatatgggaacctcttgatgtcaccaggtcagaagcacaggaattcaaattcccagtttataatggaagaaaccgagacattgaatggccctgaagcatgagatccaatcccagctttattttatttatttatttattttgagacagagttttgctcttgttgcccaggttggagtgcaatggtgcaatctcagctcaccacaacctcaatggcacaatctcagctcaccac

SEQ ID NO: 66765 - DNA, 601 bp, Human
ccccctctggcagagcccccgcccctgcacccaggtggcactcacgtcttacacttggcacattcttccacaaacatgttcccgtggagctctgccagtttgtccctgtgggaagagcaggaagaggcttgatggtgggaaaggatccctggatgcccaggctttggagctggtgctaagcccctctcctccaggaaggcttcccggactcctctcccacaacattgatcaactccttctttctggctcttctagctcctggctccaccattcatctgctgtgcatctctgggcaagtggmccaacctctctgagcccaaggaatcattaacccccaaggctgaacccaccttagataacgggaagccctttccactcacaaaatgcccgtccccctccgagagcatatgggaacctcttgatgtcaccaggtcagaagcacaggaattcaaattcccagtttataatggaagaaaccgagacattgaatggccctgaagcatgagatccaatcccagctttattttatttatttatttattttgagacagagttttgctcttgttgcccaggttggagtgcaatggtgcaatctcagctc

SEQ ID NO: 66766 - DNA, 601 bp, Human
cccagaactgtgagatcacaaatttctattgttctacgctgctcatctgtggcaggttgctacagcagtgccaggacacggatgtaccccccacaggagggaggcacggcccccccaaatccctccaggaggaagacatgccccccaaatccctccaggagggagacatactccttatatccccccaagagggagacacgcccccagatccccccaggagggccacaccccagtccccccataccctctgggtctctgggacatcggattcgacccccaaccccctctggcagagcccccrcccctgcacccaggtggcactcacgtcttacacttggcacattcttccacaaacatgttcccgtggagctctgccagtttgtccctgtgggaagagcaggaagaggcttgatggtgggaaaggatccctggatgcccaggctttggagctggtgctaagcccctctcctccaggaaggcttcccggactcctctcccacaacattgatcaactccttctttctggctcttctagctcctggctccaccattcatctgctgtgcatctctgggcaagtggcccaacctctctgagcccaag

SEQ ID NO: 66767 - DNA, 601 bp, Human
tctagggtgacgttctcccagggaggtggggggtggacaggtgaccagaactagcacccagcgacacggaacgagtagccttccacgaataacgggctgggatgctgctcggtgcccggagcacagaaaacaaagcaggaaactgtcccagacagacgaaggggctcgagagacaagacccagcatgggatcccggaccaggagaaacaggaacaattggagcatgggggcgacaggccgagtctggattcgggattagagaaggcgatgtccactttacttttcctgactttaatcgttwtactgggccgggcgtggtggctcacgcctgtcatcccagcactttgggaggctgaggcgggcagatcacaaggtcaggagttcgacaccagcctggccaatatggtgaaaccccgtctctactaaaaatacaaatattagccaggtgtggtggcgggcgcctgcagttgcagctacttggatggctgaggcagaataattgcctgaacccgggaggcggaggttgcagtgagccgagattgccccactgtactccagcctggatgacagagcgggactgtctcaaaaaaaaggagaaaca

SEQ ID NO: 66768 - DNA, 601 bp, Human
ggggatctccagccccaggtgcttcatgagccgggtcatgacctcgtcaacgtagccatggatgcggaggtcagcatggcggtcctgccggggggcgggacgggtcaggcgtgggggacagagggtgcatggtggccctgggcaggggtaggctcagacacctacgtgcttggtgggctgcaggttgacgatgaccaggcggcctccccggcgcttggtagccagcggcaggttcccgctgggccggatctgcagcgatgtacccagcgtgatggacaggtcggcgttcctggggccgggragcgtgggctgagcctgatgccctgctcctgccaacatcccgagccagccctgggggccggttcacacctaggccatctgtgctcaccggggcggtcaaggccagccccactcccgagtcagcctttgggatcccgccctgccctcctctgcggtccgttggcggggtcattgatctgggcgggcccttagacacttccggggagtatcacagtgtggtaagagcttggacacctagggtgggaccctggctcggtcacctcccggctgggcagcactggatagaggagacacctggcgg

SEQ ID NO: 66769 - DNA, 601 bp, Human
gggtctgtggggggcagggctggtgggccgctcccgtttggggctggcgggctctgagccgttgtgctgggcgcagggctcctgcttggggccggcggggatagagccgttgatccgggtgggagattcctccttgggctccagcttgggggtgggcgggcggggcaggggtggcagcgccctctccagcacacgggggccgtcccaggcggggatctccagccccaggtgcttcatgagccgggtcatgacctcgtcaacgtagccatggatgcggaggtcagcatggcggtcctgccgrggggcgggacgggtcaggcgtgggggacagagggtgcatggtggccctgggcaggggtaggctcagacacctacgtgcttggtgggctgcaggttgacgatgaccaggcggcctccccggcgcttggtagccagcggcaggttcccgctgggccggatctgcagcgatgtacccagcgtgatggacaggtcggcgttcctggggccggggagcgtgggctgagcctgatgccctgctcctgccaacatcccgagccagccctgggggccggttcacacctaggccatctgtgctcaccgg

SEQ ID NO: 66770 - DNA, 601 bp, Human
aagctggggtttggggtgccggggatgaacaggaacaaaggagaggcgctgtggctccccgttctggaccctcgtctggccacagggaagcagcactgatgactctggggaaaggccccggcctctgaatcagataaacctcaagtcgctgctctgctgttttactggctgtgtgacctgggcaagtctttctatccctcggagcctctgtgttcttatctgtaaaatgggagtaatcctagcctcacgggctggctgtcaggattaaaagtgctttctaatcctggcattggcagctatwtgagccattggtggctttgcaggtctgacccgactctctgggccatggggtggtgctcgggcctaggtggggacccctgtggagtcagactgtctgctctgagccccagggccctgaagcttgggtggcagccctgcagttgcccagagttcctgtctaagtggctttgttgcccatcatctcagaaagcaacttctttcctccctgccttttcctgtctgtgcttctgccccagtgccccctggctgggctctcaaacccactgcttgacagcctggtcttaggacactgtattgtggc

SEQ ID NO: 66771 - DNA, 601 bp, Human
tggcagctatttgagccattggtggctttgcaggtctgacccgactctctgggccatggggtggtgctcgggcctaggtggggacccctgtggagtcagactgtctgctctgagccccagggccctgaagcttgggtggcagccctgcagttgcccagagttcctgtctaagtggctttgttgcccatcatctcagaaagcaacttctttcctccctgccttttcctgtctgtgcttctgccccagtgccccctggctgggctctcaaacccactgcttgacagcctggtcttaggacacygtattgtggcaaaggctgtggggtcaggatatcccctcccctccctttgccaccccttttagtgagtaacaggtgctgtgtgttttggggatgagtgaagggtacatttggtgaagcacagagagagtgcacaaggcttcagtttgcaagatgggcacgggaagattccaggccatctccaaaacctcttccatctccaacctctgtgctgctgaaggttctgtttacttgtgaccctgagaaggggatgccctgtgggggctcttctgagatcatgctgtccattttcctgcctccaag

SEQ ID NO: 66772 - DNA, 601 bp, Human
gctgggctctcaaacccactgcttgacagcctggtcttaggacactgtattgtggcaaaggctgtggggtcaggatatcccctcccctccctttgccaccccttttagtgagtaacaggtgctgtgtgttttggggatgagtgaagggtacatttggtgaagcacagagagagtgcacaaggcttcagtttgcaagatgggcacgggaagattccaggccatctccaaaacctcttccatctccaacctctgtgctgctgaaggttctgtttacttgtgaccctgagaaggggatgccctrtgggggctcttctgagatcatgctgtccattttcctgcctccaagtgacttctaagacagcatggctctgaggaaggagcactgacttgggtgttgggagatcacagttcccatctgagcaccgtcactggcttgctgtgctaccttgcttgggttacttaacctctctgggcctaagcatccctatctatgaaacctaacaaccctggttccaatgctttcctagaatattggggaagtgtcggctttgagtatacttgacaaaggccacagattgggggtggggtatataaaagtcta

SEQ ID NO: 66773 - DNA, 601 bp, Human
gggggaccccctggggaaggctgggagcatgacctcttcccaagggtacggcatctaaaagggatctccggaacattgaaaagccatgaaggccgggcacagcggctcacgcctgtaatcccagcactttgggaggctgagggaggaggatcgcttaaggccaggagttcaagaccagtctggacaacatagcaagacccggtctctttctataaatgaaaaaataataataaagccatgaagatccccaaagaaggctgtgctaatggcggccggaagagcagagggcaccacagatgcsgtgctttcagctttttccttctcctccaggcctcccttctttccttcctctctcgctatttataaataagagaaggcattgagggcccccacctcgggtacttgcagggccttggcctgggaacaggacaagcagcaagtcagttgacccggggttgctcaattccccaagagctgacgcaaactccagaatcagacctgccctggccacctggccctgccccttaccagctaagggctccagcagagtcctagtcttgagcgaatcttatacctgcagccctgtccaccagctgtgctt

SEQ ID NO: 66774 - DNA, 601 bp, Human
atctgtgaaatgggcacaatcagacctgcctcaccaattggaatatagatttaggtgcagttttcttttttctttccttttatctattctctctctctctctctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgatt

SEQ ID NO: 66775 - DNA, 601 bp, Human
ttttcttttttctttccttttatctattctctctctctctctctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgattttcaatttttcacttgaggcccccatattttggaagattgtagtttgctgaacacgctga

SEQ ID NO: 66776 - DNA, 601 bp, Human
tgtggggcaacagcaaagggtaacccccagcctgcagcctcaggggggcttcccatctagcgaggggcccagggaggccatgaggagagccatgagggaggaaggtggggactctgggcctgagtgactccttcagggtggggtgcgggcagggagccttcaggagggagggtactgcctgagcagggctcttaagggacacgtggaatttgttacaggaagcaccaggccattccaggcatagaaatcagctggggtgcaaaggcctgggggtcagaagagtggcagattgctccatggyaggaagccccagctcctctgggtcgttcccgctgagggattccagctgttggcaccgaggggtgcagccagggcagggtggtgctgcctgccaggctgaggtgggagacagctgggtttctagccctgcttgtcactcgctataggtgcagccaaacgctcagcaggcccaaactctgggcagtcctgactcccaggcagtgctgtgaggaaggggaggaggaggcacactgaacccacctgctacgttggctggtggaaatttggccaggtctgcactggcccagcggtgctgggtgtc

SEQ ID NO: 66777 - DNA, 601 bp, Human
gccaaccccagtctttcaggagagagggcaggactcaggggcttgctcccgggggtcctgggaaggcacaatggtgacagtgctgcagctctgcactcctggagggtcactcagagacccgagagaggagggctctgcgtctgctcctctgtccagggctgtagcttctctgggtgcctttgcttttctcttttctcccctctttttttttttttttcgagatggagttttgctctgtcaattaggctggaagtgcagtggcatgatctcagctcactgcaacctcctcctcccaggttcrggggattctcctgcctcagcctccagagtagctgggattacaggcacacgccactatgccgggataattttgtatttttagtagagacagggttttgccttgttggccaggctggtctcgaactcttgacctcaagtgatccacctgcttcggcctcccaaagtgctgggattacaggtgtgagccaccacacctggccctctctctcttttcattcatcacattgttcatctcttcccggaggcatccagcacagtctttgagactgtgagctgtgaagtcagacaggacccaggtcca

SEQ ID NO: 66778 - DNA, 601 bp, Human; identical to SEQ ID NO: 20671

SEQ ID NO: 66779 - DNA, 601 bp, Human; identical to SEQ ID NO: 20672

SEQ ID NO: 66780 - DNA, 601 bp, Human; identical to SEQ ID NO: 20673

SEQ ID NO: 66781 - DNA, 601 bp, Human; identical to SEQ ID NO: 20674

SEQ ID NO: 66782 - DNA, 601 bp, Human; identical to SEQ ID NO: 18519

SEQ ID NO: 66783 - DNA, 601 bp, Human; identical to SEQ ID NO: 18520

SEQ ID NO: 66784 - DNA, 601 bp, Human
ttttcttcttctacatgtgtagtggcattacatcagaagctccaggggtccaggcaggaacataaatagttgcagtggcatgtacagacaccagatggtggggaggaggtcttctgaacacagaccagatcacaaggaaatactgccacttacctctaggtaactgatgtcactaggaatgggggcctggtgctcccgaatcccttgattgcccccagcccccttgaggaagagccagcattctagatgcttatatgaaatctactctttttaaaaagccagcacttttttttttttaaarcaactctgtacaggccagagaaaacatgtatgtgcatgggcttgatcagcctctgaaccaccaatttgctactttgctgccagtttgcagttgaatggtcagacaaggcattagcaccctgggtcactgtcaccatctccccttctttgggggttgccttgaaaggcattctgaaggaaacaccaagagtgccaaggagagagagacctgttaactatttggctctggatgcctagggcagcagcaaggatccacctgccggtctggggcttgcttgctgggtttgggcaccccctaact

SEQ ID NO: 66785 - DNA, 601 bp, Human
ccggtctggggcttgcttgctgggtttgggcaccccctaacttccttccataaatgcttccagctgcagacctgtactttttggctgcttaccttttgggaagcagatggcaggtgtagttgcttgaacattctgcttgtctaattgagcacgttgagttgacagagttcgcactgtagctgagtctaaaaagatgcaaacacaaataacctaacctcaaagagaactggctcagtattttacctgaggttgttaacttctcatgggagtgattatttctgaacaattggaagtctttttygtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcctcttcg

SEQ ID NO: 66786 - DNA, 601 bp, Human
cggtctggggcttgcttgctgggtttgggcaccccctaacttccttccataaatgcttccagctgcagacctgtactttttggctgcttaccttttgggaagcagatggcaggtgtagttgcttgaacattctgcttgtctaattgagcacgttgagttgacagagttcgcactgtagctgagtctaaaaagatgcaaacacaaataacctaacctcaaagagaactggctcagtattttacctgaggttgttaacttctcatgggagtgattatttctgaacaattggaagtcttttttrtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcctcttcgt

SEQ ID NO: 66787 - DNA, 601 bp, Human
cttttttgtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcmtcttcgtatctggtgaaatggactggggatgaaatatctcagctactatgggaagagtgtttcagggccctagattttctctatgtctggatctttcctggtctcttcatctcagcctggctatttgctttgtgggtcttattttcatacctgaaaatgcagctccctttcttaaaggcagagaaaagcattttaatctttgaagcttctttgaagatgattttattatgggtagtgaagggtagccttgggacactaccttgtacaactctcatttgcttacccaaaaatggtttcaat

SEQ ID NO: 66788 - DNA, 601 bp, Human
tatacagcctgggagagtgtgtatcctaattggggctcagaagatgcgttggatgcactgtcctgcagccacccccacctccaggcagctgccttggggaggaaacatcccccctgaactccctgtctctggtcgacatgaggagctttgcttctactgctaccttggaagggaaccatggtggttaatgggactattggtggtggagactggaccccttaagaggaactgccctggttgactgggagctgcctctgacctgcctgtgacttggaggatgagagacagttgacttgggagyctccctgttgaggccccagccactcgagaactgaatcatatgagcagtgtggggccagagctactgtcctgggcttttggcctgttccccatcttaccatacatgaattgggacacaaaccagaccaggagtcagggtttcttaaggccttaaagagcatactttttttctaagggttctgaaaatgaaaacatttaaagcatttttgaattccatgcagtaaaataaaaacggtttagtcttttagtgaaataccgagtgttttttacttgaaagggttatggttattccaatatttca

SEQ ID NO: 66789 - DNA, 601 bp, Human
ctgctgtgggcacccttatgtgtaggcagtcgtttttatggattactagaaggggtacgagatgtcctttgacctggttcctaagggcatgtgtgctcagtccctggggctctctctttctctgtgcttgtctttttcattttttgtttttacacagctacgtgtgactcttttcctggtagatcatgggagaggagatagatagcaggaggacaagatgagagggaagttcttgatcaacaaacttatccagaattggatttcagaggagcaggctgtagtttaaaacaaaacaaaataratagcaaaccacgggaacacctgaatttgttacttttgcaactgaaaatcccagtcagatagaccccataatcaaatagggcagggacaggaactaaccttcactggttgcttgctgtagaggcagagaagtatataacacttaacagtctggactctataaataatatgaatcctggccctgcacttctagatatcagatttttatcgagttaccttacttctctgtctcaatttcctcaactgaaaaggaggattagatagatcttactgtgtaggattattagaagaattaaatgaa

SEQ ID NO: 66790 - DNA, 601 bp, Human
aaaagtgtatgcacaaggtgtgagctcatgtgcaatccgggtacaaagtagctaattaaagatggctcaagaattggtcataagggaggtagaaggaaaagaacatgaaagtattaccaagttatgctttccaacagcttttctgtggcagtggatgagccctgggattcaggaagatgtggattcataaatcatttattgagggcctgcactgtgctttgaatgtgatggggacaacagacataaaataacttaaaaagctgacctgtgtgagcagttaacataccaggcactttcccaytgctataggatgtgcgatcttgattattcctcaaaaacaacccaataatataggtactgtaattatgcccattttgctgctgaggaaagtgaggtccagcaaggtcaagttatttgcttgaggtcacatagtaaataagctgtggagctgacatttacaaccaagccagtcaatacaaatgactccaatattgatatggaaggaagtatattctgtactagagatatacctggtttagtagtggagcagcacaaagtgtgatcatttatgattggggaattgacttgtatatgtttgaga

SEQ ID NO: 66791 - DNA, 601 bp, Human
ctttatgcatgttgcccatttccccccaatatggttacattttgcaaaactggagtgtaatattgcaacaagcgggatattggcatccacacaacccagtgatacgactcagattttcccagttttacttgaactcgtttgtgtgtgcgtactaagttgtgtacactacttgttgtgtgttagtcttgtgcaggttcatgtctccaccgccacaatcagaatacagaacagctccaacaccacaggacccgggttgcccttctccctaactgctggcaaccaccgatctgtcctctgtttmtaaaattttgtcatttcaaacatgttatataaatggaatcagactacatgaaccttttgggattggctttttttcaactcagcttaattcccgggagattcatccaggttgtgtgtatcaagtttgttcctttttatcattgagtagtattctgtggtgtgtatgtaccacagtttgtttaaccattctgctgttcaagggcatctgggctgattccagtgttcaggcatttcaaatccactgtgaacatacacgtataggtctttgtatgaaactaagtattcacttacatgggataaa

SEQ ID NO: 66792 - DNA, 601 bp, Human
caagtaatcttgtatttgtactgcctttggacagaggtgggtagattttagagaacaaaaacactgggtactttacagtgtgctacagattctcatttaattataatttttaattataataaaataaacttgcaatccgaatgtgtttgatcggcttgatagtgacctgctatgcataccctgcagataattctgtctgcctaccttccctttcctcatgtttcagttctagctaaataataaaatcaaatttgttcttcaaagcccatttggatatttattattattattattattattrttattattattattatcattattattatttttgagatggagttttgcttttgttgcccaggctggagtgcaatggcaccatctcactgcaacctccacctcccgggttcaagtgattctcctgcctcagcctccgcagtggctgggattacaggcatgcaccaccatgctcggctaattttgtattttagtagagatggggtttcactgtgttggccaggctggtctctaactcccgacctcaggtgatcctcctgccttggactcccaaagtgctaggattacaggcgtgaaccaccgc

SEQ ID NO: 66793 - DNA, 601 bp, Human
aaagggcacagggttgggaataagggttgttggggtttaaatcctggctttgccacttcactggctgtgtaaccatgactaatattgctaaacctccatatcctcatctggtcaatgggaccaatattggcaccccatctcacaacttcagtgtgaagattaaattagataatacattaaaatacttagaatacccagttcattctttgagagcactattaccctgacagctaaatcagacaaagatatcatgagaaaataactaatatcccttatgaatatagatataaaactcctccayaaaatatgaacccattcagcaacatataaaaaggttaatatacagtgaccaagtgggatttatcccaggaatgcaaggtcagtttaacatctgaaaatcaattaacgtaacacaccatatcaatagagtgaagaaaaaaccacatttttatctcaacagatacagaaaaaggatttcacaaaatccttcatgatgtaaataatcagcaaactaggattagaagagagcctctcacctgctaaagggcatctgtgaaaaatctaagcaaatgtatgtaatagtaaaagactgaatgctttc

SEQ ID NO: 66794 - DNA, 601 bp, Human
acaacactattaaagttcataaacaattgtagcaaggtttctggatacaagataaatacataaaaatataaaactcaattgtaaattttttttttttttttttgagatggagtttcgctcttgtcacctaggctggactgcagtggtgcgatcttggctcactacaacctccgcctcccaggttcaagcgattctcctggctcagcctcccgagtaactgggattacaggtgcctgccaccatacccagctaagttttgtatttttagtagagacatggtttcaccacattggccaggctrgtctcgaactcctgacctcaggtgatgcgcctgcctcggtctcccaaagtgccaggattacaggtgtgagccactgtgcctgccactcgattgtatttctgtacttaacagcaaacaacctgaaaatgaaataaagcaattttattcatcatagtgtgaaaaagaacaacatacacaggaataaatgtgacaaaagagcaaaaaacatttacctccaaaactacaaaatattgtttaaataaattaaataaccgaataaattggaagacattctgtgttcatgggttggaagacttaaca

SEQ ID NO: 66795 - DNA, 601 bp, Human
ttggctcactacaacctccgcctcccaggttcaagcgattctcctggctcagcctcccgagtaactgggattacaggtgcctgccaccatacccagctaagttttgtatttttagtagagacatggtttcaccacattggccaggctggtctcgaactcctgacctcaggtgatgcgcctgcctcggtctcccaaagtgccaggattacaggtgtgagccactgtgcctgccactcgattgtatttctgtacttaacagcaaacaacctgaaaatgaaataaagcaattttattcatcatwgtgtgaaaaagaacaacatacacaggaataaatgtgacaaaagagcaaaaaacatttacctccaaaactacaaaatattgtttaaataaattaaataaccgaataaattggaagacattctgtgttcatgggttggaagacttaacattgctaagacagcagtacctacaaattgatctacagattcagtgaaatccttatcagaatcccaggatcccatgacttctttgacaagttgattctaaaatttatatggaaattcaagacccagaatagccaaaacaatcttgaaaaagaaga

SEQ ID NO: 66796 - DNA, 601 bp, Human
ttcctgcttcaaaggatatcatcaagaaaatgaaaaggcaatccagagaacaggagaagatattttcaaatcataaatctagtaagcaacttgtatctagaatatataaaggacttttgccattaataaaaagataactatccagttaaagaatggacagaggatctgactggacctttccttaaaaaagacatacgttgaaaaacacaccaaagatgctcaaaaccattagctagcagggaaatgcaaattaaaactacactgcgatatcactttatatctcttaggatggctatcattaaaaaaaaaaaacagacaataacaagtgttagggaggatgtagagaaatgggaaccctcacaggtcactggtgggtttataaagatggcataaccactctggaaacagtctggaagttctttaaaagactcaccatagagttattataggacccaaaagaaatgaaaacagatgtccatacaaacacttgtacattaggggtaggtgtgttggctcccagcactttgagaggcctaggtgggcagatcgtgtgagtctaggagttagaatccagcctgggcaacatggtgaaacctcgtct

SEQ ID NO: 66797 - DNA, 601 bp, Human
tgaggggataagccagacagacatttgcagaagagtcttctaggcagagagcaccacagacatcaaagctcgggcatgcctcatgtgtttgaggactggtgggcctccgtggcttgagtggagtcagcagggaagaggatccagcatggaggtcagagctcagatcttgcaaagcctcatagccctctgtaaggatatgggctttcactctgagcgggagtgtgatctgattaggttttgaaaggatcaccggctgctgggtagtgaaagactgaaagcaagcctgggcccaggtctctcrccgtatcctcaggggtgggccatgggatttgagacctgcatgccatttggaataaaagggcatgccacctggacacagcatcaccttgcaggatctttgatttctttttgcctttttcttcctcatttaagggatacattcctactcaaaaaagggaaggatatgttgcagttatctacctcttttttgctaaccattgtatgatgcgcctggtttaagggacagttccctaatggttcctattaagctttggagaaagagtagtggtgtggtgggtgtcacatacctggagctttagag

SEQ ID NO: 66798 - DNA, 601 bp, Human
atacattcctactcaaaaaagggaaggatatgttgcagttatctacctcttttttgctaaccattgtatgatgcgcctggtttaagggacagttccctaatggttcctattaagctttggagaaagagtagtggtgtggtgggtgtcacatacctggagctttagagccttctgagaagataattcggtaaaaatacatcattttttgattggtgttgaaggaagttgtttttcgttgcacagattaaatttaaattgttcatgagagctaaagagcttgaaagcatttctttgttttctratctttaaaagtagagaagagtgagctggctatataatatagaactttctcggctttactttaccaaagcagtctgatttaaaaacttaaagccaacatatttcacatttatagtttaagattataaaaactaaatatgcatttaatttcataaatttatgtacttaatttcataaaattatgttttttggagaaaaatactgaggctataaaatcttggcttgtaagtaaataaaattattttaaatgtcagccagttttgatgatgagagctataattctaatgagtggcaaatattt

SEQ ID NO: 66799 - DNA, 601 bp, Human
tagagccttctgagaagataattcggtaaaaatacatcattttttgattggtgttgaaggaagttgtttttcgttgcacagattaaatttaaattgttcatgagagctaaagagcttgaaagcatttctttgttttctaatctttaaaagtagagaagagtgagctggctatataatatagaactttctcggctttactttaccaaagcagtctgatttaaaaacttaaagccaacatatttcacatttatagtttaagattataaaaactaaatatgcatttaatttcataaatttatgyacttaatttcataaaattatgttttttggagaaaaatactgaggctataaaatcttggcttgtaagtaaataaaattattttaaatgtcagccagttttgatgatgagagctataattctaatgagtggcaaatattttctagatatctttgaaatgatactctggtttctcttcagactgtataaatctttcactttttttttttttttttgagatggagttttgctcttgtcgctcaggctggagtgcaatgactcagtctcagctcactgcaacctccgcctccagagttcgggtga

SEQ ID NO: 66800 - DNA, 601 bp, Human
actttaccaaagcagtctgatttaaaaacttaaagccaacatatttcacatttatagtttaagattataaaaactaaatatgcatttaatttcataaatttatgtacttaatttcataaaattatgttttttggagaaaaatactgaggctataaaatcttggcttgtaagtaaataaaattattttaaatgtcagccagttttgatgatgagagctataattctaatgagtggcaaatattttctagatatctttgaaatgatactctggtttctcttcagactgtataaatctttcactttttttttttttttttgagatggagttttgctcttgtcgctcaggctggagtgcaatgactcagtctcagctcactgcaacctccgcctccagagttcgggtgattttcctgcttcagcttcctgagtagctgggaccaccacaggcactcgccaccatgcccagctaattttgtcttttttttttttttttggacggagtctcgttctgttactcaggctggagtgcagtggcgcgaccttggctcactgcaacctccgcctcctgggttcaagcaattcccctgtctcaccctctcta

SEQ ID NO: 66801 - DNA, 601 bp, Human
ccaccacaggcactcgccaccatgcccagctaattttgtcttttttttttttttttggacggagtctcgttctgttactcaggctggagtgcagtggcgcgaccttggctcactgcaacctccgcctcctgggttcaagcaattcccctgtctcaccctctctagtagctgggactacagagctaccgtgcccagcctaattttgtatttttagtagtgacggggtttcaccatgttggccaggctggtcttgaactcctgacctcaggtgatccgcccgcctcggcctcccaaagtgctrggattacaggcatgagccaccgtgcctggccaaatcttccaccttttactaaatatctttgacaagccttttgacttagtatactggtaaattagctttggtaatattattaacagatttgtaaatttttggtatatccacaaaattcatttgaaaagaagcaaaaatgaaacctttaaaaaagtataatgtacacattccaaatatgaaaatgtactacttcaccagagttgtgaagcatgtaagacgtggtccatatttaagaacaaagcagactttttaaagggactgtcttgtaca

SEQ ID NO: 66802 - DNA, 601 bp, Human
tcagcgtaacagacccaccttggtggggggctgctgcttccagctgctttgcagcttctgtcaggccagggctgcttgagtccttgctctgctatttaaatctatcactcgttggtgacagctttctgcttaagcagtggcagcatgtatgctacaggtttcagctcattacctctgtagggctgttcctggactgctggctgggggaaaggccagccatacagactgaggcaccagccccaaactctgtattggatgttgctgagcctgggtggagagtggggccgtgctacctacagtkcctgctacctgtccttcagaggacctgtctgcagcagggccagagcctaaggttttgttttctcccagcctgatgggactgtgatacttggacatggacatcaaggagatgtgggctttgccactctgcttaagtgggcctgggcaagtcattttacctcttggggttcattttctctgttaataggtggtgaacttttcaagggtgattaacatgtcatctttatctccatatcccttggacacagtaggtactcagtaaatgatagcttaaatttgtaaaatgggaatgataggaccc

SEQ ID NO: 66803 - DNA, 601 bp, Human
agacaatgaatataattctattaaactttgacaaatgggaataaagtgaaggaacccttgtatttccccaggttcatctcccatatccccagtattaaagaatctcagatgaatggggacttaaaaagttcatttgtgtatctttatttactgattcaaacttttactacctttgccagttgatctaaatagacatctctgtttaagcatcttctgtataaagaaggtgtataaatagtcaagaagcacatgaaaagatacttaacattagccattagggaaatgcaaattaaaaccccartgagttaccacttcataccctcaggtgactatggtcagaaagacaataacaagtgttggtgaagggggtgaaaaatgggaagccttatgcattgctgatggtaatgtaaaatggtgcagcctctttggaaagcagcctggcagttcctcaaaatgttaaacgtagagcaattctatttctaggtatttacccaagagaaatgaaaacatatgtccacgcaaagacttgtatgcacatattcacattagcattatttttatatgtgcatctgaatgccctcatctccgttatggattggat

SEQ ID NO: 66804 - DNA, 601 bp, Human
ttccccaggttcatctcccatatccccagtattaaagaatctcagatgaatggggacttaaaaagttcatttgtgtatctttatttactgattcaaacttttactacctttgccagttgatctaaatagacatctctgtttaagcatcttctgtataaagaaggtgtataaatagtcaagaagcacatgaaaagatacttaacattagccattagggaaatgcaaattaaaaccccagtgagttaccacttcataccctcaggtgactatggtcagaaagacaataacaagtgttggtgargggggtgaaaaatgggaagccttatgcattgctgatggtaatgtaaaatggtgcagcctctttggaaagcagcctggcagttcctcaaaatgttaaacgtagagcaattctatttctaggtatttacccaagagaaatgaaaacatatgtccacgcaaagacttgtatgcacatattcacattagcattatttttatatgtgcatctgaatgccctcatctccgttatggattggatgttaggacaccctatagaggagatttccagggatagctactcttgtgtttgtcttcttatatg

SEQ ID NO: 66805 - DNA, 601 bp, Human
tgggcacttagaagtgcttctgggatgggaggtcaggctgcagggtgatggacattgggcatgtgcttgggacactccttgaggcacatggagactatttgagatcacctctctgatcagaaagttgtttggtgagtaccaaaataagacaaaaatgagtaagtgtttttaagggagatttccctcaagctgtgtttggtagataactaataactctctgttctgggatattttctctctaggccactgtcattgacctctcaaatgcttgggggtgagaagggtaaagataatataaaartatcaagaaaaggaaagtaaagggaaaatagtaaaaaaaaaaaaaaaaaaagtcctatatagtcctatgaagaaagttttgacctagatataaaaatataggcaagtctgaaatcttgttgcttttctctttagtttgccttcgttgatataagtctgtttattcatgtctgtatgctaaccgctgacacttaaatgtgaaattgttctcaggactctgctgcattgtcctactagtagaagtcctggttttagaacataaggtctggatatgtacagcctagcttttggatgagcaact

SEQ ID NO: 66806 - DNA, 601 bp, Human
ctatttcattcttacagctctggagtaaaatggcgatgatctttggtctaccccaaaactgtcttaaatttcgcttgctttggctaactctgataggaaatagctatgggagagtaggaagggaatggggcttagagcccataattcaaaccctactaccacttctaggtatgagctgtgtaaccctgcacaggttacttatctccgttttctagattttatgcggtccatttggcatgtcctaagcacccagtacatgttcattaattattttttctcttctcaccaggtctggtctatrtcatgttcatctctatcctcattagcgtgatagtctctttgagattatttgatgaccaaattaatggggctggagtgtaacagcttaagagcaggtacattctgaagagtgagaataaactttgtctgtgtattatttactgtttaagaaaaaagaaaaaaacagccctcatggtgttgatggattttgggtaatcaagggagatttggaatatccctctcttttcgacatgtgacagcctgtctaggtgagggccagggtcacaatgatggttctgattgttcctctccaggagggccc

SEQ ID NO: 66807 - DNA, 601 bp, Human
gtacattctgaagagtgagaataaactttgtctgtgtattatttactgtttaagaaaaaagaaaaaaacagccctcatggtgttgatggattttgggtaatcaagggagatttggaatatccctctcttttcgacatgtgacagcctgtctaggtgagggccagggtcacaatgatggttctgattgttcctctccaggagggcccctgaactttgacatcatctcctaacgcagttctgccggaggccttcctgtcagagcctcctgggccagaatgggcctctgtggcgagccgggccygtaactgttcccactcataatgagcagagctgctcctgcaacccggcaggagcacccgagtgggtgtgcatgcacataatgggcccagctgctgtggctgcagcctgtgaatgccttccaagaggccagatgcctggacacatctctcagcagctacttttcctttaagggggatgctaactccctggcgcttatccctagtacctctgacaaggaaaggaaatccatcctgccctgaacagcagggtgagcaccttcaccggattcagtctcatgcatctcagcaagggagatgctagt

SEQ ID NO: 66808 - DNA, 601 bp, Human
atcatatcttcaatgacaccatctctgaataaggtcaaatttgaggtgtactgagggttaacacttcaacaaatctttttggggcatgcaattcaacccataactctcatgttgcatacatgggtgcaggtttaaagaggatcagtaatttgggtatggtcacaattaggcagtgttgggaccaggattggaactcaggccagcctgtccaaagccacttctctttctactaaactttggtgtgtcagaatcacttggagggctgataagaaagactggggcccaggctttatacccttgstcctccacctgtggtccatggaccaactggcaacatcagcatcacctgagagctttttttggaaatgcagagtctcaggtcccaccacatacatatttttaacaagatccccaggtgatttgggtgtgcagtcagtttgatgaagcacctgaatcgggtatacgctgcttctcagtcctgattgcatattagattgcttgagaacagtaaaagacaaaacacaaataacagtgatggcagccttaccccacgccattgaatcagatctctgatgaggcaccgacgtttatattttttaaa

SEQ ID NO: 66809 - DNA, 601 bp, Human
tctgattcacagtataagttgaggaccactgtggggctggaggtcctcatttctggaatatccagacttcaatattgaggttgagaattctttttgcacaggttcttctttttatttccacagtagtgcagaaactgggccaggaggggggctagtgtacggaatttatttcagagaaggcagaatattatatagcaaaggagaccacagtgcattttttttctgactttacctcttacagatactaagtgttgggtagcaacctatttgtccaccccaggagcttgggagaacatgaaargtggtgtggagatagcatatagtgggcagtcagtgcttgttgaattaaattgaataacaaaaaccataggaaatcagcgttgttggtctcactgaaacatatcatttatagagatgctattgtgttacttttggggtacaaggaagagttgcagaagactgcacagatgcttacgatgtttagcaattcttaggctacgtgggatggcttatgcttgtaatcccagcactttgggaggctgaggcgggcggatcacttgagtttaggagtttgagaccagcctgggcaatgtggtgaaac

SEQ ID NO: 66810 - DNA, 601 bp, Human
agcgatgtgccgattgcgcaaggctggaagcattgctcactcggagataccgaggcctgcttgccccgagccctttgttctcctggttgaaagcagttaattagcaactgtctccatagcaacaccctcatagtccaaaaacattgtctagtttttcagtttagcttatcacactgtttacctgaagggcttttcactgctctgagtctcatttgagttggcggcatgcctgttggggaagtgaattgtcaagatagaaaaaaacaccatggtagcaagaagccgaggagacttctctctrcccagcccaacccgggccctggattctgggaaaacagaagttgcgcctgcctaacattttcacctgtattttttttttttgttttgccataaaactgctgttctctccaccaagccctgaattgtgaggatttttcccccctttccccgagaggctttctaagctctttaatattccctgtttatagtacatttccatgattagtcatcttgaaaccccgagtgttctcagcccctgtacattcgaggaaattttgcttccctgagggtcttggcatttgcaaaggcccttggatgaagg

SEQ ID NO: 66811 - DNA, 601 bp, Human
tcttcagaatcacagcacaggttcaattcactgtggttgttatgtcataattatatattgtggatgtctaattccttttcaaacctagaagtaaagatcatgtaacatatcctagccaatattaaagcaatattattataaaaatgatctctgatgtagaaccactagaattagggccttaggtctacccatattgagtttgccctttttatttgcaaaatgcttgatcccagattgctatgagagatagacataatagtgatctttctgcttttgatagttaggtatcatagttttaagrcagcccatggagttttagaaattgtgtctgtgtctacagaatcatgtgtgtgattagataaagattagtaggtacagaaactagctgaagcattgattgatacaccttgtaccttccaaagaattgatctgtttaaatcaagttagttttacagctccgtttgttgcttctctagattgattaggtggttttatgatgtttcttttatttttttcactaggaattttgctgagtatttttaatacctgaattgacagactggtttatcggtgttgggggtctgtgtgagcttctcattag

SEQ ID NO: 66812 - DNA, 601 bp, Human
ccttactcatctctgaagagtcctaagtagcccgagtcctagatgtaatttgttgcttatccgcaaagtggttttgaaggatatggtttttcttctttgggtatgaaacataagaggatgaaggaaaaatgagaagttttgtttctaaatgaatatagtacacagcctcagaaaatatggggaaaagatgagaaggaaaattatttttatttctaaatgcactattcatttcattttccaagtaacttgtggctatcattatttttagtgatttatgcttaaatagtcttccttgggaatwatcaaatactggcttcaaatatagacagggaaattataggttcatagtaggctcataaaataacgcttagaatgaacttgggatgggacgtggaacagggcagcagactttccaccaggcgccattcctgtgttctcagctctacccttgagccttctctagtggggccccaaatgcaccaccatgatgtaagggtctgaccaactacttagtttctagcagcccagagtgaaggcacctctctgtgccttcctcttcgctaagcctcagtttttttgtttttgtttttttcccttgcaa

SEQ ID NO: 66813 - DNA, 601 bp, Human
actggttttctttcctaatgagtgtggtcattattagagttaagcctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtcccyattgacagggagcatgttaagggtaagatgctgcatttcactcattgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtcta

SEQ ID NO: 66814 - DNA, 601 bp, Human
cctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtccccattgacagggagcatgttaagggtaagatgctgcatttcactcrttgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtctaaaggagggggcaaaacgtagcgtcctgtgcttcaccactggggg

SEQ ID NO: 66815 - DNA, 601 bp, Human
cgtagcgtcctgtgcttcaccactgggggctggctgggccactgttaaggtctgtggagacttctgtttgcaggagaggttgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattctttttttttttttttttttttttttagatggagcctccctctgtcgtccaggctgtagtgcagttgtgcaatcttagctcactgcaagctccacctcctgggttcaagcagttctcctgactcagccttccgagtagttgggactataggcgcacaccaccacgcctggctaatttttgtatatttagtagagacagggtttcaccatgttggtcaggctagtcttgaactcttgacctcgtgatctgcccacctcaacctcccaaagtgctgggattaaaggcttgagccactgcgcccttcctctttccccattcttaagtac

SEQ ID NO: 66816 - DNA, 601 bp, Human
tgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattcttttttttttttttttttttttttgagatggagcctccctctgtcgtccaggctgtagtgcagttgtgcaatcttagctcactgcaagctccacctcctgggttsaagcagttctcctgactcagccttccgagtagttgggactataggcgcacaccaccacgcctggctaatttttgtatatttagtagagacagggtttcaccatgttggtcaggctagtcttgaactcttgacctcgtgatctgcccacctcaacctcccaaagtgctgggattaaaggcttgagccactgcgcccttcctctttccccattcttaagtacctagtaacaggtctgagctgtttagaggtgtaagggagcttgcgaagttgggaagtgtccggatgtatggacgctggagc

SEQ ID NO: 66817 - DNA, 601 bp, Human
cactaagccccctccattgcttaaaagccagtttgatcattgtttcttagaacatagtgacctgatatgcagaccttcctcttgtgaatttgttgaggacttttcctacaaggtcttctccaaggtccgtgtgagggttcggcattagcatctgggaagccagggatcctcatgctaaggcagaacaaaaacaggagtcagggctggagaggggcgtctgtggtctctggggcaaggcagcttgaggtgggacccagaagtccagggaatcagagaggaacagtgggttggagtagatctrtgggttggaataggtctgtgagaggtcttaggggagtggtcttgcccacagtggagtggccccgaatccactgaggatcccgggatgggggtgcaggccttcggttatcatagactgtatatgtgtatctgggtgggggtgggggtagggtggtgtgtctaagttctttcatgtctggggtggtgttgtagatcgaacttctcccaaacaggctcagccacaccggtaggacgtagtctcttcctgttttgctttatgatgttcctgtctcttaagctgaaaagagcccctgaaagccac

SEQ ID NO: 66818 - DNA, 601 bp, Human
tgagcagaatagctggtgtccagatgctcctagtgaacttttatcagtgagcagacgtggcctgggagggcaagccagactgtccagccggcttggagctggaagggaggagttcagtcttaggtcaagatactgtgctgagggaggtggagctgtagaggcagtgggcaaactgggggctccctgggagccctggaagcagcttccaccactttggatatttggcaattggaggtggaaggatgccagggaaggtgtttgggtttcttttctctgtgaagttatggcagtgccatcttcyaatcagccatcaagagagccacctttaagagtgcctcaagtgagccaaattaggggatcgccgggacagaaaagctgctgaggtgggatgagcactgtggatcatcttctgcccttctggaagtctttgtgggctggacatcccaaatgtgggcctgggaaaataacatttcccatacttcatgtgtgtatgtttcattttttacagtggtgcttttgataagcagtgtaacatcaaagccaagaactgtgctttccatttctggaaatatgaggagcccagaggcttctctttgagata

SEQ ID NO: 66819 - DNA, 601 bp, Human
tctgtgaagttatggcagtgccatcttctaatcagccatcaagagagccacctttaagagtgcctcaagtgagccaaattaggggatcgccgggacagaaaagctgctgaggtgggatgagcactgtggatcatcttctgcccttctggaagtctttgtgggctggacatcccaaatgtgggcctgggaaaataacatttcccatacttcatgtgtgtatgtttcattttttacagtggtgcttttgataagcagtgtaacatcaaagccaagaactgtgctttccatttctggaaatatsaggagcccagaggcttctctttgagataagagctgtgtgactgtgtgagctacttaatttctccaaacttcagtgtgcaccttctttgcagggctgtataaggattcattgagatgctaaccatgacacacttggctcacagtgggtacttagtccttgtcagctttcctgcccgtctgcaggggtggcagtggtgccagggggtggcgtgctgaactgcaagttcatctgggatctcctggttgtgtttggatttagctggggtgtgtcctctcctcctacaccttgagtcaccagcca

SEQ ID NO: 66820 - DNA, 601 bp, Human
ggaggatgtttctttccccattggcacagcatcaaggttctcaacagctggacacaaacaagctgttctgggagccgtgtctcattccccttcacctcctgcttgctgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccaytggggcagtgtttgggtgctgcttccactctggctcttgacaacagagtttgttccctttgaaacaagtttgtaggaaccagagtgtgtgaggggcctttggcagcgctgaaggaaaggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaa

SEQ ID NO: 66821 - DNA, 601 bp, Human
tgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagygctgaaggaaaggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagaca

SEQ ID NO: 66822 - DNA, 601 bp, Human
ctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaarggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagacatgttaggaagc

SEQ ID NO: 66823 - DNA, 601 bp, Human
ggccaacatcaaagccgggctttgtttatagataagggtaggtttcattctgtgggttccagagcccctgtccccaaatctcagagggggtgagttttaaacagaaactgtgtttatctcccgcagtgggctggaagacaggcctgctgggactcagaagcttccctccctcccatcctcccttccttcctttttccctttcttcttccctccctcccttcccagatagctagccactgccctcatttataacataacataaataatgctctctctgccccagctgtttccgtttggtttctgttcttcacatattttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagta

SEQ ID NO: 66824 - DNA, 601 bp, Human
tttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagtatagaaattcaacagttttaagggcatttgtgatatatgtgtatgtgttacttatgtgttcttcaggacacagatggggccaaaggacaaattttctgtgttttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactga

SEQ ID NO: 66825 - DNA, 601 bp, Human
tgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttggrcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgcccca

SEQ ID NO: 66826 - DNA, 601 bp, Human
cagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgamtctccagtgctagggacagggatctcaagatgagtaagacctggttcctgctcttaagatgctcatggtttagtggaggggacaaagtgggacacaggtgatgatggcattacaatgagaatgtagagaacctacaactgctgcacccctccctgttcttcaagatgccttctctggccatcagggcagcatgtgcagaggcccgctggtttggaatagtgtttctttccatgtgtgatgcagcgttccctcaaagccgaggcgaggtttatgcacactgcccaattgaaatgtgtctca

SEQ ID NO: 66827 - DNA, 601 bp, Human
acaccttttagttttcacctttgtcccaaactcttgagagaatggaattgcatgcttacttttcatctatatgacgttatacagctggtatgcccagagtgtatctcaacttaatctttttaaatgtgtctcccaaaatccctttctcaaggttctacatcctgcctccatgaaatttggtgtcaccaacattgtcttacagaaccactgttactatttttataaagagtttataaatatgttttgaaaagttctcatgtggctagatctcatcaagggattttttttcagacttgaaaartaaagttaaagaagtaaggctttggggcctccctggggacatgtctggtttggagatcagtggtggtgctaatggccccgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgt

SEQ ID NO: 66828 - DNA, 601 bp, Human
gtgctaatggccccgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgtgaaattgtccgcaggtacttacaagctggggtgtgcagatgcaatttataattgcaccggaaatasttgtaacctttatcatgcttagtggtggaaataagaaaatctatgtgagtcagcttagtactaacttgggaccaatatgaagcaactgaatcctcttaggttttgcaagagagctacaaatagaaagcagacacaaaacataggctagagtaacagtaaatgtatctggagcctcaaattaggactcatatattcaattccttattttttgttttctggttcaacaggaagtctgggagatctataggaatttgaattacctttaatggtttatggggaccagagaacctaaactttaga

SEQ ID NO: 66829 - DNA, 601 bp, Human
ttagaattgggattgtcctggaaaatctggaacacatattgacccagatccagacagtgggttatggaatatgatgcagatgatgagccaattaagagaaaggtttgcatttaagcatcttcctcttgtactggtgactgagtgactccaaggtggcaccattatcaccggtgcttgtgcagaggtgatttttttttttttttacactttgctgtctgaaatgctttaaatgattcttttaattaaaaaaattagttacctatataaatattcacttggtaaccccttcatttaaacagtmcatttatgccttatgcacttgtatgtgtgtgtgtgttgtgtttcacggtaacaaagttttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatcc

SEQ ID NO: 66830 - DNA, 601 bp, Human
gatccagacagtgggttatggaatatgatgcagatgatgagccaattaagagaaaggtttgcatttaagcatcttcctcttgtactggtgactgagtgactccaaggtggcaccattatcaccggtgcttgtgcagaggtgatttttttttttttttacactttgctgtctgaaatgctttaaatgattcttttaattaaaaaaattagttacctatataaatattcacttggtaaccccttcatttaaacagtccatttatgccttatgcacttgtatgtgtgtgtgtgttgtgtttcayggtaacaaagttttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccac

SEQ ID NO: 66831 - DNA, 601 bp, Human
tttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccaccaagcccggccrgtaacaaagtcttaaaagcggtcttattctgtaatacgttggccagttttaaaccatttgcagtaatgcatttaaaagatgttatttcatagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgg

SEQ ID NO: 66832 - DNA, 601 bp, Human
atagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacrcagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatcccca

SEQ ID NO: 66833 - DNA, 601 bp, Human
tggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccayacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcattctccttctcacccaaaccatgatctcagatcttaggagttacaggtcagacatgtcacggagcctgtttgagatcag

SEQ ID NO: 66834 - DNA, 601 bp, Human
agccagatcctgtgtgggatacttggcttttcaagggcctgtgtatggtgtgttgttgagtagaaatgtctgagatgctcctttagtagcacctgattcttttggatcagtgatttgccatttcttatatgaaaacgagaagttcagagttttgaattctggccccagttccatcactttcttgccctgtgaccctgttctcctcccaaaacctttctgagtcttcatcattaataatgtttaattggatcacatgaaatgatacaggtgaaagcatttagaaatggaaagcactgtgggrgaatatttttgttcataattgtatcataatgtggacatggagagttaacctttgtcagcgcttagtttctcagcctttttatctattaaatgggagtacaaatgataccttcattgggggttccctgagcatgcagtcggaaactatgacctcttctggaggaccatgacttttattttttgactctatagtgtaggaacatcttaattaaagattatggaaaaaaatgaaaaatgggtttataaaaaaatgcccagatccaatttcatgtatttgtaaactattgatcaacaacctgtg

SEQ ID NO: 66835 - DNA, 601 bp, Human
tccgctcactgcaagctccgcctcccaggttcacaccattctcctgcctcagcctcctgagtagctgggactacaggcacccaccaccatgcccggctaattttttgtatttttagtagagacagggtttcaccatgttggccaggatggtctcgatctcctgacccattatccgcccgcctcggcctcccgaagtgttgggattacaggcgtgagccaccggcagttgtgctgcaactgtagagaaactagaggtctaatttctcaaatactggtcctctgtgaattgaaatatagatcmtccctcacagatatagattcggtgactgaaataattattttgaaggaaccattgcatacgtgacatacttactgtcagataaagtctttggagggagatgggatagtgtgtggtgtccaccctgtcacttctgccagggcgagggctcacataatttattctaagcttcccatcctcagcttctgcgcaggagtacaatggaagatggggggtggaggccttgcctgtggagccttgactgggagaaggacaaagaaggcatgtagctggagaggtccagtgctttttccagggctggag

SEQ ID NO: 66836 - DNA, 601 bp, Human
agtagctgggactacaggcacccaccaccatgcccggctaattttttgtatttttagtagagacagggtttcaccatgttggccaggatggtctcgatctcctgacccattatccgcccgcctcggcctcccgaagtgttgggattacaggcgtgagccaccggcagttgtgctgcaactgtagagaaactagaggtctaatttctcaaatactggtcctctgtgaattgaaatatagatcctccctcacagatatagattcggtgactgaaataattattttgaaggaaccattgcataygtgacatacttactgtcagataaagtctttggagggagatgggatagtgtgtggtgtccaccctgtcacttctgccagggcgagggctcacataatttattctaagcttcccatcctcagcttctgcgcaggagtacaatggaagatggggggtggaggccttgcctgtggagccttgactgggagaaggacaaagaaggcatgtagctggagaggtccagtgctttttccagggctggaggctgggaggtgtcctcatgcactcctataagctaagcagaagccagagagctttcccta

SEQ ID NO: 66837 - DNA, 601 bp, Human
ggggctattcacttctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagcygttgtctgcagacttgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagata

SEQ ID NO: 66838 - DNA, 601 bp, Human
ctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagccgttgtctgcagacytgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagataagagactgttgtgt

SEQ ID NO: 66839 - DNA, 601 bp, Human
ccttctgtttccttctctctacttcgagcattcattacatgagatggtgctgttttttcatatatttgttatgagtaattttatctttcatctattagatgacatttttgattctgttcttaatttaaaacacacactcattttttaaagtttctaagtacgttttttatttgtatgtgatcatggttcatcagtataagaaaatatttagccagttctgtttcgtaaagtcttcaagaaagataatagcttgggtggactgcttcttcatgcactttattaatgtggcttcctgttaagwtctgaagccaggcagagatgtccacttttgctacttatatttaaaattgtactgcaggttcagaaatcaaaggcatccggattgggaagaaagaaagaaaactctctttattttcagatgaattgagcctgtactagaaaacctaaaggaacacatgcccaatcccgattcccccaaagtacgaaccgactaatgagttcagcaaccttacaggataaaagattagtatacaaaaatcaattgtatttttacatactagcaccaagcaatctgaaacccacattatgaacacaattctga

SEQ ID NO: 66840 - DNA, 601 bp, Human
ttgtgcccagcattttctgagttttcaaatagatgaagttatagaatcatattcatatcaaaggaagttcctgtgtataatctcatttcattctgtcaacaaccctaggcttggggtgggtgtgttggtgtggatgagaacacttagtatccctattttacaagtaggaaaagtaagacccagataagttaatgacttgctaaaaatgatacagctcttgagagacagcagacatttgaatcccatctactgattctaggtcctatggtcattcctttgctttatgttgcctgttttgcasactgtcaaacgcatcagacacttccagtggtttttcagtgggtttttgtcctagtgacagtccacacatcctgctctcctattatcacatttgcaggaggaagtgagacatcttttgacactggtgatatgggagaaggagaaaaatcctagaatcaaagatacttactccttgcttccctctactcatactctctggaaagaaacgtttagggacttcttgtgttgtgcctgttgtgccaggacagctcaaatggatgcttttgtcacagcccctccacctttagcagaagttgttgta

SEQ ID NO: 66841 - DNA, 601 bp, Human
gttttgtgaggatttttaaatatcggaaagaaaatttcctgcttcctctttccatctccttttctgtggttttagccccctcgcccttaagagccatcggtttgttattgctgattgaggtagtggtggtggaagcagaggctctgatccagagaaactccccaagacggaagtgcagcaggcaggatttttatccagcggattttgacccagtagaccctaaagaagctgcatgacagagactcatatttaccataccattgaattctcagagctttccgtggtggctggcccaaggcarttgttcaaaacatacgcgagagaatgaatgaacaaatgaccttgcctaccaaacgtctccctccctctgtgtaagcatcccttaaactctcccaacccaggtggccttgacatatcccatgctcacccaggaccctgaagtatgcctcggagcaactggtttctcctgaccagttagtgtcaactgagactaatgcagaaaacattgcttaccctaatgtttgcctttagaagtaaaatccaaactgaaggaaaggaccttgaatttgttttttattcttgctgacttggaacattgata

SEQ ID NO: 66842 - DNA, 601 bp, Human
ttactcttgtataattcttgagacaggaatacctgggtgttggcatcaaggggctgttgaggccatctttatttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagyccccgagccattgggaaatagaggagcttagccttgctaagaggagagaattcagagagccatgaggtgattgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacc

SEQ ID NO: 66843 - DNA, 601 bp, Human
ttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagcccccgagccattgggaaatagaggagcttagccttgctaagaggagagaattcagagagccatgaggtgatkgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgca

SEQ ID NO: 66844 - DNA, 601 bp, Human
gcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgcagagaccctcctttttagaagcaggcagggagtggtgcccaggctctcaggrcctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacacgcacatgcacatgcacatgcacattcacattgtaattcctatttaaagggaaaa

SEQ ID NO: 66845 - DNA, 601 bp, Human
ctggctgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacrcacacgcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttca

SEQ ID NO: 66846 - DNA, 601 bp, Human
tgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacaygcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttcagttcc

SEQ ID NO: 66847 - DNA, 601 bp, Human
cttctaactctccccagccctgtctaaatcttacccttcttcagagcccatctcaaattttgtttcttccatgaattctttcctatagagcttgtccttctcctgccccctctgccagctgagggctttcttctttccctgaattcccccagtgccctgagctgatcttagatctgccttgtttgccattaattgaggagtacatattccccccaaactccttgagggcagatgctctgccttattgtctttgtgtcttaaaaatcttgctcttgtatagtcaagaaattattgtttgaartggtttttaaaaatagggttctagaggtgtttttgttgttgttgttgtgttttttgtttgtttgttttaccaaaggaaaatattccacctggctgatatagtgagaccttatctctacaaacaattttaaaaattagccaagtgtggtgacgtgtgcctgtagtcccagctactcaggaggctgaggtgggaggattacttgagcctgggtggcagaggttgcaacaagccgagatcatcatgctgctgtactctagcctggtgacagagtgagacgctgtctcaaaaaaaaaaaaaaaa

SEQ ID NO: 66848 - DNA, 601 bp, Human
ttacttattgaaatatgccacttgtttttaaatagcatgtaagatgcagatatttgcacttttaattgatatgccaggcaggagatttactgctctcaacaggtattaagaggtaggaaagctgccccccggcaagtttcttagcactgtggaactgatcctagtgccatggtgagtaagtggcagacctcagattcacaccacgtctctgactcccaataaaccacactgtccccccacccccaaccctcatggtgattaaaatgattactatgtacacacaaaatatattaggttacargttttttgtttacaattctaagcttctaagctctgttcatttgtatcttcataatttgggggcctatgaaggattgtttatccctaaattgaaagcaagcaaactaacaaaaaatgagatcaaacattgtcagagacggttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacatt

SEQ ID NO: 66849 - DNA, 601 bp, Human
tcttagcactgtggaactgatcctagtgccatggtgagtaagtggcagacctcagattcacaccacgtctctgactcccaataaaccacactgtccccccacccccaaccctcatggtgattaaaatgattactatgtacacacaaaatatattaggttacaggttttttgtttacaattctaagcttctaagctctgttcatttgtatcttcataatttgggggcctatgaaggattgtttatccctaaattgaaagcaagcaaactaacaaaaaatgagatcaaacattgtcagagacrgttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacattcttggtaagaccttatttttctcctctttccattaagtttaaggtttccttctgcttcttgcactaatcattaataactatactgttgtcacagctcaaaactttcctattgacacttcagtcatttttaaagatctt

SEQ ID NO: 66850 - DNA, 601 bp, Human
aatagattttctggtgtttgatttacttagactattctttttaaatcatttgtcacataggatagacagtggctgtaacagatatccatggaaactttggacttgtgaacatctgacatgacctccttttaagggcagtgcaatctgacagacctgggctgaaatcccagtgctaccatttattagatttgtgttttgagtgagctccttaattggtctgaggctgtttcctcatctgtaaaatgaaaataatgacagcctctgttgacttttatgatagtggagagagatgtatgggaartgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtgaacctctgtgcccactctttttttttttttttcttaattttaagtttgtttgtagaggtgggatcttgctgtgttgcccaggctggtctcaaattc

SEQ ID NO: 66851 - DNA, 601 bp, Human
agtgagctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacaggtgtgaacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctc

SEQ ID NO: 66852 - DNA, 601 bp, Human
gtgagctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgagtgtgaacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctct

SEQ ID NO: 66853 - DNA, 601 bp, Human
agctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtgaacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtg

SEQ ID NO: 66854 - DNA, 601 bp, Human
ctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtsaacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgac

SEQ ID NO: 66855 - DNA, 601 bp, Human
ccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtgaccctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgacaa

SEQ ID NO: 66856 - DNA, 601 bp, Human
tacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtgaacctctgtgcccactctttttttttttttttcttaattttaagtttgtttgtagaggtgggatcttgctgtgttgcccaggctggtctcaaattcttggcctcaagctatcctcctgccytggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgacaatatatatcactttcatggggttcagagcttcttgttatagctcaggaagttacagagggagattgggagctaatgcaccaaaaccggcagtgagtatgtgtaatggggtcaaaccttgt

SEQ ID NO: 66857 - DNA, 601 bp, Human
tacaggtgtgagccaccgtgcccagcctaatctatgggattttgaagacaatactgtcacttaatgacttacaacacatcctcatgagacctaataacagaagttctgggttctgtgttaatacgggacttccttttgtgaaacttgtaatacactcaggagaaatgtgtgacaaataggattctactttttaggggcatttggagcactgtattgtccttgggtaataatgcttaatgtggacgatgctacatggcctccaagaatatccctaggcccttgatcctttaagggagaaaaycaacctttacttttcgattgtgtaattgtgatcagaatagcctctgagatataaattccaaatatatctgaattggttttctttaattaagaatacttttggattcaaatcatactggcagcaaattaaagacatgtttcatgtgtttactaaatgttaatgatgggattactttgaagataaattttaacattttaagtaaaacgttcatgtaaaacaaaagtttattatagattggttttaaaatgagcactgcttcagagtcaggatattcttagtaaacccacaagtgttgtggcc

SEQ ID NO: 66858 - DNA, 601 bp, Human
tttctgattctctaatattaaagtctctaagagagtttctctaagcccaggcagtacagttaaaaatattttcgttgtttgcttgttggttatagagtgataatattttgcaattaggaagcttggatgagaaaccacacacgtgacataaaatggtttctcaacagaaaatctgtgccgctcaaactggggaaacagacttataaattccttttgacaaaagacacgtcaccacacaagcaagttaggacagaactctgagcattgtttttcatagacttgggacaattcccaaatattyttttttctcaaaacaatatttttcattccaatttacttattaaaaaaaaaaactgggagccgggcatggtggcttacgcctataatcttagcactttgggaggcagaggccagtggatcacctgaggtcaggagtttgagaccagcctggctaacatagtgaaacaccgtctctactaaaaatacaaaaattagccgggtgtggtaatgcacgcctgtagtcccagctgctcgggaggctgagacaggagaattgcttgaacctgggaagtggaggctgcagtgagtcaagagcgtgaca

SEQ ID NO: 66859 - DNA, 601 bp, Human
caaacaaacaaaaaacaaagctctttttgaagatcacgagcttcagaaagaaatactgcatccactctgtccacatgtttctggcctgtccattcagttaacagttattatgtcccaggtgctaggctgtgtcctggggactgaggtaacagaaattacaggataaagctcctgccgtgtagtagtactttagggagtagtagagatgttggttgggaaagaagtgatgccagaatgtggcgggggttatcagagcaggttcagaacgtaaggagcacgaccagggaatcactaacttcgygtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcggtggttcacgcctgtaatccaagcactttgggaggccgaggcgg

SEQ ID NO: 66860 - DNA, 601 bp, Human
cagagcaggttcagaacgtaaggagcacgaccagggaatcactaacttcgtgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcckggcgcggtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaa

SEQ ID NO: 66861 - DNA, 601 bp, Human
aggttcagaacgtaaggagcacgaccagggaatcactaacttcgtgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcrgtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaaaaagac

SEQ ID NO: 66862 - DNA, 601 bp, Human
ttaatctaatggattgttattcacaaaagctaaatcttttcaaatctgcagggtttggttgtttattttgttttacttttcagtttgtgttttaaaaagtctagagaaaagaataaagttttaaaaccacatgaaataactccatgtatggaatatttcattgttgatgtcttgccagccataattgcatgcatctcatttatggcgctgaaaacttgttctttttaaaaatcagatgtttctgtggtcacttttttgttattaaaactggagccgggttaaataaccaaccattgaccaygaagcctaatattaaaggaataatcagcccatgttcctattagatcatttccgttttcttttactttataaattaccttgttgcttaaaaatgacattttgttggttgtgaagtcctcttatagctaaattattcaagttattttctttggagattcttttaacttgaatttatataaactgtaaagaatgtacattaaatattcagaaacttttctttatgccagtttcttattttcacccatcatgacttaaagcttttttttgttttagcattttaatgtttaaataaatgtaaata

SEQ ID NO: 66863 - DNA, 601 bp, Human
tttgttggttgtgaagtcctcttatagctaaattattcaagttattttctttggagattcttttaacttgaatttatataaactgtaaagaatgtacattaaatattcagaaacttttctttatgccagtttcttattttcacccatcatgacttaaagcttttttttgttttagcattttaatgtttaaataaatgtaaataatttagttacaaggtctttatggtagtgccgccattgtttttaagaagacaaattttaatccaaggttaaaaacttcacatttgcttatctctttttyctcttaagaactaagagtccagagattagagtaaaatcaccttttcctcatagttttttctttcaacgtgttagaaattcctgtttgaaaaggaaagccagttcctccccctttttatgtttgaggggatgatggtaaaatcacattattcagtcagtttccacatgtgatttgttgcctatattttttaatccagggattaaattgttgccaccaccagcatcaaatcattggggggcaggggtggggaaggtgcgagacagttggttatagacatccaaatatgacgacagaaaaatc

SEQ ID NO: 66864 - DNA, 601 bp, Human
gggattacaggcatgagccactgtgccgggcctagaatttttatatgaggaagtggtgtccttattttctccagttgcagctctctctgcagggaaagagacatttggaatgttgtggacttgagaactctgaatgctttcaaagcactatcgtgtgtgtgtgcgcacacgcacacacagtagctagaagtgttagtctagcacaggagttaattgagttaatgtgtagggaattcagtaataacaacagagcgtcctctttcatttcccagatccaaagctctgtgacatgcattaacartatacctccatgtagtttgtgtctcagtctgtgtacacgtgtgtgatggctaaatgggaactgcacagccagtggatttgtgaacttgagcacttgcacctggctaagggtttattaagtgtggaaaccgtactgttgttgtaaaacagttttcatctcaagaaccacctgccccttttagcggtggccttttgcacgtgtcttgcactagccaagacaagtctatccaagagggagcttgtggagtaggttggtgtttgaatctttcccagtactcccaaatgcacatagaattggtcg

SEQ ID NO: 66865 - DNA, 601 bp, Human
tcagtctgtgcacagcttaaacacctgcccaaaggatttttaaaggcttaaaatagattcactcatagcatttaaatagagggcatcttgcttgttggtttaaactgcttaagcggttgttgacttgtggaaccttctatccacacaagggtttgctggataatttcactctgagatatctttacaaagcaacattcagggcccgagccacataagtagtttgggctctgcctttttttttttagaagtcaaacttctgtgtggtgaatgagcttgcagataaagctgtgttgactgtatrtattccttctgtctgtagaaaatattgtgggtactgagaataaggccctgagttagcatgtctgacttccgtttgtccagttcattcttacctattctgcctataaacaagttgaggtgtttcttagaaaatttgtttttctcaattaaatgctgaatgttatgctctctgtcagtggtggattgaagtaggatactaaatctgaaattgatgaagatcacaagaattaaaaacagggaagattgagctaattttgaagtaagaagggctttaagctttccaggttcattctgttaggga

SEQ ID NO: 66866 - DNA, 601 bp, Human
ggcttcctctttgatttcttggagcttaagaagaggaaagattcatgggtatttctgcattccataagcatccaacacgactgtgagctccttgaaggcaggagccctgttgcattcttctttgcatccccagtgcctgccaacacagtgctttctctgtcttcctgcggcttccccctccctttctgcctgcccattcaaagaagacagtcactgcgtcccatgagccatgatgtcatatattcagatattttttctttcagggagagactcaagtcaacagtagcaatatcattaagtagcacattcttcatgcagggccagaggttgggaggatggagtagatgggagtaggatgtgggtcctgccttcacaaagctcacaatctgccaaggaaaaagcaaaaacaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaa

SEQ ID NO: 66867 - DNA, 601 bp, Human
atgggtatttctgcattccataagcatccaacacgactgtgagctccttgaaggcaggagccctgttgcattcttctttgcatccccagtgcctgccaacacagtgctttctctgtcttcctgcggcttccccctccctttctgcctgcccattcaaagaagacagtcactgcgtcccatgagccatgatgtcatatattcagatattttttctttcagggagagactcaagtcaacagtagcaatatcattaagtagcacattcttcatgcagggccagaggttgggaggatggagtagwtgggagtaggatgtgggtcctgccttcacaaagctcacaatctgccaaggaaaaagcaaaaacaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaaggaaatagcacccaacatgacaggaataaggatttttagagaca

SEQ ID NO: 66868 - DNA, 601 bp, Human
ttacctagatcattagaaatttattttattttattttagtttttagagacgggtcttgctctgttggccaggttgttcttgaactcctggcctcaagcagtcctcctgtcttggcctcccaaggtgctaggattataggcgtcagccactgtgcccagcctagaaatttaaaaggagaagaaaaaccaagcagctgtcctgaatctaagctcaactgaggaaggtgattttcttggtttgcttggtcatcatctccagtgggaaccctatatcataggccactgctttgtctgtcgtgacyagctggtatggggttacctctggctgcttctagttttgagataggtctgatgtggctagggcagtggggtcagtgagccagagcatggcaaccctaggaggaaacatctctgggcacctgtctcaggcccttcctgagtacatctatccatctaatcgttccgtctttgattaccattgtttggcttctagcctcatttctcttcctagaccataaactccttgagggcagagagtgtgtattattccagcgtgtttctcttctagagcctagcctaattccttttgtacagaaaatatt

SEQ ID NO: 66869 - DNA, 601 bp, Human
actgcaacctccgcctctcggattcaagcgattctcctgcctcagcctcccgagtagctgggattagaagcacatgccaccgtgtccagctaatttttttgtatttttagtagagatgggattttgccatgttggccaggctggtctcaaactcctgacctcaagtgatccacctggacctcccaaaagtgctgggattacaggcttgagccaccgttccctgcaaaagcccaactttctatagcctcccaccatctctaaactccgcaatagtgtttcatttagcttattccctgaattkcaatttcttcagtttgagttcattttaaaaatgttattccttctcatcatgcttttcatatttttattagattactgagtgcctagacatttagatactccttcagcatgttttctaagcagcaagtcatccctgagcatgccattttgacttaatgcttgcataacttacctttgtgtagctattgttgtagtagcttcagaagttgatagaattcttctggtgatagttgtttttacaacaagaactaaatactggacgtccagtgagggacatgctgtttaatgcaacacctccagc

SEQ ID NO: 66870 - DNA, 601 bp, Human
cctcaagtgatccacctggacctcccaaaagtgctgggattacaggcttgagccaccgttccctgcaaaagcccaactttctatagcctcccaccatctctaaactccgcaatagtgtttcatttagcttattccctgaatttcaatttcttcagtttgagttcattttaaaaatgttattccttctcatcatgcttttcatatttttattagattactgagtgcctagacatttagatactccttcagcatgttttctaagcagcaagtcatccctgagcatgccattttgacttaatgyttgcataacttacctttgtgtagctattgttgtagtagcttcagaagttgatagaattcttctggtgatagttgtttttacaacaagaactaaatactggacgtccagtgagggacatgctgtttaatgcaacacctccagcctattcatagacttaattatacagtctgtcacaaattttaagaattttggctatacttaccttctggcaaaaacctcattcctgctatttattcagtggagaatctatttcaaattaaaagatttgtgccctcttaatgttaagatagtgccctctta

SEQ ID NO: 66871 - DNA, 601 bp, Human
gcctgtaatcccagctactcaggaggctgaggcaggagaacagcttgaacccgggaggcggaggctgcagtgagccaaggtcgtgccattgctctccagcctgggcaacaggagtgaaactccatctcaaaaagagttgaaggaccattttagagccccagaaggtgccagagccttcccattttctgttactaatgcatacagcagccctctagagtaggaactgttatttccattttacaggtaaggaaatagaggtctagagaagttgagcaagtttcccaagttcacacagctcatwagtccagtttcctcagaagaatctaggcagtcatacctttgagtcaaaaaaccagaaatcggcagcattgcatcattaaagattcttcattataaactagcggtgtttagcacttcaaatgtgtggatttcacacttctctaaggccaaataattaataaatagagtgcttttagcaaaccttttcattaataagactttcttgggttaatgttaagattagctttttttggaccaggtctctatggctgtggcttggggaagtggcagggacatgggtatagggcatgaagaagcaatg

SEQ ID NO: 66872 - DNA, 601 bp, Human
ctgtagataagtaatggcagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatctttggaaaagaatgacagtggtctggggaactctatgaagagccacattctagaatagaggagccctatacaggagtgggctsttagctttaggtaccagactaaggagtttgtgttttgcttgtagtggatgagaacctgttggtataggaaggcaacataactagatgtggaggtgaaagaaaagacaaatgcctgcaagatgagtggcaggacatggtgggcgcctgagagcctgtgggtagcagtctatttaggtcacagttgggggcagcaagttcaggctccattaaatctcatctttttttcctttttttttttttttcgagacagagtctcactctgttgcccaggctggagtgcagcggcgcgatcttggctca

SEQ ID NO: 66873 - DNA, 601 bp, Human
cagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatctttggaaaagaatgacagtggtctggggaactctatgaagagccacattctagaatagaggagccctatacaggagtgggctcttagctttaggtaccakactaaggagtttgtgttttgcttgtagtggatgagaacctgttggtataggaaggcaacataactagatgtggaggtgaaagaaaagacaaatgcctgcaagatgagtggcaggacatggtgggcgcctgagagcctgtgggtagcagtctatttaggtcacagttgggggcagcaagttcaggctccattaaatctcatctttttttcctttttttttttttttcgagacagagtctcactctgttgcccaggctggagtgcagcggcgcgatcttggctcactgcaacctccgccccc

SEQ ID NO: 66874 - DNA, 601 bp, Human
tcaaactcctgacctcaagtgacccacccgccttggcctcccaaagtgctgggattacaggcatgagccaccatgcctggcctccattaaatctcatctacactttaagtgtatgggataccaagatgtgaaagacatggactgtaccttgaagaggcttgtagtctgttacacagggaactcagcagagtctgattgtgggcggttccctgacacatgaagtaaagaactatgagaccaggacagaatggtgaagctcatgctgcttgcctagttaagagtcaagccatcattcccctcrtatactaagtgacttgtttttaattcatagtactttttgtttcactttataatattgtggtctttcccagttgctggtctggtgaagtgggctctgggcacctggctgtctggcttacccctcttcatacactccatgtctagcacatgtttcaggcacgtttcaggtgaggtttcttggaggggacatctgagctggacctggaaagattttccttggtggtcttaagggttattgcagctataataccttagcatggcagggtgggttcagggaactggaagcttggtaggtattttg

SEQ ID NO: 66875 - DNA, 601 bp, Human
aactggaagcttggtaggtattttgatggtggtaaaatgaattgtggtggtggtcgtggtggtggtgtgtcatgaaaaatagttaggggccagatggtggggacaacactgaacaccatactaaagcagtttattcctttagatgtgggcagtaggagccttggaaggtcttataactgagaactgtgttttaggtagctgtgtagaggatggattagaaagaaaaatgatcagaggcatagttacagtggtaaggctagtcaaactactcattagaggattaagaaagtgattatgtggygtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacagtgttctatggagttgtcacatgataatgttatcagctgccgttgactgatacaaactcctgagaaggtgggacttg

SEQ ID NO: 66876 - DNA, 601 bp, Human
gattagaaagaaaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgygggagaacacagtgttctatggagttgtcacatgataatgttatcagctgccgttgactgatacaaactcctgagaaggtgggacttgagttatcgccagacactcactcgcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaa

SEQ ID NO: 66877 - DNA, 601 bp, Human
aaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacrgtgttctatggagttgtcacatgataatgttatcagctgccgttgactgatacaaactcctgagaaggtgggacttgagttatcgccagacactcactcgcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaagtagtaccagc

SEQ ID NO: 66878 - DNA, 601 bp, Human
gctgtgctgtgtgctgtgaccgagaggcgtaggttcctgtgagagcacatgttagggtgatctgaccagttctcatgggttggagttcttccaaacaagacataagcacctccaaggcagagatggcgtgttttctttttctttctttttttagacagggtctcactctgttgtccaggctggagtacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgtttaatccacacacagtccatgtgtgaccagtggatgactggccagcttccgtaggcctcctttcttttccactattgctgggacaagttgctatggcatccgtgtagaagaaatggt

SEQ ID NO: 66879 - DNA, 601 bp, Human
tacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgttyaatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtgtccacagatacatacctcctagatcttcaggaagatggatggggagataaaacacccccattctgtagacctctcccaagacagtgacatgtggtttcctcagtgtccccttcatctatactttt

SEQ ID NO: 66880 - DNA, 601 bp, Human
acagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgtttmatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtgtccacagatacatacctcctagatcttcaggaagatggatggggagataaaacacccccattctgtagacctctcccaagacagtgacatgtggtttcctcagtgtccccttcatctatacttttt

SEQ ID NO: 66881 - DNA, 601 bp, Human
ctcctgggctcaagttatcctcctgcctcagcctcccaaagtgcttggattacaggcgtgagccactgcacccagcttgagatggcatctttttacccccataattttagcatgtttcttgtgtttaatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtrtccacagatacatacctcctagatcttcaggaagatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactgtcctgcctcagccccccgagta

SEQ ID NO: 66882 - DNA, 601 bp, Human
ctttactgcttcctctggcagtgtccacagatacatacctcctagatcttcaggaagatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactstcctgcctcagccccccgagtagctgggattacaggcatgtgccaccacgcccagcttatttttgtatttttagtagagatggggtttcaccatattggccaggatggtcttgatctcctgactgcgtgatccacctgccttggcctcccaaagtgctgggattacaggcatgagccattgcgcctgaccaggttgttggctttcatatcctaaaattttttttccttttgatgaaccccagctgatgaaaacagacttcatgggctaagcacagtagttcacgcctgtaatcccagcat

SEQ ID NO: 66883 - DNA, 601 bp, Human
aggactttatgacttggttgcaatcatgacatgtgctgaaatgatatcacataaggcagaaaaaaatacaagttaccagcaaagaagcccaggtcaaaggctgtgaatgtttagggaaaggggaggcctccaccagctggtaggttcatgaaggatgaggccttgggaaggtaggcagattccagacatgcagaaatgggcaaggacagtacaggccatgacagcagttgtgcacccaggtacaaagttcaaggtgttcacaggaaacattcgataatctagtagtactactgggctgagyggggtggggggatatgtagaagacccttgtttgatgtagctttggtctagcagtcaagggaaatgagttttctttctgattttccttgttttaatatggaagaacggggtggagaatcctcacacatccttcccagtgaagggaaagggccagcagatgtttccttagagaagccaagctagagcttcctaggcccagggcagtccagtccttcatgggtgtgagtttgccttaggactggccacggccagggaagagaagcattgcatttgttgcttctttcttggtggctccctgact

SEQ ID NO: 66884 - DNA, 601 bp, Human
gacattttgatgttcgtcttcatcagtgtttccagttctttactctgctagggaagatctgggggatatggtcacttcctttcagcagaggctgtgttatttcctcattcattcttttctctgtgcccagcagtgtgctaggtgctagggggacattgaggaagaagacaaagttcttcccctcttcaagtatgcagtatatctgggaggaagtaagacaacaaacacaaattttacaactaactataaagttataaatacagttacagtttgggtacatcctaggaagaagtacagtttktgccaccatgggggtgtagaacaaggcaaccaaacctagttgggcaattagagaagacttccccaagggagtgacatccaagtgaggccttgaaggagaaatagaatctagcacaatggtctcaggctggtgaagcacatgagtgaatgccacagcagcaagcttcagacttgttcttgaccaaaggaatttttcacaaggatagagctgagctgatacaaagccagccaacagtagtgctatgaaatggtggttttccatttactgtagaaagtatgtagaaataatttcagttcctgg

SEQ ID NO: 66885 - DNA, 601 bp, Human
tgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgarccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttg

SEQ ID NO: 66886 - DNA, 601 bp, Human
aaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagargtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaa

SEQ ID NO: 66887 - DNA, 601 bp, Human
aaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaat

SEQ ID NO: 66888 - DNA, 601 bp, Human
actgaaagccctataagtgaggaataaagctcttctgttcagaagggattcccatgtgatataggaagcactctttttctcacttggtgaattttagagttttcttccatagaaacaatttttctgttgctttatacatgtacatatgtaaaaatacacagcggtatttatgtttgtttctaaaaaaaaattaacaataataaaaaagaaacattcccctgactttcagccctgggccactctcttttggggcaggcacaaggaagagacagaaacagaagcagtaggatagcaactggcycagcatttaagctccaagaaccacctccgtcttcttgtagtttcttccgttctttcctaccatattgttcttggaaaaatggagtcctttgtttttccatctgctaataccaactgagtgttccaggcatggtgcttgctcactgtgatgggcagttaacagccaatatcctgttcagggagctggccatgtaaatgggaatgtaaactagaggagcactttgggtaatagcgggagcagccaaaatgaaatgtggggtgcatcccggggatgagcttcgtggagagtatactgttaagt

SEQ ID NO: 66889 - DNA, 601 bp, Human
cagttatagctacttgggaggctggggcaggagggttgcttgaacttgggaggtggaggttgcagtgagccgagattgtactgctgtaccccagcctgggcaacagagcgagactctgtctccaaaaaaaagaaaaagaaaaaatgtctaggacagaagctagagtacaaactgcaggcctagaagagagcttagctttgaaggagttgtttcttagtgatgggagtgctatgtgtttgtctcctactcagacaaaacccttttgacccactgctctcaagggggtaggttttatagatgrcccacagcctgtagctgggcctgagtctacttctaaagtagaagatgaatccatgcagttgcagtgtgaaagaggcttctaggcctatggaatatccatttaaaaatcctgaggatgctgagttagaggtctcccttggaccttgtgtcaccagctgcagcgacagcagtgtcaccaacaccagctttacctgttgtcttccatctcaccctttcccttagtttagcccctattggcgtctccagtggagtagtgagaagcagcagcatgtctgaggattagctcacagccttagaaatt

SEQ ID NO: 66890 - DNA, 601 bp, Human
ttcatgaaaaagtcattaactgtttttttaagctccagggatttattatcccagcatgtagaaagaatgcagaagcattctccatgtgttaagcagtctttttcctactcagagtttctttgtagagttccatgcaggagtctctttgcctgtatgttcagttgccctaagaagttgttcagaccctgctcagagtccttctttccccattagcagcaaaaaggcagtcctttcttgctgttttcagaagctcacggtagccacagccaaggtctgggaagcaccaccacactgtgggccrtctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggc

SEQ ID NO: 66891 - DNA, 601 bp, Human
agtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgcyccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatatagtctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccactt

SEQ ID NO: 66892 - DNA, 601 bp, Human
tcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgccccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatatartctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatct

SEQ ID NO: 66893 - DNA, 601 bp, Human
ggaaggtagacgtacttcacttcactctgtgttgccccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatatagtctttcctggcatttcccaatcttcagggggagttcttttgcatttatgacatatacgctttctcctcaaagatatttttattaccttgtttttaatttaactgaacgaaaactaagatkggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcaaaatcccattgttaattggcctccaacttagataatgccctagaatgacatctatccgaaaggttatctagtgaggacaagggctcctgagtatttcaggtcccgagcag

SEQ ID NO: 66894 - DNA, 601 bp, Human
gcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcraaatcccattgttaattggcctccaacttagataatgccctagaatgacatctatccgaaaggttatctagtgaggacaagggctcctgagtatttcaggtcccgagcagaatccagcttggaaagccagtccattacctgggccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaag

SEQ ID NO: 66895 - DNA, 601 bp, Human
cttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcaaaatcccattgttaattggcctccaacttagataatgccctagaatgacatctatccgaaaggttatctagtgaggacaagggctcctgagtatttcaggtcccgagcagaatccagcttggaaagccagtccattacctggsccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaagttaatccagggatatctggtgccacaagccaagctctttgcaggatgttcttctgccttcccaaagagtactggtccaggatgaggttcattttcctgacttggaatgctttgcattgtctccctccactgagccctcttcat

SEQ ID NO: 66896 - DNA, 601 bp, Human
ttggaatcctatctttaaattctgaaatcatggcccatgaataaactgtttggaatatattgattatgctgttcattaaaattccatatatggcagctatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccarccatgtgcatttgtgatattgctgtcctcctgtcatgtatattacatgtagatattttccaaacattgtgtccatttcaaccataaaaaggaggcaatcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggt

SEQ ID NO: 66897 - DNA, 601 bp, Human
tatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccagccatgtgcatttgtgatattgctgtcctcctgtcatgtatattacatgtagatattttccaaacattgtgtccatttcaaccataaaaaggaggcartcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggtagatgatgagacaggcatcccgagtctcaggtcagttggaccgtttgttcttagaacccatcctctttcccatcaaaagtccatagaccacccatag

SEQ ID NO: 66898 - DNA, 601 bp, Human
gaagaaattaatggaagtgttaggctccgttttctttttcccccctcccctccctttccttttttcctcccttcctccttccccttttctccctcccaccctccctttcttccttccttttctccttcattctttttttttctgatggagtcttgctctactgcccaggcttgagtgcagtggcttgatgaacacagctcattgcagccttgacctcccaggttcaaacagtcctcccacctcaggctcttgagtagctggaaccacagaagtacaccaccacacctggctaatttttttktgtgtgtgtgtgtgtgtggagacagggtctctctatgtaacccaggctggtcttgaactcctgggcccaagtaatcctcccacctcagcctcacaaagtgctgggattataggtgtgagcagccacacctggtcttcccctttccctttttctttattggctctttttcaaaggttaatgtaagctttttggaaattcacattgtcttcctgacagttatagggcaaagtagtatctacaccctgggaacacctagcacatctttcttagaagcccttagcagttgttcatgagctttga

SEQ ID NO: 66899 - DNA, 601 bp, Human
ttgaagtaaactcgtaattctgaggcctttgcattttgccttccagttctggccgggaatgattcaaacagggcagccaggatcctcacaagagtaagtctgaggaggggtgggcactgacaactacgggctggtcccagcccacgtggggagagctcttcctggaccatagtgtctcagggcctggaggagaaaggagcattacactgaggtcccagaaggcatcccctttttattgtgtacttaggcccctggcaggaaagagactggcttttcggatctgggagaggtggaagcaccycattcccaccttaagtattagcagtcatccagctggaagcaagaagtggacccctcttccttcatggtattgaaggctgagctgtggtcctccttgcctgagaaagggcggcacaggtgatcctctagcccatttcattctagccagccctgtagtagggtggctagtagacaaatcctactgatgccttgggggcaagagaagaaagatcagtaaactggaaataagggctatttcgggataaaagaaaggaaatcttgcctatatgctgtaaaaaaaaacttgcattgtttggcctag

SEQ ID NO: 66900 - DNA, 601 bp, Human
agaagtggtgactgcttgacctcagaggttcaaaggcagatgccacagcacaaggaattcaggctgtctttccagcacatcccattgaactggaatgaggcttggtggtttgatccctacctggctgctggtccctctcagtttatggaacaactgcctctgcctggggtgtgctaccacctgcaggcagggaccacagcggtgaaggacctcccactgggaggtcatggtggggcctgggtaatagcccctgctgcagatgcgatctcttaactctgtctgccatctctctgttcccagygtcaagccttttgtgcagcaggcctaccccatccagccagcggtcacagcccccattccaggtgagtgtccctgaaactcctttttgggagcacagccccacacagctgacagctgggtctggcactttgttcccagagtcaagagatgctcaactttgccacagccgcacattgcccctgacttgcaggatccttgggtagcctgtagctcaggagggccacagggtcccgattcccatcagtcatctcccaagagcttttcagatggtttgtttaagaaacaggaagcctcctcactt

SEQ ID NO: 66901 - DNA, 601 bp, Human
gaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcatacygcagcccttaaccttagctgaagttggcttaatgaggaacacatgctttgtgcttatttgactgtttaccatcactggggccctctgccagcatctgtcgtctgagttatcctggccagagccggtggagagggggctgttggcatttccttctgggtcatctgtagagccctgttccagtatttgcctgaggcccaaggggaggtgagtgaccagcatcaaaggtgacgattgctctttcagggtttgagcctgcatcggccccagctccctcagtccctgcctggcaaggtcgctcca

SEQ ID NO: 66902 - DNA, 601 bp, Human
agccggtggagagggggctgttggcatttccttctgggtcatctgtagagccctgttccagtatttgcctgaggcccaaggggaggtgagtgaccagcatcaaaggtgacgattgctctttcagggtttgagcctgcatcggccccagctccctcagtccctgcctggcaaggtcgctccattggcacaaccaagcttcgcctggtggaattttcagcttttctcgagcagcagcgagacccagactcggtgagtgtgcccagagaggtgtgtcttgaatccaggatttctttccctttaytgtttacctccttgcttctctttctttcctcctttaccccgccccatgcctgacaaatatcctgtgtgaaaacgggcctaggaaagaatagccttttgattaagtaaaaagggattcctattggcagatttgtagaaaacagcagagcaggaggtgtattactgtcctggaccccaaggtgctgtggggaatacttgagtcagagagagggacgtttacaagctcttatgttttgtaaaatttaacaagaagtaacatttattgagccttgccatatgcctggtcccatgcagagttatt

SEQ ID NO: 66903 - DNA, 601 bp, Human
tagatatatgatcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggycgaggcgggcggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccatctcaaaaaaaaaaaaaatgaagaagtaacaaaatggcactttagcagtttgccatagagtgcagtgcattataatatcataaatacca

SEQ ID NO: 66904 - DNA, 601 bp, Human
atcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggtcgaggcgggyggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccatctcaaaaaaaaaaaaaatgaagaagtaacaaaatggcactttagcagtttgccatagagtgcagtgcattataatatcataaataccagtaacattgg

SEQ ID NO: 66905 - DNA, 601 bp, Human
aagaacaacttcttaagaagaagtggccaggcatggtggctcacgcctgtaatcccagcactttgggaggtcgaggcgggcggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccatctcaaaaaaaaaaaaaawgaagaagtaacaaaatggcactttagcagtttgccatagagtgcagtgcattataatatcataaataccagtaacattggcatctggactctatttgtcactttcttctttcctacctcccccacccccatcttgtacccatcgtcccattgtttctcagccaggcatttcccatacatatgtgatcctcccttctttcccacccaacaagccccgtaccctttcttcacacccactccttggctgtgagtatgagcgttgcatctgtgtgtgggtgagcccaaggcaaaaactgaagga

SEQ ID NO: 66906 - DNA, 601 bp, Human
ggggcagaggggcttgaccagtcatcaccagagtggagaacccacatgtggcccactcatgtctttgtccacaaatcatgaactttgggagctggtggaaaaatagagctgcttccaaattagggggaaaaatgagggaaggaatgtaaattgggcccatcaggacaggtacaagaaaatggggctattcagaccaggaaagagaagaaaaggccaactggatgactccttccaagcagctgagtggctaacaggaagagtgatggtgagggttaaatccgtctaggtggaaggcattaakacaaactgaaagatgccctgcgtgactctgtcctgctggttctttctgggaagcatacatagttctttggttgaaggctgggctttggcccagatgctgcttctgcctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaaatgacttaagattaaacagaaggaaac

SEQ ID NO: 66907 - DNA, 601 bp, Human
cctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaaatgacttaagattaaacagaaggaaacaggagcccaaatcttgtatttcattgtatccttttcactatcgtaaaagatcacctcccagttttgagggtctcttgaattgtcttttttttttttttttttgagrcagcgtctcgctctgttgcccaggctggagtgcagtggtgtgatctccactcactgcaagctctgcctcccgggttcacgccattctcctgcctcagcctcccgagtagctgggactacaggcgcccgccactacgcctggctaattttttttgtatttttagtagagacggggtttcaccgtgttagccagggtggtctcgatctcctgaccttgtgatctgcccgcctaggcctcccgaagtgctgggattacaggcgtgaggcaccgcacccgggcttgaattgtcttttcagtctg

SEQ ID NO: 66908 - DNA, 601 bp, Human
ttcagttgaacacaaatgatttaatatatgcaaatgaatgtggaagtttttttgtttttttttttttggtttttttttttttggagacacagagtcttgctctgtcactcaggctggagtgcggtggcgcgatcttggctcactgcaagctccgcctcccaggttcactccattctcctgcctcagcctcccaagtagctgggactacaggcatccaccaccacgcccggctaattttttgtatttttagtgagacagggtttcaccgtgttagccaagatggtctcgatctcctgacctmgtgatctgcccgcctcggcctcccaaagtgctgggattacaggcgtgaaccaccgtgcccggccgcagattgttaataggatctatatttgattttagtggacatgtgagggcctgaaggttggttcttgtgctagagggaaaaagtggtggctgaccagttgaagtgatggagaattaataaaattatttaaagcatttgacagtatcttaagtaccagcctctcaagttatatactgtgtgctttattggacaaacacaacgtgctattacaatcaaggtataatggtacttcagggc

SEQ ID NO: 66909 - DNA, 601 bp, Human
gccactgaaagcgtctggaaatccgggttctatagacatttcacagaggccccagtcaggccccctctgctttctttggcaggtccgcaccccacgcaccttcctggttgctcactcagtcggtgggcctttcagctgcacttctgtggggaagacacactcctgtctgaggaagcagcagcccctctgtagagatggtgctgggagtgggaggtgggaaggatgcatctcggtgtgagatcccggaaggaggcattcacttgctccttgtttccaatgatgtttctctctgggaagaacraggggcatgggatgaagtggcatatcagggccaagtggccagaacagggctggtgccctggacagtgagctgaggagagaacccacttcagattcactttctcctgggcaggaaccgtgagcacaggcaagctcctgggctgaatgtgcgggaacctgtcttggcttggctccgcagccattccctgtccccccaggggccaccgcaggctgcccagcctgccctggggggtaggtggacagacattccaggcaggaccgtgacaagaagtaaatgtaggtgatttgtccttgttctgtt

SEQ ID NO: 66910 - DNA, 601 bp, Human
cttgcagccttttcagccatttctttgtattaatatatttacctccacatttctaaataacatgcttatattgtgtatctcattctattaattttaggcatcatctgttgacttcttaacatagaagactacgatttagttctctaaatttagtatatgcccccctccgtcttcctttcagtccccctatgtgcttttctctaaatttagtatatgcccccctccgtcttcctttcagtccccctatgtgcttatatcacattaaaaaaaattagcattcagttaattttacaaacccatrtaaattttgcacacagcgtggttaatgttatatattggaaccatttccttaattgtaaaacgtttttttctggggtgtatggttgtcttcttaaaaaattgttcagttttacatagctacaccaattcatcctcaaagtttcgaggagaactcatactcttctccagatggtgagatataaatcaggtccgctctcttggtgacatccttccaggagtcctcagctccacggatccactctggactggttgctgacctggctggtttctttacctttcttctatgttaggccccatctct

SEQ ID NO: 66911 - DNA, 601 bp, Human
tcactaattctaatttaacttcatagaagttttaaaacgctgtttagtttttttgctgttgttcctttcccaaatcaactttcaaaaaacgttggtttaacggtgttagaaaggcttagacattttcttttgggggacagtgtgattaatgtttgcagcaaacgcaagggctgtggtgttgacagatccaagttttattaactccaggactattcctggatgtgtgacctcaggcaagtcagttcatctctaagcttctatttcctcatctgtaaaatgatttaaattaaatccacctccmgcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaa

SEQ ID NO: 66912 - DNA, 601 bp, Human
attaaatccacctccagcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatstcacatgataataaactataacaatggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatcca

SEQ ID NO: 66913 - DNA, 601 bp, Human
atgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaactataacartggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatccaccctcctcagcctcccaagtgctg

SEQ ID NO: 66914 - DNA, 601 bp, Human
cacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaactataacaatggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatccaccctcctcagcctcccaagtgctgggattacaggtgtgagccaccaatcctggcccctatca

SEQ ID NO: 66915 - DNA, 601 bp, Human
gtgaagtgaatgccatcactgtccccattttagagacttgagaggcacttgcgcagtatcatagctagtttgccttgggcagtgttttgtgcttgagtaggatgagtctagacccacacaatctttttttttttaaagcaggtcccagtgattaagttccatggactgtacattcttaacccatgtataatactcagctttgcccaagccttctgttagttgggacttcctgtggaatagattagtactcagggacagtagttggagaattgccagttttaacttggaatgtgagcagacytggactgctagataaagaaggcggatggagtttctcagtgaaccctatttggttctgaggcccatggagcctctgcatccccaggtttcttggtctgtgtcacattaagttggtattaatgcctattcagtgggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatga

SEQ ID NO: 66916 - DNA, 601 bp, Human
ataatactcagctttgcccaagccttctgttagttgggacttcctgtggaatagattagtactcagggacagtagttggagaattgccagttttaacttggaatgtgagcagacttggactgctagataaagaaggcggatggagtttctcagtgaaccctatttggttctgaggcccatggagcctctgcatccccaggtttcttggtctgtgtcacattaagttggtattaatgcctattcagtgggagaggcatgcccgaagagtctggagtataacgtctagaccagtggtctcaamtttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaatgtggtttagagttttttgtttgttttttcatgaatgagtgacctgtgttctttt

SEQ ID NO: 66917 - DNA, 601 bp, Human
gggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaaygtggtttagagttttttgtttgttttttcatgaatgagtgacctgtgttctttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatga

SEQ ID NO: 66918 - DNA, 601 bp, Human
tccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagtyccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagc

SEQ ID NO: 66919 - DNA, 601 bp, Human
ttttgtaagcatcagagaggaaacagaattgctttgcccagtgtatacttcatttgtgctttaaaatgacgggcaaagtcccctggctgctgcagctttgctgatgttccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaartgtttgtgccccttagcatggcattaaaggccctaagcgacctggttccagggtagcttcctcttgtgtcctgccaaacccctgttgccccacctgtccagtctatgctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggt

SEQ ID NO: 66920 - DNA, 601 bp, Human
tccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaagtgtttgtgccccttagcatggcattaaaggccctaagcgacctggttccagggtagcttcctcttgtgtcctgccaaacccctgttgccccacctgtccagtctatkctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggtgtcccccttcctctgggctctgcctcagggggccttattcatatagtggcttccttttttattgaatgcttgctttgtgctaggagctgtgctgaatgctttacgtg

SEQ ID NO: 66921 - DNA, 601 bp, Human
agatcagttatatggtaacagggtagctttcaaaatgtggcctgcgaacccctagggagttccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagtctatcacatcaaggaaaacaaatgacattatttgttgccaaagataaaatttgggctttcaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaagga

SEQ ID NO: 66922 - DNA, 601 bp, Human
gatcagttatatggtaacagggtagctttcaaaatgtggcctgcgaacccctagggagttccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagtytatcacatcaaggaaaacaaatgacattatttgttgccaaagataaaatttgggctttcaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaa

SEQ ID NO: 66923 - DNA, 601 bp, Human
tccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagtctatcacatcaaggaaaacaaatgacattatttgttgccaaagataaaatttgggctttyaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaaaatgaccactgttatctgaggagtctgtcacataatgtaaagcagcactacctgtctca

SEQ ID NO: 66924 - DNA, 601 bp, Human
gtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagtctatcacatcaaggaaaacaaatgacattatttgttgccaaagataaaatttgggctttcaaatgaaaattagaatactgggaaatttgwgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaaaatgaccactgttatctgaggagtctgtcacataatgtaaagcagcactacctgtctcactaattttttaaaaatacaggcatgtttaa

SEQ ID NO: 66925 - DNA, 601 bp, Human
taacattttaagatactgctaaacttcttttttatgtggttgtaccattttacattctcaccagtaagatcttaggggttcttctccttcagccattatgtctgcaagtattggggtacagattacaggggacatcttagatgaggggctggtaagcaaaggcactgagacagggtgtgtgtaacgtatgcttcaggtgcattgaggtgtgttgcagctgaatcttcactggtaatggaaagataggtgagtagaaaaatttggaaagagaaggaatccagaatttagttgtgacagcagyagggagcagtcggtgttttaacaatttttcagtcaacagagtaatgggattctttttactgagtgttacagagactctgcattttgccttttctagttttattatattttccttttcatgacagcctcttactcatttcctttctatttcttttgccctctttttatttactcctatgtgttttaattctacagcgtatttaattacaaagagagaaaaggtgattttgcaggaatggaagggaagggaagaggttcctctctttttcagcagtacctgaacctgacgcttaactggtac

SEQ ID NO: 66926 - DNA, 601 bp, Human
tgaatcttcactggtaatggaaagataggtgagtagaaaaatttggaaagagaaggaatccagaatttagttgtgacagcagtagggagcagtcggtgttttaacaatttttcagtcaacagagtaatgggattctttttactgagtgttacagagactctgcattttgccttttctagttttattatattttccttttcatgacagcctcttactcatttcctttctatttcttttgccctctttttatttactcctatgtgttttaattctacagcgtatttaattacaaagagagaaraggtgattttgcaggaatggaagggaagggaagaggttcctctctttttcagcagtacctgaacctgacgcttaactggtaccttctttaagccaggcactgtgccagggctaagcacatacttgatattatttaatccttgtgagatacatgtgatgagtcccacttcacacatgaagaaatcaaaccatacaaaggcaaagtgacttctgtgacatcatattgctagtaaatgccacatctgctagactccagaatccatactctttgtgtaaacctgtgcatggcctcttcagggag

SEQ ID NO: 66927 - DNA, 601 bp, Human
ttttaattctacagcgtatttaattacaaagagagaaaaggtgattttgcaggaatggaagggaagggaagaggttcctctctttttcagcagtacctgaacctgacgcttaactggtaccttctttaagccaggcactgtgccagggctaagcacatacttgatattatttaatccttgtgagatacatgtgatgagtcccacttcacacatgaagaaatcaaaccatacaaaggcaaagtgacttctgtgacatcatattgctagtaaatgccacatctgctagactccagaatccatrctctttgtgtaaacctgtgcatggcctcttcagggagcacggttctgtcactagaaaccatcccaacatagcttcacttaaatggaagctaatggtgattgctgaaggatagcagccttggtagtttctctttgaagtcctgtcattatgagatgctctggtgtgtttacatgggagctaaggtgtattttcatatatatgttctgtatattattatgttctgattttttttaaaaagcctttcttgctgggaaaagactggcctttctgggtctagccaattcttagagtaggaaaatg

SEQ ID NO: 66928 - DNA, 601 bp, Human
gagtcccacttcacacatgaagaaatcaaaccatacaaaggcaaagtgacttctgtgacatcatattgctagtaaatgccacatctgctagactccagaatccatactctttgtgtaaacctgtgcatggcctcttcagggagcacggttctgtcactagaaaccatcccaacatagcttcacttaaatggaagctaatggtgattgctgaaggatagcagccttggtagtttctctttgaagtcctgtcattatgagatgctctggtgtgtttacatgggagctaaggtgtattttcatrtatatgttctgtatattattatgttctgattttttttaaaaagcctttcttgctgggaaaagactggcctttctgggtctagccaattcttagagtaggaaaatgattctgtctaacagaggatagtccaggagcctgcttttcatatgcaaaccaaccagtccagaaccagacctcctctatgtggtccaggcaccccaggatacagtgttcctctgccctaatcattccctggaatggtaccagacaactagggaccacctctgaagcttagagccagctggagttattcgaactagt

SEQ ID NO: 66929 - DNA, 601 bp, Human
ttatttaaaattgttttgtattttaaaattcttgggattatgatcattcagtgtaaacaatactgtctacatagttacttaatttgctttttttttttttttttgagatggagtctcgctctgtctcacaggctggagtgcagtggcacagtctcggctcactgcaacctctgcctgtcgggttcaagcgattctcctgcctcagcctcccgagtagctgggattacaggcacctgccactgtgcccagctaatttttgtatttttggtagagatggggtttcgccatgttggccaggctkgtcttgaactcctgacctcaggtgatccacccgccttggcctcccaaagtgctgggattacaggcgtgagccaccatgcctggccaatttactttcttaacctattatttttaaaggaagaaaaagcaagcctacttttactaaccatagcagatgtgagaagattttataaaacaaaaaaaggggaagcaagttacctggaaagaggacagccattagaagatgcttttgtcttggtagaaatgaaatcacatttgttcaacaaaatgacagtcactctacataaaactgggttttatt

SEQ ID NO: 66930 - DNA, 601 bp, Human
actttcttaacctattatttttaaaggaagaaaaagcaagcctacttttactaaccatagcagatgtgagaagattttataaaacaaaaaaaggggaagcaagttacctggaaagaggacagccattagaagatgcttttgtcttggtagaaatgaaatcacatttgttcaacaaaatgacagtcactctacataaaactgggttttatttaaagagaagaaactgggcgcacaataacccagcagaacagaccccacccccattggagtctcagcttgtttctaattgtattctgcatgrtttagattggaattgtagacctgagtctgtcatttggaaccaaacgtcctgttgctattcatggaagagggagttaacagtacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaatt

SEQ ID NO: 66931 - DNA, 601 bp, Human
aaaacaaaaaaaggggaagcaagttacctggaaagaggacagccattagaagatgcttttgtcttggtagaaatgaaatcacatttgttcaacaaaatgacagtcactctacataaaactgggttttatttaaagagaagaaactgggcgcacaataacccagcagaacagaccccacccccattggagtctcagcttgtttctaattgtattctgcatggtttagattggaattgtagacctgagtctgtcatttggaaccaaacgtcctgttgctattcatggaagagggagttaacartacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtctttttttttttttttttaattatctcttgataggccctgctattgtaagcacag

SEQ ID NO: 66932 - DNA, 601 bp, Human
ctgtcatttggaaccaaacgtcctgttgctattcatggaagagggagttaacagtacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtctttttttttttttttttaattatctcttgataggccctgctattgtaagcacaggaagagagaaatcaatacatttgtatatctgcccattttggtttgttttcgtaagaaaaatatctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctgg

SEQ ID NO: 66933 - DNA, 601 bp, Human
ggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtctttttttttttttttttaattatctcttgataggccctgctattgtaagcacaggaagagagaaatcaatacatttgtatatctgcccattttggtttgttttcrtaagaaaaatatctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgagg

SEQ ID NO: 66934 - DNA, 601 bp, Human
caataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtctttttttttttttttttaattatctcttgataggccctgctattgtaagcacaggaagagagaaatcaatacatttgtatatctgcccattttggtttgttttcgtaagaaaaatayctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgaggaatcatccgcaa

SEQ ID NO: 66935 - DNA, 601 bp, Human
attgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgaggaatcatccgcaagcaattcgtaggaggaaaaggagacctcaagagactcacttraaagcttttctgggccatctcgttgctagaaagtcattcaacaaacatttgccaatgtcgtctttgcttctggaaaactgggaagcagatgtgattgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcggaagggctcacaaagacatggcatttaaacagaatcttgatagaatttgg

SEQ ID NO: 66936 - DNA, 601 bp, Human
catccgcaagcaattcgtaggaggaaaaggagacctcaagagactcacttgaaagcttttctgggccatctcgttgctagaaagtcattcaacaaacatttgccaatgtcgtctttgcttctggaaaactgggaagcagatgtgattgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcrgaagggctcacaaagacatggcatttaaacagaatcttgatagaatttggtcagtgcaaggggagtgagaaggagttttcagggcagtggatactcatgtacagacaaggagtcctgggaggtggcgagaggtccccatggccactggggcttaccgaactcagagaatagggagagatgtgggtggaaacactggtcacaggggcattcacttcgaaagaccacacctgaatcctctgaaagcctaaaacgtagtaggaatgaaatcatggatttcacaggataggatagcttggaaaa

SEQ ID NO: 66937 - DNA, 601 bp, Human
attgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcggaagggctcacaaagacatggcatttaaacagaatcttgatagaatttggtcagtgcaaggggagtgagaaggagttttcagggcagtggatactcatgtacagacaaggagtcctgggaggtggcgagaggtccccatggccrctggggcttaccgaactcagagaatagggagagatgtgggtggaaacactggtcacaggggcattcacttcgaaagaccacacctgaatcctctgaaagcctaaaacgtagtaggaatgaaatcatggatttcacaggataggatagcttggaaaatgagcacaagagcttacattgcttttcctcccatcctcttctatcaaaccacagatacttctcttttttttaaacctttgactctgaagtcttcagggcttccgggcagaatctcttgcattgggagttgccttgacctggagg

SEQ ID NO: 66938 - DNA, 601 bp, Human
acaaagacatggcatttaaacagaatcttgatagaatttggtcagtgcaaggggagtgagaaggagttttcagggcagtggatactcatgtacagacaaggagtcctgggaggtggcgagaggtccccatggccactggggcttaccgaactcagagaatagggagagatgtgggtggaaacactggtcacaggggcattcacttcgaaagaccacacctgaatcctctgaaagcctaaaacgtagtaggaatgaaatcatggatttcacaggataggatagcttggaaaatgagcacaaragcttacattgcttttcctcccatcctcttctatcaaaccacagatacttctcttttttttaaacctttgactctgaagtcttcagggcttccgggcagaatctcttgcattgggagttgccttgacctggaggaattcattccaacagctattcctaaaagactttctgtcctgggtccttcggctctgtgattgctaagaaagcccaggtcaggggtctgtcccttccttctggggccatttaattccactcccttctgtggctacagactgagatgctaagccacgatcccacctga

SEQ ID NO: 66939 - DNA, 601 bp, Human
agcttccccacccaccccaagcctctgaatgtcaatgggactggcttcaagggtcttagccagaaggcacttgcctgcaaatgagagggcgaggagccttttagagcagccagctttctccagacctcccccttctctctgcccatggcagtgctgcctctaggggcactgttgccccacagccccaggcccagtgcagagcgattgtcctttggtgcctgtgggagcagctgcaatgccgcactgcgtgccctgcctggccgagccttaccatgtggcaggcctggacggctgcccgccrcagggcccagctcccagcaccgcctgccaaggagccagatgctaccattggaaaaaattgcttcacaatttgaaatcttggttctttgatcattgctcggagaggatgaagaagagaggttcaaagtagtgttttaaaatgccagcgtctcgttgcagccatcagtgcctattagactgtctctggttggggacagtcctcttgatgttttcatttttgcaaccaggtcattctccccagctcttccaagccctctggataggaagggaaggtccacagcctgctcctgaccctgtgccc

SEQ ID NO: 66940 - DNA, 601 bp, Human
ttgcagccatcagtgcctattagactgtctctggttggggacagtcctcttgatgttttcatttttgcaaccaggtcattctccccagctcttccaagccctctggataggaagggaaggtccacagcctgctcctgaccctgtgcccctgctgtccccctgcctcgcgccttagaggttatctgcttgcctttgttccagcaggcttttccccaataaagcttgtaacaaagttgttgtcatccgccaaatgctgccaccgcgtgagctgctcactcccattcttcactgggcaggagtwgccttcacttcctgatccttctgcccccacagccaggtctccagaggacggaggttttgcagggatgatccactctgtcccctggcctagcacccgcctccaaggacttcagatcccacatacttgggtgaggcttcattcttccttacccttgaaatgggaagggtcagtctttggagagtgttgcatttttcatatttactgccaaaaggcaaaaacatgaaatttaaaccaaacagatccaggatggctgggcatggtggcccacgcgtataatcccagcactttgggaggccgagg

SEQ ID NO: 66941 - DNA, 601 bp, Human
ggaattaaaagttgttaatcagcagatagaatatcttggattatctaagtgggcctagcatggtcccaaggtcccttaaagcagaagagggagacaaaaaaagacatccagagagacgacagctggcaatgtgagaaggattcggctggtgtttctggctttgaaaatggagcaaggggctccgggacaaggaatgtgggtggtctcagaagctggaagaggcaaggaaacagaaccctcttcagagcctctgtctagtaaggagttgcgtcccttctagttccttgatcttagccagccyggagctgaattaaatttctgacctacaggaatataaaataattagtttgtcttgttttaaggcactaaatgtgtgataatttgtagcagagaaaattaatataacagaaaaaagcattaacagttaaggctgtctggcaatattattattatttataaatagagatggggtcttgctgtgttgcccaggctggtctcaaactcctgggcgtaagtggccagcgtgcctggcccagcagcattattgaagtgattttcctgtgtctgaaagtatttagctttaaggcagtgcaggtcagga

SEQ ID NO: 66942 - DNA, 601 bp, Human
gacagctggcaatgtgagaaggattcggctggtgtttctggctttgaaaatggagcaaggggctccgggacaaggaatgtgggtggtctcagaagctggaagaggcaaggaaacagaaccctcttcagagcctctgtctagtaaggagttgcgtcccttctagttccttgatcttagccagcctggagctgaattaaatttctgacctacaggaatataaaataattagtttgtcttgttttaaggcactaaatgtgtgataatttgtagcagagaaaattaatataacagaaaaaagcaktaacagttaaggctgtctggcaatattattattatttataaatagagatggggtcttgctgtgttgcccaggctggtctcaaactcctgggcgtaagtggccagcgtgcctggcccagcagcattattgaagtgattttcctgtgtctgaaagtatttagctttaaggcagtgcaggtcaggatgctgtggaaaggatttctgcttttggaggtaggagagagttgacctctgaactaagtttcagcttagcgtttagggtctctgtttctagagcaaacagggagaagatttcttagaa

SEQ ID NO: 66943 - DNA, 601 bp, Human
ccagccatatttctaagtgttgttttttaacactgcagaacctggcctatgaccagcctttttggctagcttgtgcccagaagatgggatatggtttgactttggaatttattggaaagataagttttactagttttcaactgtttcttggatttttgtttttatttacttttagaaaatatcctgtggttaggtaaaagctgattaggcagaaatagtttgtatctctgatagtggtacatttttaaaaactcattttcttgccttcagaactacatgaaataggtttgctttccacctggagtgattttcagttgggaggggggacgtgtcagtagggtagataatgaactctgcaaatcccagacttctttgttgttgacttaatgctagcattctttctttgatattaccttcacttcatgggagttcagtgactgcatttctttctggaatagccataacactatcagctgacagataattatatatatataaaattatatatatcttgataattatatatatatcttgataattatattttacatcaatacttcctcctagaaaattcctgaagagcatctgtgatatggttgga

SEQ ID NO: 66944 - DNA, 601 bp, Human
tcacttcatgggagttcagtgactgcatttctttctggaatagccataacactatcagctgacagataattatatatatataaaattatatatatcttgataattatatatatatcttgataattatattttacatcaatacttcctcctagaaaattcctgaagagcatctgtgatatggttggatagctacataattattttccatgttcaagggtaattacaaagcagttgtaatggcaaattggttatttactgttagttgggaagccttttaaaatctaatctcttaaatttacastaataattaaatagagaattttctcagactgtttctccctacctcttatctaaatgaaggataaaatgcacgtagactctatgaccgagtaattacactcctaggaacgtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatgg

SEQ ID NO: 66945 - DNA, 601 bp, Human
atatatcttgataattatattttacatcaatacttcctcctagaaaattcctgaagagcatctgtgatatggttggatagctacataattattttccatgttcaagggtaattacaaagcagttgtaatggcaaattggttatttactgttagttgggaagccttttaaaatctaatctcttaaatttacactaataattaaatagagaattttctcagactgtttctccctacctcttatctaaatgaaggataaaatgcacgtagactctatgaccgagtaattacactcctaggaacrtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatggttgagtctcacaaataaaatgctgagtaaacaaaactaaacactgtaaaccctgttgcacttgcttaaagttcagaaaccagacaaaactaatgtgtgatgtttcagga

SEQ ID NO: 66946 - DNA, 601 bp, Human
aattaaatagagaattttctcagactgtttctccctacctcttatctaaatgaaggataaaatgcacgtagactctatgaccgagtaattacactcctaggaacgtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatggttgartctcacaaataaaatgctgagtaaacaaaactaaacactgtaaaccctgttgcacttgcttaaagttcagaaaccagacaaaactaatgtgtgatgtttcaggatcatggttacgctggcaaggtgtatagatgattgtgcctggaaggaaggatatttgggggagagagggacttccatttcttcatctgggtgctggctcacttgatgaaaattaatcaagctgtaaacttccagtttgtgtacttttctgaatgtatattttaattttatgtaaaactgttaactttgacagcttta

SEQ ID NO: 66947 - DNA, 601 bp, Human
tgagcaacaatagtagaatgattatgaagatgaggaaacagaactttttttccattccttcattctctgtttctgctttgggaatttttacgtttacaattttaaataactgaagtagagtgctggttattgttgaaagtcattttgtcaaataaaggaaggcggtcttaaaaatgcgtcagatctgctaggtgtgccactgctgtgggacagctgctttcaccagcgttacttaagcatggaacctcgtacagacagaaccgtaacagttgtgaacatattcagcaattttactaacatmatgatgaataataccattctaaacttagttaacattttaaaattatatatattgacagattattttttctgttttaaggttgacagtttttaaaaacaatctatttactctcccagtgacccacctgcccccatacacaattgcttatttcactgtgttcccttccatagtccagtctgtacaccaaaatcactagactgctttcccccatgcttagaaatagggtcttgctacgttgcctaggctggtctcaaactcctgggcttaagcgagcctcctgcctcagcctcctgagtaatt

SEQ ID NO: 66948 - DNA, 601 bp, Human
aagcatggaacctcgtacagacagaaccgtaacagttgtgaacatattcagcaattttactaacatcatgatgaataataccattctaaacttagttaacattttaaaattatatatattgacagattattttttctgttttaaggttgacagtttttaaaaacaatctatttactctcccagtgacccacctgcccccatacacaattgcttatttcactgtgttcccttccatagtccagtctgtacaccaaaatcactagactgctttcccccatgcttagaaatagggtcttgctaygttgcctaggctggtctcaaactcctgggcttaagcgagcctcctgcctcagcctcctgagtaattgggactacaggtattctaccacacccagcttgctagactgcatttgattatttactagtctttcagaacaacttgattaatcaaaatcaactagtacaatgttagcttacagtgtattcatagcacatggagactctttttcaaagctaggaatttaaagttgaaagaaagaaaaataatttctaatgcaccttttctgctcaacacaaacttattgcagcatcattgggaagc

SEQ ID NO: 66949 - DNA, 601 bp, Human
tactgtttgtgtgataaaggaggaatgtatatgcttgaatacctaagtgctgaatatctctgaaaggacacttgagaaatggataacattggttacctttagggaggttggcaaattttggggttcatgcccattttacagttttatttttcccccgtctttaccacatgcatgttttcacttttttaaaaaatgttgggctgcgccaggcatggtggcttaggcctgtaatcccagcactttgggaggccgaggtgggcggatcacctgaggatgggagttcgagaccagcctgaccaaygtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaaatctggaacgttttggcacaggctacatcataataataacagcattaatcctgccaccataaagcacctgaactgcttttcacagcgaagtattct

SEQ ID NO: 66950 - DNA, 601 bp, Human
aaaaaatgttgggctgcgccaggcatggtggcttaggcctgtaatcccagcactttgggaggccgaggtgggcggatcacctgaggatgggagttcgagaccagcctgaccaacgtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaaatctggaacgttttggcacaggctacatcataataataacagcattaatcctgccaccataaagcacctgaactgcttttcacagcgaagtattctaaggtgtcagcaaagcgaggcagtggcagttcttgaaggtaacactgccatgttgaaagctcgatgggaattccagtgttcagagcccctgtgtgcctgaggtgtatggtagcccctctgccctggagactggagctcagttagacccaggggcctcttcagccttgggagttcagatgctgatctc

SEQ ID NO: 66951 - DNA, 601 bp, Human
cataaagcacctgaactgcttttcacagcgaagtattctaaggtgtcagcaaagcgaggcagtggcagttcttgaaggtaacactgccatgttgaaagctcgatgggaattccagtgttcagagcccctgtgtgcctgaggtgtatggtagcccctctgccctggagactggagctcagttagacccaggggcctcttcagccttgggagttcagatgctgatctcatttagggaaagacatgcatgatttcctgctgagctgctcttttgtggagccaaatgttaaacctttgaatgtgwgaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctctttatttgtagacagaaagta

SEQ ID NO: 66952 - DNA, 486 bp, Human
catgatttcctgctgagctgctcttttgtggagccaaatgttaaacctttgaatgtgagaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacrtaaggtgaaaaggggaatgtggagtacatggttctctttatttgtagacagaaagtaggaagttttgcctaaggagttggacattttcctaataaccaattcaaaaaggaaatttaaatgtagatacttattttaaagtatatgatgactcaagtcttagtggttagtgcctgtcaaggtataaa

SEQ ID NO: 66953 - DNA, 601 bp, Human
aagttgttagtagctattagaagcacctgagacaagttaattattgtagttgaactctgaatttagctttgaatttcttggcacataaggtgaaaaggggaatgtggagtacatggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggwgcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctaggcgacagggccagaccctgtctcaaaaaaaaaaaaaaaaaaaaaagtgc

SEQ ID NO: 66954 - DNA, 601 bp, Human
gagcaggccctggctcagcttttgctttttttatccgcagctctgagcattgtgccggatgcggagcagggggttggtagatatttgagggaaggcagctattactctgtggctgtctttggtctgttttgtgctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcrttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacc

SEQ ID NO: 66955 - DNA, 601 bp, Human
ctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacrgtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtact

SEQ ID NO: 66956 - DNA, 601 bp, Human
tatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagktgagatttgggtggggatacaaccaaaccatatcaccctccttctttctcccacttctttttcctgttaacttctaaaaagccaaagtgatttggaagcacctgaaaggaagcaaataggatgtcccgtgccagtcctctgactgtgtctgaagtcagctgtgccctgctcagccagtgctgtgcacctttgcttgaggccttgtggggtagtgtggtatgaaagctgggtcgagataggccctgccactcagaatgatgccctccctacacccaacccctaggtccaagggcactccca

SEQ ID NO: 66957 - DNA, 601 bp, Human
atatattaggatccaatctctttttacggcttttatgtttcataccttcctccctttaaaaagatgtatatttgtttgatcagggtgagttgctttgttgaataatgtttgttgttggcattccttaaaggttgtattttttagtgtcttctatccatcacccaattaattgatccatgttcagtgagcagtttttatttgcagtggccccagacctttcaggttcaagagcccaccttagctgtacaaagactttgtgctgaggagggagagagggagaaggatatatttcttaagaccytgggctaagcaatgaggatttgggatgctgcaggccctcgtagcacaagccccctgagcaatggacaggccttatgagaatgttgttgaggaaaggttatgctggcagaagaggatccaggggagttgactcagatggacaatttaagcttaggggtcatgagctttcccacaatggtggcagtgggaatcctgtaagatgttttgaatggaacttagaaactaactggatattaatgaggaggaagagtcaaaagtcacactcacattttatgcttggaaggatggtactgccactaat

SEQ ID NO: 66958 - DNA, 601 bp, Human
taaattgggaatcctgagcattaaggattgggaatggagacctagctgcagagagggaatagaaagggcacaggaataaggattaaatttggggagcagccactagccctaggataagtagagggagacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgkgtgattgggagtgtggaagatgagtgttaggcaatgttagtgaatagctaagttgtcagggatgttctctgtagttgaaattccctgcctggacaggtgcatttgagaaaagatgaaccagacagcttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgt

SEQ ID NO: 66959 - DNA, 601 bp, Human
gacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgggtgattgggagtgtggaagatgagtgttaggcaatgttagtgaatagctaagttgtcagggatgttctctgtagttgaaattccctgcctggacaggtgcatttgagaaaagatgaaccagacagyttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgtttagaatgtgtgtctgcatttggtgtgaagtagtagtccacttatattttcttccagataggcgtttgtatcaaaaccacttatgaaatgattcattctttcccagttaaacagatctgtcccctt

SEQ ID NO: 66960 - DNA, 601 bp, Human
attttgcatatctgtcttcaatatggccatcttagcaaattctcatacttaactttagtttttcccccagattcctggggtacccttgtatagttaactgatgttagttgaaaaagttttggtgttttgccctttaggattatatttactgtaggcttttattaatggtctttattactaatttaagtgttttctttctattcctattttacttaggatttttattagttacagctgcaatacgttatcaaatgcttttcagcaactgttgctatatgatttttcttccaagttgttgacrtaacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttccttttttttttttttttgagatggggtctcactctgtcacccacactggaatgcagtggcatgatcttggctcactgcagcctcagcctcactgggctcaagcaatcctcccacctcagcctcctgagtatctgggactaca

SEQ ID NO: 66961 - DNA, 601 bp, Human
attaatggtctttattactaatttaagtgttttctttctattcctattttacttaggatttttattagttacagctgcaatacgttatcaaatgcttttcagcaactgttgctatatgatttttcttccaagttgttgacataacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttccttttttttttttttttgagatggggtctcactctgtcacccacactggaatgcagtggcatgatcttggctcactgcagcctcagcctcactgggctcaagcaatcctcccacctcagcctcctgagtatctgggactacaggcctgtgccaccatgcctggctaattttttgtattgttttgtagaaatgtggtttcgctggtctgaaactcctgggctcaagcgatctgcctacctcagcctaccaaagtgctaggattaaaggtgtgagctgtcacacccaactatatacctttttca

SEQ ID NO: 66962 - DNA, 601 bp, Human
ttggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcmtgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttg

SEQ ID NO: 66963 - DNA, 601 bp, Human
tcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacggaagtgaggaaggtgggcctgggaggcgctgggcctgcgccgagggaactgaccaggttgttggattgggttcctagtggtcagtcagyagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttcaacattagccaagttttagtctcagcagcaacatggtat

SEQ ID NO: 66964 - DNA, 601 bp, Human
tttttttaagttccgcaggtaatttcaacattagccaagttttagtctcagcagcaacatggtatgcaaatcaggcaaaagctgagttggtatgtttgtacttcaaacataccttgacatgttccatgatggacttccaaggccttctaagaagttacatgcattaaggcaggaaaatataagctctcagtaccagaagaaatataaattagaatagaatgcatggaatgcagtgaccaggaggaggaaaatgttcttcataggctaaaaaatctggctaggctgagtacagtggcttatrcctctaatctcaacactttgggaggccaaggtgggaggatcccctgagcccaggagttcaagaccagcctgggtgacatagtgacaccctatctcaaaacaaacagacaaaacaaacttaatgggcagctaaaggaaagggaaaatagtgttcaaggtccatgatgggaaaactcaccagtgcccctggatggttctatgtgggttttcccctaatacttaactttaaaacaaatttcttctgggagctttatttggggacttcagaagttgttaggaacaatgtcatcctcaaaataga

SEQ ID NO: 66965 - DNA, 601 bp, Human
gattaagaatccatacagcaggaattctttacttggtgtttttggttccattgggacagtggctttcaatcagcagtgttctgtttttttgttttgttttgttttgtttttgttttttagaaaggctgtttcccagtttcccaaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttgtttattttttaagctctgcatgtagttgaagtgtgcaaccgggtagagacccactgctgtaagagattgggaaatgagccgcaaggactctcagagtttatagacacatgattggcatacaactagcaaacagataattttgcatataattttcgttt

SEQ ID NO: 66966 - DNA, 601 bp, Human
aaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttgtttattttttaagctctgcatgtagttgaagtgtgcaaccgggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtga

SEQ ID NO: 66967 - DNA, 601 bp, Human
atatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttgtttattttttaagctctgcatgtagttgaagtgtgcaaccrggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtgaaaatagagcaattcaaggtttgcaggactggcatatagcag

SEQ ID NO: 66968 - DNA, 601 bp, Human
aactctacctcagagagcacagctaagataaatgtggcctggaaaagtgttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcrtcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacgctctatgctgttggttc

SEQ ID NO: 66969 - DNA, 601 bp, Human
gttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcatcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacgctctatgctgttggttcgcatgacaaaaccacctgattacacattaggaggtgtcctcattgtta

SEQ ID NO: 66970 - DNA, 601 bp, Human
ggccttcccattcactcatcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacrctctatgctgttggttcgcatgacaaaaccacctgattacacattaggaggtgtcctcattgttaagcaagtcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatc

SEQ ID NO: 66971 - DNA, 601 bp, Human
atggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacgctctatgctgttggttcgcatgacaaaaccacctgattacacattaggaggtgtcctcattgttaagcaastcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatcatctaattgatgaacaggagaaattgtacctcatataaaatgacatagtatttgcagataacttatacaaa

SEQ ID NO: 66972 - DNA, 601 bp, Human
tataaactagttccaaccattgtggaagtcagtgtggcgattcctcagggatctagaactagaaatacaatttgacccagccatcccattactgggtatatacccaaaggattataaatcatgctgctataaagacacatgcacacgtatgtttattagagcactattcacactagcaaagacttggaaccaacccaaatgtccaacagtgatagactggattaagaaaatgtggcacatatacatcatggaatactatgcagccataaaaaatgatgagttcatgtcctttgtagggacrtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagaggggggagggatagcattaggagataatacctaatgttaaatgatgagttaatgggtgcagcacaccaacatggcacatgtatacatatgtaacaaacctgcacgttgtgcacatgtaccctaaaacttaaagtataata

SEQ ID NO: 66973 - DNA, 601 bp, Human
tggattaagaaaatgtggcacatatacatcatggaatactatgcagccataaaaaatgatgagttcatgtcctttgtagggacgtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagaggggggagggatagcattaggagataatacctaatgttaaatgatgagttaatgggkgcagcacaccaacatggcacatgtatacatatgtaacaaacctgcacgttgtgcacatgtaccctaaaacttaaagtataataaaaaataaataaataaataaagctaaacttaaaaaaaaaaaagaatggatagaaaagaccttgcaaggtatcttatggtcatgaaatcaaaagacttgagtttaagactttatggccttggtcacttagtcttcagacatcagtttcaccttgatttataaacagaatgctcaagtctgcactttctacctcagaggttatcattgaaatattttaa

SEQ ID NO: 66974 - DNA, 601 bp, Human
ttggtcacttagtcttcagacatcagtttcaccttgatttataaacagaatgctcaagtctgcactttctacctcagaggttatcattgaaatattttaattcagctaagctgtgagagatggtactgccttctgggatacaatgcaaataaaacccagcacttgtcacgtagtaattcatggtccttcaggatgaaagaggcaggtaaataaaccattgcaagcaaatgatggctgtagtgtactcgtgaaacaggtacctctgaaatgcagagtgatgaggtagggattctcagggatrttgcctcgatggataaggagacatctttctgattactaagaataggggtatcccatgggtacatacttaggtaccaggggctggggtgctatggtgaattaggcaggtgggccgccatcctgggttctgatgcaggaggcaggcatgcatcaagtcatcacaaaataaatgaaaactgtagctcttgctacctggcagagggacgcagggcattcgtagaacaggggaatttgacctagttcaggcggaagctgaggaaggcttcctgaggaagaaacagttgagagctctctgcgtggt

SEQ ID NO: 66975 - DNA, 601 bp, Human
accagagtgaggacagaaaggagtcagggtctgtgtggtgtggagggagctgcaatgatttgggctggagaactcaaaatacgagggataattagagggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctrttgtgaaacaagatttagcagaagtttaagactaggatgggaaaaagagtggattttaaatgttctcatcacaaagaagtatgtgaagtgcttggtatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgtt

SEQ ID NO: 66976 - DNA, 601 bp, Human
agggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctgttgtgaaacaagatttagcagaagtttaagactaggatgggaaaaagagtggattttaaatgttctcatcacaaagaagtatgtgaagtgcttgstatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaag

SEQ ID NO: 66977 - DNA, 601 bp, Human; identical to SEQ ID NO: 39810

SEQ ID NO: 66978 - DNA, 601 bp, Human; identical to SEQ ID NO: 39811

SEQ ID NO: 66979 - DNA, 601 bp, Human; identical to SEQ ID NO: 39812

SEQ ID NO: 66980 - DNA, 601 bp, Human; identical to SEQ ID NO: 39813

SEQ ID NO: 66981 - DNA, 601 bp, Human; identical to SEQ ID NO: 39814

SEQ ID NO: 66982 - DNA, 601 bp, Human; identical to SEQ ID NO: 39815

SEQ ID NO: 66983 - DNA, 601 bp, Human; identical to SEQ ID NO: 39816

SEQ ID NO: 66984 - DNA, 601 bp, Human; identical to SEQ ID NO: 39817

SEQ ID NO: 66985 - DNA, 601 bp, Human; identical to SEQ ID NO: 39818

SEQ ID NO: 66986 - DNA, 601 bp, Human; identical to SEQ ID NO: 39819

SEQ ID NO: 66987 - DNA, 601 bp, Human; identical to SEQ ID NO: 39820

SEQ ID NO: 66988 - DNA, 601 bp, Human; identical to SEQ ID NO: 39821

SEQ ID NO: 66989 - DNA, 601 bp, Human; identical to SEQ ID NO: 39822

SEQ ID NO: 66990 - DNA, 601 bp, Human; identical to SEQ ID NO: 39823

SEQ ID NO: 66991 - DNA, 601 bp, Human; identical to SEQ ID NO: 39824

SEQ ID NO: 66992 - DNA, 601 bp, Human
tttccgtttaaagcaggttgagcaccagctgcctgccacttgtgagctgggtatgtgccgcacaggacagtgccttgtttaggcgatggtcactttgtcaggaaaatctaccaaggaagaaattaccaaaccatgtctttttttctgtttatggagtagttcacagcaaatcttgagtgttttgactaaagcatggaatacagaaaacaaacttcagctagtgctttaatctctgctgaaattctacaggtatgtgttttataagcagtatatggcaggattttaagccagtctgaaagtstggttttcagtagcattatttctgacagctacatactgctgaatgttcaactggtgaaactgaaggtcttttcactcagaagaaatcaatcaagaagaacttgcagttcgcaagcttctgagctgctgtggatggccctggctctccagactgcccttcccactgagatctctcacatggggtctcctgctgctgccactcctgactctcctcctgatgtggtacctctcagccttccccactacaatgtgacagaatatgtagactggatgtacttttacaagtatgagccaatttaca

SEQ ID NO: 66993 - DNA, 601 bp, Human
aagatggagaagatatttaaatattcttataaacaagtattcatcaataagaaagtggttaaatatatggctaaagcatgggacactataaagctgtcaaaaaggatgagaaatctacaaatactggaatagaaagaccttccagataaataaacacacacacaaaaattgtgggtcgggcacagtagcccatgcctgtaatcccagcacttggagaggccaaggcagacagattgcctgaggtcaggagtttgagaccagactggctaacatggtgaaactccttctctactaaaaataygaaaattagccgggtgtggtggcgggcgcctgtagtcccagctactagggaggctgaggcaggagaatcgcttgaacccaggaggtggaggttgcaatgagccgagatcataccactgcactccagcctaggcaacagaataagactcagtctccaaaaaaaaaaaaattggggagaaaattcatacagtataatgccatttatgaaacggcaagagaagtgttaatatatatactcatatatatgtaaatacacagcaagttctgaaatggctgggtgtgggaaacacctatcgaacca

SEQ ID NO: 66994 - DNA, 601 bp, Human
tcagacttgagaatactcaagcttgcaagcttggaaaaatatttgctcagagctgacgccaccttgacaaccacagcatatagccaagatgacttttctctttaaagatagttaataatttcaggaaacagaagacttgaaacaattagatcaaagaacttataaaagcattagaatttttccaaatatcagggtcaatgaaagaacaaaataaaacagaaaacaagacatatagtgatgaagataggatttcataaagttttcagtctaagacttaaaagtgcaattaggctggacctgstggctcacatctgttatcccagcactttgggaggctgaggcgggagaattgctttgagcccaggagtctgaaatctgcctgggcaacaaaagagatgtaatccctaaaaaaattttttttttaatttaaccaggtggggtggtatgtgcctatagtcccagctattcagggggctgaggtgggagaatcacttgagcctaggaggtcaaggctgcagtgagcctgtaccaccgcacttcagcctgagcaacacagtgagatcccgtctcaaaaaataaaaataaaaataaaatttttata

SEQ ID NO: 66995 - DNA, 601 bp, Human
tagaaacatgagtagtgtctccaacgaaggggctcagagtgctgcatgtaacataatgggtgacccaaatatttagcaaccagcagagcaaagtcattacaactctttttctttttttttttttttgagactgagtctcactctgtcgcccaggctggagtgcagtggcgtgatcttggctcactgcaacctgtgcctcctgggttcaagagattctcctgcctcagcctcctgagtagctgggattacaagtgtgtgccaccacacccagctaatttttgtatttttagtagagacgggktttcaccatgttggtcaggctggtctcaaacttttgacctcgtgatctgcccacctcaacctcccaaagtgctgggattacaggcataagccactgcgcccggcccattacaactcttcatcaaatatttccagctgccctcccaggcacataacaaaactacactttctccatgccccccggcattacatgagaccacatgacttgctttggccagtgagatataaaaggaagtgacatatatcccttctggcttttagtttccactagtacttgactcattactctgtttctctctgc

SEQ ID NO: 66996 - DNA, 601 bp, Human
ctgctaacaatatggaagtgctattcttttaaaaatcaccacctaaaaactagtcaggaaacccacgcttccctcttcttaaaagaaattaactcatgacattttaaaaggaattagccttgctgtcctcctacacatttttgttttcaatagttaacagtatcttagactgagtatgttctgttcaacaggtcacataaaaaaattaacatcacaagaatattttacctcagcttaaaaaataggaaaggagcctaaatacctgtatacaaatgtgtacttccttagtttttggttacaycagcaaattaagtaacactggactgtaagtgaatcagtgattgatctgtaccctgaaataactgctgaaatgtcttctgcctttttcccctacaatcacttctgttaacatatgtcctgtcctcatgtaaacttaatatgagctcaacagaatgaagaatacagacgccttcaaggaactgaatctaacagaagaaacaaataacaataaaaattgtaagacaaaagtactggatgttaaatagtgtgaaaagaaataaatgtgaagtaagttctaaaaagaggtaaaaacaaaaaccaa

SEQ ID NO: 66997 - DNA, 601 bp, Human
tgaggcaaaagaaaaaaaaagatttaaagatagtaaaaaaaaaaaataatctcagcacactgggataaatatcatttgatgcaatttaacatatatatcattattggtcttctatactgtaacagaattggtaactattaatactttttcagcaaagaaaagaaaatcttggctcttatttctgcttattaccaattaatatgcaaatttccagattagctgctaacaatatggaagtgctattcttttaaaaatcaccacctaaaaactagtcaggaaacccacgcttccctcttcttaraagaaattaactcatgacattttaaaaggaattagccttgctgtcctcctacacatttttgttttcaatagttaacagtatcttagactgagtatgttctgttcaacaggtcacataaaaaaattaacatcacaagaatattttacctcagcttaaaaaataggaaaggagcctaaatacctgtatacaaatgtgtacttccttagtttttggttacaccagcaaattaagtaacactggactgtaagtgaatcagtgattgatctgtaccctgaaataactgctgaaatgtcttctgcc

SEQ ID NO: 66998 - DNA, 601 bp, Human
aaaaggccgggtgaggtggctcacgcctgtaatcccaacactttgggaggccaaggagggtggatcacctgaggtcaggagtttgagactaccttgatcaatatggtgaaatcctgtctctactaaaaatacaaaaattaaccaggcgtggtggcatgtgactgtagtcccagctaatcgggaggctaagacaggagaattgcttaaacccaggaggtagaggctgcagtgagctgagatcacgccactgcattccagcctgggtgacaagaacgaaactgtctcaaaaaaaaaaaaaaaattgttttctgctgggcacagtggctcacacctataatcctagcactttaggaggctgaggcgggcggatcacttgagtccaggaattcaagagaagcctgggaaacatggtgaaaccatgtctctactaaaaatataaaaattagctggcgtggtggcacacgtctatagtcccggctacttgacaggctgaagtgcgacggtcccctgagcctgaggaggtcaaagctgcaacgagttgtgccacgccactgcactccagcctggatgacagagtgaaaccctgtgccaaaaaaaaaaa

SEQ ID NO: 66999 - DNA, 601 bp, Human
atcaaagataaatttgagaaactactgatggaggcttgaaaatgatttttttacatatcatataatttctgctaacatggaataaggatttctaaaaaacaatttttaaggtatcaacacactatttacacacatattaaaactctacacacaaaacacttcatatttctgcaaataattaaaatccactgaagaatacaagggctccagctagcagtatgactggaaccttgtgagagaccctgagctagaaccacccagctaagccactctcagatttctgacactcagaataaatgtygtttgttttaagctgctaaatttgggaataactggttactcaggaacaaatatgttgcgtttaatatgcttaaagaaaaaaagagggtaatgatagtaagaagaaaatggcactataaaacaaagaccaacaagtcaacaacaaaaaagcaaacagattcaaaaatgggcaaaggacttaaaaatttctcgaaaacagatacacaaatagccaataaacacttgttaaaaaatgcccaacatcactaataattagggaaatgcatatcaaaacgacaatgagaggccaggcatggtggct

SEQ ID NO: 67000 - DNA, 601 bp, Human
gttcaagcgattctcttgcctcatcctcccaagtagctgggattacaggcatgtgccaccatacccagctaattttttgtatttttagtagagatagggtttcaccgtgttgtccaggctggtcttgaactcattacctcaggtgatatccacccacttcggcctcccaaagtgctgggattacaggcatgagccaccttgtccggcctctgaaattacttcatatatacatattctgctatcatttaaataatcaacactctgtaaaggtttttaaaaatcactaaagagttttcaaaamaattactaagaaacagtctgtgtcatgttaaatgacagatggaacaattactcaattgaaatgagacagaaaatctgacaatcaattggaaactgtcatataaaaattaaggttggacctaagcaaaagcattacaaatggtttttcctttgcttttatattctctttaagaaaaatacatttaattgcaaacaaagtataaagcagaagagtaacttatacttggtgacattttaccattcccctacagtcaaaatataacaaaatatttgaaccaatcatatttcactccttggttag

SEQ ID NO: 67001 - DNA, 601 bp, Human
ctagactaatggtcttcccagtactttatattcttactacatcacaaagggtaaggattataaacccaaagttagaaagaataagcactgatttctgccagctataaggtaatagatgattgcacttaattttcaaaatcaaataaggctgtatacttttccaattcttctatattaaattattagatgttgtatgatagtatgagaaccttaatctttctgtatgaaatccctttttttttttttttttttttttgagacggagtttcgctcttattgcccaggctggagtgcaaaggcrcaatctcggctcactgcaacctctgtctcctgggttcaagcgattctcttgcctcatcctcccaagtagctgggattacaggcatgtgccaccatacccagctaattttttgtatttttagtagagatagggtttcaccgtgttgtccaggctggtcttgaactcattacctcaggtgatatccacccacttcggcctcccaaagtgctgggattacaggcatgagccaccttgtccggcctctgaaattacttcatatatacatattctgctatcatttaaataatcaacactctgtaa

SEQ ID NO: 67002 - DNA, 601 bp, Human
aaaacccagaatgatgacagtaatgaaatccttcatggaccaatactagactaatggtcttcccagtactttatattcttactacatcacaaagggtaaggattataaacccaaagttagaaagaataagcactgatttctgccagctataaggtaatagatgattgcacttaattttcaaaatcaaataaggctgtatacttttccaattcttctatattaaattattagatgttgtatgatagtatgagaaccttaatctttctgtatgaaatccctttttttttttttttttttttttgagacggagtttcgctcttattgcccaggctggagtgcaaaggcacaatctcggctcactgcaacctctgtctcctgggttcaagcgattctcttgcctcatcctcccaagtagctgggattacaggcatgtgccaccatacccagctaattttttgtatttttagtagagatagggtttcaccgtgttgtccaggctggtcttgaactcattacctcaggtgatatccacccacttcggcctcccaaagtgctgggattacaggcatgagccaccttgtccggcctctgaaattacttc

SEQ ID NO: 67003 - DNA, 601 bp, Human
gcatgcaccaccatgacgggctaattttgtatttttagtagagacggggtttctccatgttgaggctggtctcgaactcctgacctcaggtgatctgcccacctcggcctcccaaagtgctgggattacaggcgtgagccaccgggcccagcctgggtgtcttacaatttaactcaattctaattccacctacctagagatagtgtcagattccacaagtccagggctcaggcccacatgactgtcccagacttcagatgccatttctgattgattggcaataaactgggatttccacaamcccctccttggttagactaatttgcaagagtggctcacggaactcagggaaacactttacatacgtttacttatttattataaaggatattacaaaagatacagatgaacaaccaaataaaaagatacacagagcaaggtgtgggagaagaggggctgagcagagtccttcaggaacttccatgtgttcagctatcccaaagctgtctcaacccagtacttctaggtttcgtggaagcttcattacataggcatagttgattaaatcactggccattgttgatgacgttgatgacgttaa

SEQ ID NO: 67004 - DNA, 601 bp, Human
aaatccttcctttaaaaataaagttatcttcaacgaatttcatttgaatgagagtggtattccatcttcaaagtccactgaaatcaaatggaaagctggaaaggatgcgatgaaacattcaagtcaaacacagaataaagccagcaggaagaggcagcatgaggcaccagagagcttctttatctggtttactgaccattctgatgcaggtgctcatatgttaggaaagttcatcaaagatgacatttgtcccatcccattacagtactacttggttaccgactgatatggatgaagaagraggagaagatgaggaggaggaggaggaggaagaggaaggattagaagatattgatgaagaaggggatgaggaagaagatgatgatgatgataaagggaaggaaggacagtagggtgaaggagaagatgactaatagaacactgatggattcaaccttcctttttaaaattttctccagtccctgggagtaagttgcagtcttttttttccccctcttgtggctcacttgccctgttcttgaggtctcttttctatacaccatgattctcaacttatttgggaggtaaataccttgagcag

SEQ ID NO: 67005 - DNA, 601 bp, Human
ccttcttataggaacaaataatgttaatacccactgaccaagtcattaaatctgaggaatacccagattacataacttttgacatcagagtataaaagaaaaggagcattgataaaacagtggaaattaggaaacacaactacattaacaacagttacatcctaagcaggaatacaatttaatgagtcaccagtttaaaatgtgcaaaactcagacctaaaagggtaaggcttatataatgttgtccaattatttaaagtgctcagataattcctccacatgaggattaactctgcaattytaagcttcctacccaacgtcccaatcccataataggcaatcacattatactaattatgactgtcatgatttatactcattggaatactgattatttcacaagtcaagtgtctaagcaattttgaccttgaaaaggcaaaaaaataaaatttaaaagccgagatattcaatatataatgttatataatgtaaatattaggaaacaagagcaacagctatcttaaagggttttttttttgtaatagaaagtacctaggaagaacaggcccagagttagggggtactaaggtaaaaataagac

SEQ ID NO: 67006 - DNA, 601 bp, Human
gatctcaggtgatctgcccacctcggcctcccaaagtgctgggattataggcatgagccaacacacacggccaagtgttgttacattttcttatcctaagaaaactataaagaggtacacttcttttttgaaataaaaccttgcttttgatgtccaacacttaagagagtgaatgaatcaatagaagagaaagacttaatttaacaccctagcctaggagagatgagcaagtgaggagcaggttcctatttctgacaagaagaacagggattaaaaacaatgtgagaaataaacaaaaaaacaagccaacaaacactgtcaagaccactgaaccctagttgcaagccaggctgctatactaagcatcctgattattccaaagatgccccgagattcaacccagcccttctggcctctgccaaagaggcacagaaacagccaagtcaagttccaagaatagtcgtggcataccatccccctccaactacagtcatcctcagggagattgtttctgggagcatcttgccctaggactaacagcagaattcagaagggcagtcagttgttactactgtttccttccttatccaacaaaacttca

SEQ ID NO: 67007 - DNA, 601 bp, Human
cagtcttaaaaccttctacaacttttttatactcctcaaattttctactggggctgagcacagtggcttacacctataatcccagccctttgggaggttgaggtgggctgatcacttgaggtcaggagtttgagacctcaaagtgttggcacgcacctgtaatcccaggtactcagaaggctgacgcaggagaatcacttgaacctgggaggtggaggttgcagtgaggccagatcgtgccactgcactccagcctgggtgacagagcagagactctgtctcaaaaaaaaaaaaaaaaaaataataataataataataataataattctattggttctaagcaaaaaggagaaagtagagaaatataaaagggtgcttatcccctgatcttttagtgtctttcccccatggaattcttagtttttttaaaaaaatagtattttaaaatacagactaggtcttgctatgttgcccaggctgatcctgaactcctggcctcaagcaatccttttgcttcatcctcccaaagtactaggattacaggcatgagccactatgcccagctgaaatttcttagagcactttttatttcgaaaccagg

SEQ ID NO: 67008 - DNA, 601 bp, Human
cgcagtcttaaaaccttctacaacttttttatactcctcaaattttctactggggctgagcacagtggcttacacctataatcccagccctttgggaggttgaggtgggctgatcacttgaggtcaggagtttgagacctcaaagtgttggcacgcacctgtaatcccaggtactcagaaggctgacgcaggagaatcacttgaacctgggaggtggaggttgcagtgaggccagatcgtgccactgcactccagcctgggtgacagagcagagactctgtctcaaaaaaaaaaaaaaaawaataataataataataataataataattctattggttctaagcaaaaaggagaaagtagagaaatataaaagggtgcttatcccctgatcttttagtgtctttcccccatggaattcttagtttttttaaaaaaatagtattttaaaatacagactaggtcttgctatgttgcccaggctgatcctgaactcctggcctcaagcaatccttttgcttcatcctcccaaagtactaggattacaggcatgagccactatgcccagctgaaatttcttagagcactttttatttcgaaacca

SEQ ID NO: 67009 - DNA, 601 bp, Human
aggcgcagtcttaaaaccttctacaacttttttatactcctcaaattttctactggggctgagcacagtggcttacacctataatcccagccctttgggaggttgaggtgggctgatcacttgaggtcaggagtttgagacctcaaagtgttggcacgcacctgtaatcccaggtactcagaaggctgacgcaggagaatcacttgaacctgggaggtggaggttgcagtgaggccagatcgtgccactgcactccagcctgggtgacagagcagagactctgtctcaaaaaaaaaaaaataaaaataataataataataataataataattctattggttctaagcaaaaaggagaaagtagagaaatataaaagggtgcttatcccctgatcttttagtgtctttcccccatggaattcttagtttttttaaaaaaatagtattttaaaatacagactaggtcttgctatgttgcccaggctgatcctgaactcctggcctcaagcaatccttttgcttcatcctcccaaagtactaggattacaggcatgagccactatgcccagctgaaatttcttagagcactttttatttcgaaa

SEQ ID NO: 67010 - DNA, 601 bp, Human
gatattcctcaaattatgcaagaaagcctattctatccctcttataaatacatatggcctaaaagtggcaaatctcttaagatactaaattaacagggttagacaaatgtccacccagaatattatgtggtactttgcactgtaaaacatagatacagtaagccctgagtatttataaactattaaaaatcataagttcggccaggcacagtggctcacgcttgtaatcccagcactttgagaggctgaggcggatggatcacttgaggccaggagttcgagactagcctggccaatatgkcaaaacactgtctttactaaaaatacaaaaattagctgggcttggtagtgggcgcctgtagtcccagctacccaggaggcttaggcaggagaatcgctggaagccgggaggtggaggttgcagtgagcggagatcgtgccattgcactccagcctgggcgacaagagtgaaactcggcctcaaaaaaaaaaaaacaacaacagaaaaaaaacgtaagttaacagaaaagtcttcattccacatacattcttccaaaactatcaagaagtattttgaaagtatgttttaggaaatagctca

SEQ ID NO: 67011 - DNA, 601 bp, Human
agacacaagactttattttttttttttccagacggagtttcgctcttgttgcccaggctggagtgtagtggcgcgaccttggctcactgcaacctctgcctcctaggttccggcgattctcctgtctcagcctcccaagtagctgggattacaggcacatgctaccacgcccagctaattttttgtattcacagtagagacggggttttaccatgttggccagattggtctcgaactcctgacctcaggtgatctgcccgcctcggcctccctaagtgctgggattacaggcatgagccaycacacctggcccagattcaagacttttaaacgtcagacctgacgctagaaaacaactagaagaaaacataggaaaaatgcttcaggacattgatctaggcaaagattttatggctaagacctcaaaaacacagatagcaaaaacaaaaacagacaaatggagctatattaagccaaaaaaagcttctgcacagcaaagggaacaatcaagagttaagtgacaacctgtttaatgggagaaaatatttgcaaactattcatcttataaggaactaatactcagaatatacaaagaattcaa

SEQ ID NO: 67012 - DNA, 601 bp, Human
cttgaatgtcacactacgaagttcagatttattttgttggcattgagaagccattaacataacagtaacaatttacaagagtgcttcttctagataaatacatacttttacttttctggattatgggggaggggacagttatgccagggaaataacaaaaacacacactagatcattgagataatagctaaatcatgatgttctacctcagtatataatcccagccagacacaagactttattttttttttttccagacggagtttcgctcttgttgcccaggctggagtgtagtggcgcraccttggctcactgcaacctctgcctcctaggttccggcgattctcctgtctcagcctcccaagtagctgggattacaggcacatgctaccacgcccagctaattttttgtattcacagtagagacggggttttaccatgttggccagattggtctcgaactcctgacctcaggtgatctgcccgcctcggcctccctaagtgctgggattacaggcatgagccaccacacctggcccagattcaagacttttaaacgtcagacctgacgctagaaaacaactagaagaaaacataggaa

SEQ ID NO: 67013 - DNA, 601 bp, Human
aagcaacttaaatgtccttcagtgaatgaagggataaacaaggtgtggtacacatccatactatggaataccactcaacaatacaaaggaatgaagtattgatagacacaagttggatgaatctcaaaggcattttgctgagtctcccacagaagccaatctcaaaagatctcatactatatgattctagctctatgacactgctgaaagacaaaactctagtggtggagaacacatcagtggctgccagggattaaagggggggaatatgtgactacagagggattgcatgagacagtcwtttggggtgatgaaactgttccgctgtttgtggggttatgcgaatttacatgtgttaaaattcacagaaccgtacaataaaccaacaaaatccattttactgtgtgacgattttttaaattaagagaaaaaaagcagaaaatgtgttgaagcacattttcatgccagttatatgtaaataataaaaagtcatgccatgaatgtcatatcataggacacatagttattattgaataactacagatgagaattttgcagcttcacttgaattttaaatttccacacttattttagatataat

SEQ ID NO: 67014 - DNA, 601 bp, Human
gctgaggggaacacaaaatggtgtagccactctggaaagcagttgggcagtttgttataaagtcaaacacttaccataggacctggcaatcccattcttgagtatttacactggaaaaatggaaacttaagttcacacaaaaacctgaacacaaatgtttatggcagctctattgaaaattgtcccaaactgggccaggcgcagtggctaacacctgtaaccccagcactttgggaggatgaggcgggtggatcacttgcggtcaggagttcgagaacagcctggctaacatggtgaaacyctgtctctactaaaaatacaaaaattagctgggcattgtggcaggtacctgtaatcccagtgacttgagaggctgaggcaggagaatcgcttgaacccaggaggcggaggttgcagtgagctgtgatcgcgccaccgcactccagtctggatgacagagtgagactccgtctcaaaaaaacaaaaaaagaaaagaaaattgtcccaaactgaaagcaacttaaatgtccttcagtgaatgaagggataaacaaggtgtggtacacatccatactatggaataccactcaacaatacaaag

SEQ ID NO: 67015 - DNA, 601 bp, Human
ggcaggcggactacctgagatcaagagtttgagaccagcatggccaacatggtgaaacccgtctctattaaaaatacaaaaaaattagccaggcgtggtggcatatgcctttagtcccagctactcaggaggctgaggcacaagaatcgcttgaacctaggtggcagaggttgcaatgagccgagatcgggccactacactccagtctgggagacagagcaagactccatctcaattaaaaaaaaaaaaaaaaaattatacagctcatgccagaacttagaatccatccaaaaaaaataaytttttctctagtatgactggacaatttccatctcttcttggaacaaccttatttggaccaaaaattgaatacacagtgtccttccctttggtttttcctcaaaaaaaggatgagctgaacaaaaatcttccctaatatatggctcacctcacaaacatctcaccaaaaaagacaatgtatgtgtgggtattcattaggaaatatttcttataaagtttccctaaccttactcttttaggacacctgtcactgtactgtagataatgtactaacataacaagcttttcatatgatgttaaa

SEQ ID NO: 67016 - DNA, 601 bp, Human
ggcttaacccaacagaaatgcattctctcatagtttgggaggccggaagtctgaaatgagcaacactgggacaaaataaaggtgtcagcgggagactccaaggagaatccattccttgccccttccagcttctagtggctgccaacattctttggcttgtaatccaacccatcgtcaaggccaggatcttcaaatctgtctctgttccaggttcacattgccttctcctatgtgtgtgtgaaatcgccctctgttacacgtgatggcatttagggtccaactcaataatccaggataagcyccccatcacatgtataaagaccaaaaattccccccacctgcaactttatttttgctatgagaggtaacattcataggttccagggattaggacatggatatcttttgagggggtacttttcaacctaccatagctcccaaatgtcaccagcccagaacattttcctgattaacagattgcctgattcctatagcctatggataagtagatacctttggatatcctaaaggcaacaaaaatccattttgttcctactcctggtttgtttctcttctgtttcatgtacatgtacatgtgtat

SEQ ID NO: 67017 - DNA, 601 bp, Human
aggctattggctcctgtattagtttcctgcagctgctataaccatatactagatggcttaacccaacagaaatgcattctctcatagtttgggaggccggaagtctgaaatgagcaacactgggacaaaataaaggtgtcagcgggagactccaaggagaatccattccttgccccttccagcttctagtggctgccaacattctttggcttgtaatccaacccatcgtcaaggccaggatcttcaaatctgtctctgttccaggttcacattgccttctcctatgtgtgtgtgaaatcgycctctgttacacgtgatggcatttagggtccaactcaataatccaggataagccccccatcacatgtataaagaccaaaaattccccccacctgcaactttatttttgctatgagaggtaacattcataggttccagggattaggacatggatatcttttgagggggtacttttcaacctaccatagctcccaaatgtcaccagcccagaacattttcctgattaacagattgcctgattcctatagcctatggataagtagatacctttggatatcctaaaggcaacaaaaatccattt

SEQ ID NO: 67018 - DNA, 601 bp, Human
gcacagtggctcacgcctgtaatctcagcactttgtgaggccgaggtggacagatcacatggtcaggagttcgagaccagcctcgccaacatggtgaaaccccgtttctactaaaaatacaaaaattagctgggtgtggtggtgcatacctgtaatcccagctactcaggaggctgaggcagtagaattgcttgaacctgggaggcagaggttgcagtacgccgagatcatgccactgcactccagcctaggcaacagagcaagactccgtcttgaaaaaaaaaaaaggaaaaaaaaaaaagaaattagaccaatttataatggcctctaagtgttcaagtgaaaggaagagttgcatgtctctaactttaaaccaaaaagtagaaataagttcagtgggcaagaatgtcaaaagttgagataggctaaaaaactacgtctctcgtacaagttagccaagttgtgaatgcaaagtaaaagttcctgaagaaaattaaaagtgctactctagtaaacacaaacatgataggaaagtgaaacaacagccttactgctgatatggagaaaatttgagtggtctgcaaaccagccataacattcc

SEQ ID NO: 67019 - DNA, 601 bp, Human
caatattgaaattaggccaaaactgggcacagtggctcacgcctgtaatctcagcactttgtgaggccgaggtggacagatcacatggtcaggagttcgagaccagcctcgccaacatggtgaaaccccgtttctactaaaaatacaaaaattagctgggtgtggtggtgcatacctgtaatcccagctactcaggaggctgaggcagtagaattgcttgaacctgggaggcagaggttgcagtacgccgagatcatgccactgcactccagcctaggcaacagagcaagactccgtcttaaaaaaaaaaaaaggaaaaaaaaaaaagaaattagaccaatttataatggcctctaagtgttcaagtgaaaggaagagttgcatgtctctaactttaaaccaaaaagtagaaataagttcagtgggcaagaatgtcaaaagttgagataggctaaaaaactacgtctctcgtacaagttagccaagttgtgaatgcaaagtaaaagttcctgaagaaaattaaaagtgctactctagtaaacacaaacatgataggaaagtgaaacaacagccttactgctgatatggagaaaatttgagt

SEQ ID NO: 67020 - DNA, 601 bp, Human
atcccactactgggtatctacccaaaggaaaagaaatcattctatcaaaaagacacttgcactccatatatttattgtagcactattcacaatagcaaaatcatggaatcaacctaagtgtccatcaatggatgactggagtttttaaaatgtggtatagatataccatggaatactacttagccataaagaagaataaaatcatgtattttgcagcaacatggttggaactggaggtcgttatcctaagtgaaatgacttaaaaacagaaagccaaaaaccctatgttctcattgtaagygggagctaaacaatggtacacatggacataccgaatggaataatatattctggagactccaaaaggtggaatactacctattgggtcccatgtcatgtatgctattcaggtgatggttacactggaagcccagacttcaccactaggcaatatatccatggaagaactgcacttgtaccctccaaatctataaactttttttaaaaaagcaatagagagacctcagcttttgcaagattaactctctttaggttagtcaataatagtataagtacatgttgttttattattctttgcttt

SEQ ID NO: 67021 - DNA, 601 bp, Human
atgacagagccagaccctgtctttaaaaaaaaaaaatttaaaaagtaggctaagaacatgaacagacattttccaaagatgacacataggtggctaacaaacatatgaataaatggtccaatcactaatcatcagagaaatgcaaaaaaaaaaaaaaaaaaaaaaaaaaaccaactgatgttggcaaggatgcagagaaaagggaacacttattcactgttggtggaaatgtaagttagcacaacctctacgaaaaacagtatagaaatttctcaaagaactacaagtagaactatacttsaatccagcaatcccactactgggtatctacccaaaggaaaagaaatcattctatcaaaaagacacttgcactccatatatttattgtagcactattcacaatagcaaaatcatggaatcaacctaagtgtccatcaatggatgactggagtttttaaaatgtggtatagatataccatggaatactacttagccataaagaagaataaaatcatgtattttgcagcaacatggttggaactggaggtcgttatcctaagtgaaatgacttaaaaacagaaagccaaaaaccctatgttct

SEQ ID NO: 67022 - DNA, 601 bp, Human
gaagcaaaagaagaatctaagcaaagatgaggaggagcgggggcattctgagtagacaatgtagcaagttcaatgcaaaaactctgaggtaggaaaagaacctggtatgtacaggaaataagaagtgtggctactgttacggaagtcaaaagatgagcatgaaacaaagtaaggtagacaggggctggccaaatcaagtgcttagggatttaggattctattccaagtgcaatggaaatccagtgaacagttttaagcaggatggccatatggtctgatctccatttttttttttttttttgagacagggtcttgctctgtctcccaggctggggtgcagtggcgtgatcttggctcactacaacctccacctcccaggttcaagcgattctcctgcctcagcctcctgggtagctgggattacaaggtgtgcaccaccatgcctggctaatttttgtatttttagtagagatggggttttgccatgttggccaggctgctgatttccattttttaaaagaccattattacatgaaaaaaaatgaattacattgagaaccaaattagaagcagaaaactatgcagtagttcagcaatggga

SEQ ID NO: 67023 - DNA, 601 bp, Human
ttaccacaattatgactaagaatttcaaataccagattgaatatctcattctccggattatagaaaaaaaggtatgggaaaggatcttcatcatccacattctatccatatgtagactctataccatatggtttactatttaatcaataaatcttctatttaaattaccaataattagtagttacattttcaattacttatagcataatttggaataaagaggagataaatggataaacaaaaggtggtctatacatataatgaagtattatttagccataaaaagaatgaaatgttgatmtatgctacaatgtagatgggccttgaaaatatgatgctaagtgaaataagccagacacatcaaggcaaatattatataattctacttacatgaaatatttagaatttttctagttctggaagtctagttctgcaaatggatggctatacaacattatgaatatatttaatcctactaaactgtacatctacgaatagttaaaatagtaaattctgatactttgtcataattaaaaattaaaattactaaggtctccaaaggccttttgtttatgttatagctatcagtatttactatatt

SEQ ID NO: 67024 - DNA, 601 bp, Human
ccccattccccttcttcccgtctctggttttacggtctttttggttgagtcaaaagatcttatttccttcctttcttctttcttcccactcctcttttgttctcaaagaacttagggtcaatttcctgcacaatctgtctgcacaggatatccacttaaacaccattctacccattagcaccaaacaaaaggaaaactttttcaaagagaaaaacaccctaacatttttctgaagctaagaacgaacatattttgaatcataaagagtaagggaactaaatgagggggaacaagataaggrataaaggcaaaaacaaaagaaaacaaaagcctgtgggaagagcaagtaaatgtcagtgttacccagtagctatagtctatgtcactttcctcattggttaagacagacatgtctggatgattcagatgtactgtatacgcccaaatgcaagtgtgtgggctgggaatggtttatttttgaacaaaatgaaatgactactataaattaggtaacttagatatcaagttaacttatcttccattattcactgctatagaggtagatcagagatttaagatgggataagagaagactgatttt

SEQ ID NO: 67025 - DNA, 601 bp, Human
atcagactgctgcactccaacttgggtgacaaagcaagactctgtctcaaaaaaaaaaaaaaaaaaaaaattaagtattggctgggcatagtggcacacaactgtagtcccagctacccaggaagctgaggtaggattgtctgagcctgggaggttgagcctgcagtgagccaagatcacaccattgtactccaatctagacaatagaacaaaaccctgtctttaagaaaaaaaaaaattagattaataggaattctgcactgatgacagtagagtgacagactgtcaatacgcaaggacatgtttataataaggggaaactctgaacccaaaagaggactcttaaagacaagtcaacttcctgaaagttgtgttatctgacaaaaggagaaaacagaatgagatctacagcacgattttatgtaaatttagaagatatatgcaggccaaacaatattatatttctgaaatatgtaaagtaataactataggataaaagtaatttttgaggccaaagtactaaaagaaccacaacttagaaaacaatccttcttattccccattccccttcttcccgtctctggttttacggtctttttgg

SEQ ID NO: 67026 - DNA, 601 bp, Human
ttgaggccaggagttcaagaccagcctgggcaacatcatgagacttcatcaggtgtggtggctagcgtctgtaatcccagcactttgggaggccgaggtggatcacctgaggtcaggagttcgagaccagtctggccaacatggcaaaaccctgactgggtgtggtggcgggtgcctgtaatcccaactactcgggaggctgaggcaggagaattgcttgaacccgggaggcagaggttgcagtgaactgagatcagactgctgcactccaacttgggtgacaaagcaagactctgtctcaaaaaaaaaaaaaaaaaaaaaattaagtattggctgggcatagtggcacacaactgtagtcccagctacccaggaagctgaggtaggattgtctgagcctgggaggttgagcctgcagtgagccaagatcacaccattgtactccaatctagacaatagaacaaaaccctgtctttaagaaaaaaaaaaattagattaataggaattctgcactgatgacagtagagtgacagactgtcaatacgcaaggacatgtttataataaggggaaactctgaacccaaaagaggactcttaaaga

SEQ ID NO: 67027 - DNA, 601 bp, Human
caggcacagtagctcatgcctataatctcagcactttgagaagccaaggcgggaggatcacttgaggccaggagttcaagaccagcctgggcaacatcatgagacttcatcaggtgtggtggctagcgtctgtaatcccagcactttgggaggccgaggtggatcacctgaggtcaggagttcgagaccagtctggccaacatggcaaaaccctgactgggtgtggtggcgggtgcctgtaatcccaactactcgggaggctgaggcaggagaattgcttgaacccgggaggcagaggttrcagtgaactgagatcagactgctgcactccaacttgggtgacaaagcaagactctgtctcaaaaaaaaaaaaaaaaaaaaaattaagtattggctgggcatagtggcacacaactgtagtcccagctacccaggaagctgaggtaggattgtctgagcctgggaggttgagcctgcagtgagccaagatcacaccattgtactccaatctagacaatagaacaaaaccctgtctttaagaaaaaaaaaaattagattaataggaattctgcactgatgacagtagagtgacagactgtca

SEQ ID NO: 67028 - DNA, 601 bp, Human
gaactgctcaagcaagggatctaggttgaatgctccttatgataatctaatgcctgatgatctgaggtggaacagtttcatgtgaaaccaccgctccccacccagtctgtgaaaaaattgacttccatgaaactggtccctggtgccaaaaaggttgggaccactgatgtagactatttcactagactcctgatttccatgcttccgtgcttgttccctactgtttattctcaacataccagccatctttcagagcataagtcagattgctactcctctgttcaagactcttcaaaggttycccattttagagtaaaagctaaaatccttaaaggccctgcaaggtccttcacaattggtcttgcccagcatctcctgctgctattcctctaccttattctggccactgacatcaatgctattgcttgaacaaagcaggcacacttctgcctcaggacctttgcgctggcttttccttttgcctaaaacactcttccccatgacatttcaccaaatgttaccttctcagtatgtcattctctgattattccattttaaagtacatctattcttgataacactctcacatcccccactgact

SEQ ID NO: 67029 - DNA, 601 bp, Human
caaccctgtgctccctgaaacatgtgctgcatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaataaataaataaataaataaataaataaataaataaaaataaaaataaaaatacaaaaattagccaggcatggtggcacatgcctataatcccagctacttcggaggctgaggcacgagaattgcttgagtctgggaggtggaggttgcagtgagccaagatcgccgctgtgctccagcctgggtgacaacagagtgagaccctgtctcaaaaaaaaaaaaaaaaaaggcttcataacttctacatgatatacacacagaaattcctgttgtaggttggctctgtaattctccagttt

SEQ ID NO: 67030 - DNA, 601 bp, Human
atggttactagctttataaaacatagaggatattttgttgtagtagtggttgtagttttaaggaagaaatgattgtaagtttcttacaagtccactcaaactacccttattcctttctctctccacagaaaacaaactgtagaaaagacaacagggattatttttcagaattaggtaatactgtataaatccaggccctctatttaagtatagaaaaaattatttaaaaagtgcttttagaaaaatatctttttttggccaacatggcaaaaaataatctttttttcgttttaaaaaaacwaaagaaatgtggccgcacccggcctgaatgacttttaaactctattttgttttcctgagcagtgattttttgtaaatatcaataacttaattgaagagcctagaaaacattactatcatcgggcatttattgagtttctactcaaagtggtccaagccttttacgacctgttttttccttaagcctttacagtttctaaatttattcatagtacatagcacaggtgatccctataccatcttaaagatcacctgcttctcacagcccagatcgattatacaaaaaacagtttttccagta

SEQ ID NO: 67031 - DNA, 601 bp, Human
cagctaatagttttaccttttggagcaaggctttctgcatgaagatagtagttcagtgtttcacattctggcataagcatcttaccttgttgtggaccatttttgagtagcactggcctagacaacataaatgtctattgtttgtgtttatatagattagtgaaaggaatggtaggaaaggtttatttgatttccattatagtaatattctcaagagagtggtagtttatttccgtgggaaattcttataaaagggaacattaagaacatgaccaaataaaatcaatcattattgattttttgtgtgtgtgtgtgtgtgtgtgtgtgtgtgtgtgtgtacgcacacacgcatgcaaaggcaaaaaaaagtaacttttatgagaaagaaataggattatggggagattatccttgtgtacatgaactggattgctagtctgcctaagcttattcttaccttttgaacatatgaaagccactgccggggaaaaaaatgtatttcaggataatttttttttttttttcttttttgagatggagtctcactctgtcacccaggctggagtgcagtggtgtgatctcagctcactgcaacctctgc

SEQ ID NO: 67032 - DNA, 601 bp, Human
ctgtaatcccagcactttgggaggctgagaggggcggatcacctaaggtcaggagttcaaaaccagcctggccaacatggtgaaacctcatctctaccaaaaatacaaaaaattagccgggtgtgatagtctgcatgcctgtaatcccagctactcgggaggctgaggcaggagaattgcttgaacccgggaggctgaggttgcagtgagccgagattgcaccactgtactccagcctgggagacagagtgagactgctaaaaaaaaaaaaaaaaagcacatggccagaagtatcaggcaraagtttttaggagaactaaaaataattatccttgtaaccatctgtccttttttagtggccttcagaaacgtttccatagaataactttgtatcagacaccatctcaccttagacacatggatatgagataatgagaaaaaacacaagagtatatgtacatatatacacctatgggtacataaaatatacatatatacagataagagtaagtctggtgtagcggtggatatgcataagtgcacaaatacttgccaatcatatttacaggaagaaaaaaaaaagaatcctgctagaaaaact

SEQ ID NO: 67033 - DNA, 601 bp, Human
atcaaaagcacatggccatggctgagcgtggtgtctcatgcctgtaatcccagcactttgggaggctgagaggggcggatcacctaaggtcaggagttcaaaaccagcctggccaacatggtgaaacctcatctctaccaaaaatacaaaaaattagccgggtgtgatagtctgcatgcctgtaatcccagctactcgggaggctgaggcaggagaattgcttgaacccgggaggctgaggttgcagtgagccgagattgcaccactgtactccagcctgggagacagagtgagactgctaaaaaaaaaaaaaaaaagcacatggccagaagtatcaggcaaaagtttttaggagaactaaaaataattatccttgtaaccatctgtccttttttagtggccttcagaaacgtttccatagaataactttgtatcagacaccatctcaccttagacacatggatatgagataatgagaaaaaacacaagagtatatgtacatatatacacctatgggtacataaaatatacatatatacagataagagtaagtctggtgtagcggtggatatgcataagtgcacaaatacttgccaatcat

SEQ ID NO: 67034 - DNA, 601 bp, Human
ttcttcctaaattagtcttgggaaaaaccttccaagatctctctctggataatcaagctcattggtcttcaaatatatatatattttcaaatatatatatactcaaattatgtattttttcaaatatatatttctttttctttttttcttttttttgagacagagtctcactctgttgcccaggctggagtgcagtgtcatgacctcagctcactgcaacctccgcctcctgggttcaagtgattctcctgcctcagcctcccaagtacctgggattacaggcatgcgccatcacgcctgrctaatttttttctttgtatttttagtagagatggggtttcaccatgttagccaggctggtcaggaactcctaacctcaagtgatctgcctgcctcagtctcccaaattgctgggattacaggtgtgaactaccacgcccggccagtcttcaaatatttttaagccacaagactatggactcaactacagaagatacgtaaagaagagataccctgatcaaagtaggcaagcaaggacttggcctcttgtagaaatttacaaaatatcaccttaatcttgtaaaaaacataacttgaaaac

SEQ ID NO: 67035 - DNA, 601 bp, Human
attttctgggaaggttctcacattcttccttttatctgcatgtcaagcaagatggcttcatggttggtcagaggtaagttttacacacctatggatgaaattcttcttctctaagtactccattgcagaagaaatctgagtggccatgtagagcagcacaactgcagtcacctcttctcggttgcattctcggaggtaatccagcaaattcccgtatggcatgtattcagtcacaatgtaaaatggtggctccaaagtacacacacctaaaagttgaacaatagtgcttgtttttattagygtacattcaaacactccaaaccactttggccaagaataatttgacaatttttcaggtctagttcggcaataatcttttcccttcttaccaccacgttctctgaaattaataagcaaaaactaagaagctggtttataagggagtccttgctttcactgtattgttctctgggaattcatatgcctctgagtatttgtctatttgagcaaaagcagagttacctgtattaattctataaggggccaagaaaaccaacatgtctagagttttgcacatggcccatgattctcctcaactgca

SEQ ID NO: 67036 - DNA, 601 bp, Human
ctgctagcttatgccttcaaaattaaaacatgcaaaaatactcacatgctctcataagttcataaaccttaggggggcatccctcaggctgttccattcgatatcctttttctagtaggtcatagacctgagacaggtcaatacctggatatggtgacattccataggtagcaatttcccacaacaataccccaaaagctgcataaggaattaaaaaaagcacttagtgtttcttctccgattatttattttacataattaggtgattctctttcatattttaggtaacattcacacactrttacaacaacattaatatataatatactcttttatcaattcttacagcatgatttgtccttctaaaatatttgcaacaggaatgctgcagataatctcaagacagttttatttaaatttcccaatttttatttagatttcctttactgtaatgagggaaaataaactatgaccatttaagaagtctgaggcataatccaactattcttagaaaagtttttgatatacagtagtcaccccttatccatggtttcacttcccacagtttcagctactcacagtcaaccaaggtccaaaaata

SEQ ID NO: 67037 - DNA, 601 bp, Human
tagtgagagtccgtctcaaaaaaaaaaaaattagctgggcatggtgtgcgtgcctgtggttccagctactgaggggctgaggcatgagaatcacttgaacccatgaggtagaggtttcagtgagccgaaatcacgtcactgagccgaaatcacgtcactgcactccagcctgggcaacaaagcaagagtgtttgaaaaacaacaacacaaataaacaaacaaacaaaaccctgcaatttaatccactattcactttcctactttttcatctgcaagcaatcggatgcttctgtttatctaccacagaggttatttttatgcattcttcatagtctttagcaatcatttttatctagttgaaaacggccctccccaccttaatctctaaactcaatttcttatcttattaaatatgcaaatgtctctgagaaactgggtcaatatttgggccataacaactatgcttaggattccaataagattcaatggtatatgatatgacaactggctgatcaatgataaactctttaaatgtcatgaggctggattcaatctaacaacactgagaggagaaatgtttctaattttgttaactattctg

SEQ ID NO: 67038 - DNA, 601 bp, Human
cacttgaggttaggagttcaagaccagcctggccaacatgccaaaaccccatctctaccaaaaatacaaaaattagccaggcgtggtggcaggtgcctgtaatcccagcaacttgggaggctgaggcaggagaatcgcttgaacctgggggacggaggttgcaaagattgtgccactgcactccagcatgggcaacatagtgagagtccgtctcaaaaaaaaaaaaattagctgggcatggtgtgcgtgcctgtggttccagctactgaggggctgaggcatgagaatcacttgaacccakgaggtagaggtttcagtgagccgaaatcacgtcactgagccgaaatcacgtcactgcactccagcctgggcaacaaagcaagagtgtttgaaaaacaacaacacaaataaacaaacaaacaaaaccctgcaatttaatccactattcactttcctactttttcatctgcaagcaatcggatgcttctgtttatctaccacagaggttatttttatgcattcttcatagtctttagcaatcatttttatctagttgaaaacggccctccccaccttaatctctaaactcaatttcttatct

SEQ ID NO: 67039 - DNA, 601 bp, Human
tttttatgtagatgggattttgccacattgctcaggttgcttttgaactcctgagctcaagcaatctgctcacttcggcctcccaaactgctagaattacaggtgtgagccactgcacctggccattaacccactttctaaggctggtgcttcgatttagcctcagctcctattccctctaataaaaggatgaggagaaacaaggagatgttttagaaaatggcaagttttcttccacttgaaaataaaagaagtaaaacctgtcttcaaactcagcctaaccatataatcaactgtatayattcagaaatataaaaggatatcaaaaaggaggatctcagagttcatttttgacaaagtgcaacagagaacgtcaatgttcaatgaggaaacaacacagacttatgttcaaacacaactgcaattaggaccaggcctggtggcccacatctgtaatcccagcattttgggagactgagtcgggcagatcacttgagaccaggagttcgagaccagcctggccaacatggtgaaaccttgtctctactaaaagtacaggccgggtgctgtggctcaagcctgtaatcccagcactttggga

SEQ ID NO: 67040 - DNA, 601 bp, Human
gaggatcacttgaacccaggagctggaagttgcagtgagctgagatcacaccactgcactccagtttggatgatagagtgagatcctatctttaaaaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacagrtggtggaggacaggaagagtagggagaccaggaaggggctgctgtgagagtcctgatgaggggacgaggtctggagctgtgggtcaggcctctgctgggtgcacaggactgagcctttgggccaccctgggcagctgaagctaaggggtgcgggtgttcataggcacctcataggcagtggcatctttgagcaggtttcataacaggcggttcaggtacacacagacctcccaggccactcaaggaaggtgttccagagtggagccactggggaatttttacattttctaaaattctttt

SEQ ID NO: 67041 - DNA, 601 bp, Human
tatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcrgtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatgg

SEQ ID NO: 67042 - DNA, 601 bp, Human
gtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcagtggggaaacrggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatggctcacgcctgt

SEQ ID NO: 67043 - DNA, 601 bp, Human
ctaggggcagaatgtgtgcattctggaggtagagggggtggtctctcctgcaggcagaaggcagaggcagggttagaaaaccacaccccttcggggggactgtggcagactgatacttgggacatccaatggaggcctgtgaggtcaggggcggggctagctccagggggggccccaggagccccaacagtagttcagagcatgcggtgtcctggaagaagctacaagcggtgagtgatagcctctctccagctgaggccttcttcccatcacaactctttctgtctcctccctgccaacytagagccctctccctgaggtgtccaagtgcagccctccctgccccaagggcccttgctcacagggaacctgcacctaggactctgcctgctgggtgctaagacactgaggttctggttctcttcgtatctgggttcccagctctcttcttaaaagccaatgtggtggttttgatgtgtgagaaactcctgcctggttgggtgctgtctttctattcttcactttttgtcttatgaaaaacaaattaaaccatctccttacccgaatcttgagaggaaacagcctccctgtctccagtccc

SEQ ID NO: 67044 - DNA, 601 bp, Human
ttcccatcacaactctttctgtctcctccctgccaacctagagccctctccctgaggtgtccaagtgcagccctccctgccccaagggcccttgctcacagggaacctgcacctaggactctgcctgctgggtgctaagacactgaggttctggttctcttcgtatctgggttcccagctctcttcttaaaagccaatgtggtggttttgatgtgtgagaaactcctgcctggttgggtgctgtctttctattcttcactttttgtcttatgaaaaacaaattaaaccatctccttacccraatcttgagaggaaacagcctccctgtctccagtccccacgtcctttcctcccatctcctcaggagtccattctccaaaaggtctctccatcattgggtcaggagcctcctctcctgtggcttctgcacctgctctcctctttctctggatgggaatgtctggttccttccctgaggatgtgttctagaagcttcagcttcacagtgatgactgccggatgccttagcgcctgcgctcctgcagccaggatccctatcatgctgccctctctgcctttcaggagcgatgggcttttgggg

SEQ ID NO: 67045 - DNA, 601 bp, Human
actgaggttctggttctcttcgtatctgggttcccagctctcttcttaaaagccaatgtggtggttttgatgtgtgagaaactcctgcctggttgggtgctgtctttctattcttcactttttgtcttatgaaaaacaaattaaaccatctccttacccgaatcttgagaggaaacagcctccctgtctccagtccccacgtcctttcctcccatctcctcaggagtccattctccaaaaggtctctccatcattgggtcaggagcctcctctcctgtggcttctgcacctgctctcctcyttctctggatgggaatgtctggttccttccctgaggatgtgttctagaagcttcagcttcacagtgatgactgccggatgccttagcgcctgcgctcctgcagccaggatccctatcatgctgccctctctgcctttcaggagcgatgggcttttgggggaggacccactagctttctaagctctcccgtgaaactgtgtcatgctccatcccttagtgccggcgttgactgggttttgtggtgatccttgtctggaatgaagaaagcctggcttgcgcagaggtgtttccctgcagagg

SEQ ID NO: 67046 - DNA, 601 bp, Human
agggctctggagccagaaccagttggcctcctccagccctaccccaggtaagcccctcgctgtcctgcatacacctgtaacatggtgtcttctctgggctggggctcgaggagtccagcctgagcagggcccctacctcccactgttccttccaggttccctcccccagggccccgcacagctcagccctggggagatggaagagtctgatcaggggcacacaggtgagtcgggcgggggcactcgtgcctcagccccactgtagcccttgatttcctgcctgaatggtacagtgagttgrcgctgggattcctggccctgccctcctttgccttctctgtccccacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggtatgggcgccctgccctgtgtgaactgtcggctttcttcccaactccgctcctgagtctccacctgtgtgcccggttcccgcgcaa

SEQ ID NO: 67047 - DNA, 601 bp, Human
ctcccaaagtgctaggattacaggcgtgagccaccgcacccggcgaaaattgtattccttaatgaatcctcagctggatataactgcttttctttgtgatgctgtgcaggtttttttcacttcatgtactcatggagcctatgcaatttttaaatacatttaaacatattcaggccgggtttggtgtctccgttctgtaatctcaacattttgggaggccaagccgggcagatcatttgaggtcagaagttggagagcagtctgaccaacatggtaaaaccttgtctaaaatacaaaaaaattagcagggcatggtggcaggcgcctgtaatctcagctgttcgggaggctgaggcaacagaattgcttgaatcttggaggcggagtttgcagtgagcctaggtcgtaccagtgagcctgggtgacagagcaagactctgtcttaaaaaaagaaaaaaaaaaacattcagcgagaggtttctgggattcatcagactgctgaggagtttgtggcaccaaaaagattaagaatctttgcagtgtagattatgccaacaacggaggcagcccaccagttatttttatgccgtttaaccgtagg

SEQ ID NO: 67048 - DNA, 601 bp, Human
aaatgctgggattacaggcatgagccaccgcgcctggcctccccaccttctttatgtcctgtctggaacacagcaccccgctctccccagtagagaagtgacgccactaactgggggttatcacatctttgtttttggttttggtttttgtttttgagactgagttttttgttttcgttgcccaggctggagtgcaatgtcacgatctcggctcactgcaacctcttctgcctgctgggttcaagcaattctcctgtctcagcctcactagtagctgggattacaggcacccgccaccatrcccagctaattttttgtatttttttttttttttagtaaagacaaggtttcaccatgttgatcaggctgatcttgaactcctgacctcaggtgatccacccacctcagcctcccaaagtgctggaattacaggcgtgagccactgtgcccggcctcacatctttgttttttaccaccatgtttattattttattttattttatatatgttatgttgttatgttattgatggagtctgtttcttgttgcccaagttggagtgcaatggcacgatctcagctcattgcaacctctgcctcccg

SEQ ID NO: 67049 - DNA, 601 bp, Human
gaacattttcaaagcagagataataattcattgacctcaaatacatccatcacccaaagtgaatagttatcaggatttatccacggtttcttcatctaccccttttcgttttcttctttcctttgctgaagtattctaaagcaagtcccagacacgtcatttcacccctgcctacttcagtgtggacttctaaataatgacacagtaagacagtcctttcagccctgatctgaccaaatctgtcgtcaatatttaatagctctttgctatgcccctgccctttgtttaaaaaaaaaaaaaagtttttaaagacaaggtctcatgatgttgcccaggctagactcgaactcctgggctcaagtgttcctcctgtctcagcctcctgagtagcttggactacaggcatgtgccactgtgcctgtctctctctctctctctctctctctctctctctttgtcgccctctcgctctctcttgctctctttctctctcgctctctctttctcactctttctctctttctttcctttctttcttttctttcttgagccttgctctgttgcccagactggagtgcagtagcatgatctcagctcactg

SEQ ID NO: 67050 - DNA, 601 bp, Human
agctaccgcacccagctgaatctttcaaaataaaaaaaattaccctttaacttggcaattccacatctagggatgctacaaaaatcttcatgtacaaagatgcccattgcagagttgttcgtaatggagaatatttggaaataacccaagttaaaacattgatcttgatagtctttatggagactatggtgatctacatgctagcacacagaaagaatgctaagacacaggaaaagtaagttgcagaacaatctatatagtaggagtcaatttgcaaggatggagtttttatggtgtggtrtgtgtatgtaaataaagtaggcacataccgctggcacttattatgggccagctatgttgttagacctttttttttttttttttttgagatggagtcttgctctgtctcccaggctggagtgcagtggtgcaatctcagctcactgcaacctccgccttccaggttcaggcgattcccctgcctcagcctcccgagtgtctgggattacaggcgcctgccaccatgcccagctgatttttgtatttttagtagagacagagtttcaccatgttggccaggctggtctcaaactcctgacct

SEQ ID NO: 67051 - DNA, 601 bp, Human
acaaagagtagagtgttactttcagggagtgttaacttgacataggccttatatgggccttttcattttttttttttttttttttttagagacagtcttgctctgtcaggctggagtgcggtgtgcagtggtagcatcatagctcactgcagcctcgaactcctgggttcaagcagttctcccacctcagcctccctagtagctgtgactacaggtgcatgccaccatgcctggctaagttttgtattttttgtagagacagggttttgccacattcaccaggctggtctcaaactcctgrgctcaagcgatcctcccacctttgcctcccaaagtgctggaattataggcgtgagccaccatgcccggcttattttttattttttgtagagatgggggtcttgccgtgttgtccaggttggtctcaaactcctgagctcaagcagtcctcccacatcggccccgcaaagtgctgggatgacaggtgcgagtcaccacacccagcctccatcattgtttatactgagcatcgcctgtggtcagtggtgggattgcactgtgtattgtttggcaccttttttgcacttgactatgtatcttg

SEQ ID NO: 67052 - DNA, 601 bp, Human; identical to SEQ ID NO: 27273

SEQ ID NO: 67053 - DNA, 601 bp, Human; identical to SEQ ID NO: 27274

SEQ ID NO: 67054 - DNA, 601 bp, Human; identical to SEQ ID NO: 27275

SEQ ID NO: 67055 - DNA, 601 bp, Human; identical to SEQ ID NO: 27276

SEQ ID NO: 67056 - DNA, 601 bp, Human; identical to SEQ ID NO: 27277

SEQ ID NO: 67057 - DNA, 601 bp, Human; identical to SEQ ID NO: 27278

SEQ ID NO: 67058 - DNA, 601 bp, Human; identical to SEQ ID NO: 27279

SEQ ID NO: 67059 - DNA, 601 bp, Human; identical to SEQ ID NO: 27280

SEQ ID NO: 67060 - DNA, 601 bp, Human; identical to SEQ ID NO: 27281

SEQ ID NO: 67061 - DNA, 601 bp, Human; identical to SEQ ID NO: 27282

SEQ ID NO: 67062 - DNA, 601 bp, Human; identical to SEQ ID NO: 27283

SEQ ID NO: 67063 - DNA, 601 bp, Human; identical to SEQ ID NO: 27284

SEQ ID NO: 67064 - DNA, 601 bp, Human; identical to SEQ ID NO: 27285

SEQ ID NO: 67065 - DNA, 601 bp, Human; identical to SEQ ID NO: 27286

SEQ ID NO: 67066 - DNA, 601 bp, Human; identical to SEQ ID NO: 27287

SEQ ID NO: 67067 - DNA, 601 bp, Human
ctgggagaagagtgctcctggcagggagaacagcaggtgcaaaggccctgaggtgaggacaggcccgaactgtcggaggaacagcagggaggacaccataactgcagaggagtgaacaaggaaagagggctaacgaacaagcttagaaaggtaacaaggcccgatgtaacagggccgtagagacacgggaagggcttgggcattgcctgcctggccttggctttcccacccttgttttgtgtttggggaaccactcctctcccctacaccatcagttgcagtgaggtccctggctaagatygggtaagtaagcccagacctggccaatcaaggtcttccatcccccagccccagtgactggctcagggataaatgagtgacccaatccagtgctactgcaaaagaggcactctctttttgtggggtggctaagcaggtgggagttaagtttgagctgctggagcaggggtgtgtgtgtccccaagtgaagggagtgcctgcaaataaagccagcaaagagaacagcagagctgagacatggagaaaggaaaattcctaatgacactgagctcctggatctggctagacctgaagcttaatt

SEQ ID NO: 67068 - DNA, 601 bp, Human
atttacttgaccaagcgtgaccacctcctacgtgcctgggatatagcagagacaaaagagacaaaaatccctgtccttgaggagctgacattctagtgagggtgacagaaaataaagaaacgaattatatagtgtgttagaaagtggaaaaaaacatattaagcttggtgaaggaaacggtgactcgattttaagtgtacccagggaagggcttattgagaaggtgatatctgagcagagacctgtaagaggtgagagagtcagccacgtggaaagctgggagaagagtgctcctggcagrgagaacagcaggtgcaaaggccctgaggtgaggacaggcccgaactgtcggaggaacagcagggaggacaccataactgcagaggagtgaacaaggaaagagggctaacgaacaagcttagaaaggtaacaaggcccgatgtaacagggccgtagagacacgggaagggcttgggcattgcctgcctggccttggctttcccacccttgttttgtgtttggggaaccactcctctcccctacaccatcagttgcagtgaggtccctggctaagattgggtaagtaagcccagacctggcc

SEQ ID NO: 67069 - DNA, 601 bp, Human
tggctgcaatggccttggcggtgatggggtggtcacccgttaccatgatcacctgtagggggaaccagtggatcactgaccccttcagatcagcccaatctccctgtcctccctgggagacatctgctgatacacgtgttcatttacttgaccaagcgtgaccacctcctacgtgcctgggatatagcagagacaaaagagacaaaaatccctgtccttgaggagctgacattctagtgagggtgacagaaaataaagaaacgaattatatagtgtgttagaaagtggaaaaaaacatatyaagcttggtgaaggaaacggtgactcgattttaagtgtacccagggaagggcttattgagaaggtgatatctgagcagagacctgtaagaggtgagagagtcagccacgtggaaagctgggagaagagtgctcctggcagggagaacagcaggtgcaaaggccctgaggtgaggacaggcccgaactgtcggaggaacagcagggaggacaccataactgcagaggagtgaacaaggaaagagggctaacgaacaagcttagaaaggtaacaaggcccgatgtaacagggccgtagagac

SEQ ID NO: 67070 - DNA, 601 bp, Human
ggtttatttgtccgtgtctgtttaggggcacgtgtctgtgattcaagtttggccagatacctgttctgtttccatctctgtctgagtatctgtatctgagtcatgtgtgtgcatgggtcggcccgggcctacctgagtgtccgcctgtgtgtgcatggctgtaggtatgtccatttaggtctgttcacctgcctgccacccatgtgtcctgcactggctgtcattgcacacacaggtcttgtctgtcactctgtgcccaagagtgtctgtggtggtctctgtccctcctgtccatctgcargcaagtgtctctgggcaccctgtggatgggtaccctgggctgtggacttacaatgtcagtgcagagttcgatgaagaggatggtgatgcacccgaggggcaggggcacgctgacggtgatgtagatgaggtagggtgtcagctctgggatgttcttggtcaatgtgtaggcaatagacttcttcaggttgtcgaagatcagtcgacctgtggggtagggtgggcacctcagcctcctcacagccctctccctcctgtgcccacactgcctgccctccccctggcgtggctcggaccctgc

SEQ ID NO: 67071 - DNA, 601 bp, Human
ggccacttatttgcccagtgacctgggacaatccactctacctgtctatgccttgatgagctcatcagtaaagtacgggtgatagtaacaaaactcatctcatagtgtggttatgagtacaaaattaaggaaatgatggtgtgtctggcccagagaaagcactgtgtaaatgttaccgaataaatacctgtcaacacagctgcgcctctggctgcattcgtgactgtatctgtggttcttttctgtctgtctgccatggggtctatctgagggggtttatttgtccgtgtctgtttagggrcacgtgtctgtgattcaagtttggccagatacctgttctgtttccatctctgtctgagtatctgtatctgagtcatgtgtgtgcatgggtcggcccgggcctacctgagtgtccgcctgtgtgtgcatggctgtaggtatgtccatttaggtctgttcacctgcctgccacccatgtgtcctgcactggctgtcattgcacacacaggtcttgtctgtcactctgtgcccaagagtgtctgtggtggtctctgtccctcctgtccatctgcaggcaagtgtctctgggcaccctgtggat

SEQ ID NO: 67072 - DNA, 601 bp, Human
cgtgccccttcatctgcttgtgcctagagtggcagcagagcatactgaccacgaccacaggctgtgggacctgtgactgctcaagctcaagtcacagccgggccacttatttgcccagtgacctgggacaatccactctacctgtctatgccttgatgagctcatcagtaaagtacgggtgatagtaacaaaactcatctcatagtgtggttatgagtacaaaattaaggaaatgatggtgtgtctggcccagagaaagcactgtgtaaatgttaccgaataaatacctgtcaacacagcygcgcctctggctgcattcgtgactgtatctgtggttcttttctgtctgtctgccatggggtctatctgagggggtttatttgtccgtgtctgtttaggggcacgtgtctgtgattcaagtttggccagatacctgttctgtttccatctctgtctgagtatctgtatctgagtcatgtgtgtgcatgggtcggcccgggcctacctgagtgtccgcctgtgtgtgcatggctgtaggtatgtccatttaggtctgttcacctgcctgccacccatgtgtcctgcactggctgtcattgca

SEQ ID NO: 67073 - DNA, 601 bp, Human
agggacacagatgggaactggccaggagtggaaggaactgggactgagggtttggctgggcccttgtcccctccacttcgggtcccccttcccccacttgtgagcaggaacaggactgaggttagcaggcaggacctgcagggacggcacagccacaccagcctggacagcctgggccccactggcccctgggtgttggcatcctggtgcccatcttcgtaagaacatctgcttttatcttctccctctgtctccctccctctctttctctgttcctcactctgtttctctgtccctgtcaccagtgtaattctctgtgactgtatctgctcttgtgtatttctgtgtcactccctatctctgtgtatcttcagtctctcagtgtcgccgtgccccttcatctgcttgtgcctagagtggcagcagagcatactgaccacgaccacaggctgtgggacctgtgactgctcaagctcaagtcacagccgggccacttatttgcccagtgacctgggacaatccactctacctgtctatgccttgatgagctcatcagtaaagtacgggtgatagtaacaaaactcatctcatagtgtggtta

SEQ ID NO: 67074 - DNA, 601 bp, Human
ggacacagatacacaaggtcaaggacacacagagccagggacacagaaacagtgacagagacacagaggcagagagagaagcagggacagagagacagaggcagggacagagagaaaaagacacatccaggacccaaaaagacagaaataggcaacaactcagagacagggtcatggagagcaaggtcagagagagagcagggacacagcagaaccagagagactgtcacaaacagagagggacacggaggacaacggagacccaggaccaaatgcagacactgaggtccagaaccagccrgagcccaaggcagggcctggggcaggcgagcagcccagcgcagagccccccacctccaggctccccggcccacgggcacccaccaatctggaagtaggagtaggcagccaggggctcgttgaccaatctgtcacgctttgggttgcgtggacgcaggtgcatgatgtcactctcggccttttcatatgccagggacacagatgggaactggccaggagtggaaggaactgggactgagggtttggctgggcccttgtcccctccacttcgggtcccccttcccccacttgtgagcaggaa

SEQ ID NO: 67075 - DNA, 601 bp, Human
taccttaaccatgatagtaaatgtttaagggaagtatcctcgtctgtatgtaactctacaggtgaactaaacacatctgctggccagatctagcctcactgtgctccaaaccttcattaaaatagaccacatgtgcaaataccctgtgggagtgatgctgtagggaaaatagcagaataggggcctggttccacatctgagatgatgcattagtgtcagggcagagacacccatctgcagttgcgatcatcagaagcaggagtttggagctggagatggtgggaaaggcccttgcccccccgaactggcagggagtctgggggtccgggatgctctggctgaactcagtcacacgtggaggaacaagtgggccgcacacaaggcaagttgccctgggaaggagggagcccagggatgggatggggcggggcagggctcacccactcctggccgtagctgtcctgcagatcttgtaggtggtggtcctcccactgcgcccgcagccccacgcacagcagtgggaaccagccctcctgggccattgccgtgaagtagtcagtgaagccagcaaaggactgaatggcacctggagagagacaag

SEQ ID NO: 67076 - DNA, 601 bp, Human
ttgaaatcctcagatgggatttgcaaagtccagtgactccaggggccaggcagatggcaaaaataggtgaggcagtcaccgcgggcctttgggaaaagagggcagatgccccatttaaagggggcagccactatgcagcccatttcttcaacacagctacttttttttttgagatggaatctcgctctgtcacccaggctggagtgcagtggtgcaatctcagctcactgcaacttccgaatcccaggttcaggagattctcctgccttagcctcccaagtagctggaattacaagcatgygccaccatgcctggcaacacaactcctaataccagctaactgtggggatcactgactgctccaggtgccgagtgttgcacgtgcattagctcatttaatccgctgggtaaccctaggaggtaaatcagtggtgctggaacttgaacatgcatgagaatcccagcaagggctcccagagggctgggatagagcctgagaatttgcactgcaaacatgttcccaggagatggtgatgctgctggtctgggagcaaactgaaaaccactgaggtagactttgatattctctccactttgcagg

SEQ ID NO: 67077 - DNA, 601 bp, Human
tgtcaccatctggcactggcacccgctggcatttgccggctgttctaaaccacagtcaggatctgatgggagttgggaccaggggttggagggcaggaagagggccagccagggacacctgaagaagccttgctggaaggcagagagacggcgcgtcttgcggatgaggacatcggcgatctggcacacctcaatgctgatgaagaacacggtgtagcaggtgtactgctggtacaggcgctgcccgaatgtctgcaggccaggggcaaacggaaacagcctgagtccagcctgagtcccrgcggagagcctctgcagcccaccgggcatagggtcccagggccgtgaacccctaaatgctctctctgccttgcatcagagtgtgggggtggggggaaggagagaggcagggtctgccaggtgtgcaggaccccagaacgtggggcccagaaacctcagcctagcagagcttggatgacagtggccgggaaaactgtaggctgggccgactgctttcatagtgaaaggggggaggcacccaaaagaaagggcctgggaaaggggaattgaaatcctcagatgggatttgcaaagtccagtg

SEQ ID NO: 67078 - DNA, 601 bp, Human; identical to SEQ ID NO: 24797

SEQ ID NO: 67079 - DNA, 601 bp, Human; identical to SEQ ID NO: 24798

SEQ ID NO: 67080 - DNA, 601 bp, Human; identical to SEQ ID NO: 24799

SEQ ID NO: 67081 - DNA, 601 bp, Human; identical to SEQ ID NO: 24800

SEQ ID NO: 67082 - DNA, 601 bp, Human; identical to SEQ ID NO: 24801

SEQ ID NO: 67083 - DNA, 601 bp, Human; identical to SEQ ID NO: 24802

SEQ ID NO: 67084 - DNA, 601 bp, Human; identical to SEQ ID NO: 24803

SEQ ID NO: 67085 - DNA, 601 bp, Human; identical to SEQ ID NO: 24804

SEQ ID NO: 67086 - DNA, 601 bp, Human; identical to SEQ ID NO: 24805

SEQ ID NO: 67087 - DNA, 601 bp, Human; identical to SEQ ID NO: 24806

SEQ ID NO: 67088 - DNA, 601 bp, Human; identical to SEQ ID NO: 24807

SEQ ID NO: 67089 - DNA, 601 bp, Human; identical to SEQ ID NO: 24808

SEQ ID NO: 67090 - DNA, 601 bp, Human; identical to SEQ ID NO: 24809

SEQ ID NO: 67091 - DNA, 601 bp, Human; identical to SEQ ID NO: 24810

SEQ ID NO: 67092 - DNA, 601 bp, Human; identical to SEQ ID NO: 24811

SEQ ID NO: 67093 - DNA, 601 bp, Human; identical to SEQ ID NO: 24812

SEQ ID NO: 67094 - DNA, 601 bp, Human; identical to SEQ ID NO: 24813

SEQ ID NO: 67095 - DNA, 601 bp, Human; identical to SEQ ID NO: 24814

SEQ ID NO: 67096 - DNA, 601 bp, Human; identical to SEQ ID NO: 24815

SEQ ID NO: 67097 - DNA, 601 bp, Human; identical to SEQ ID NO: 24816

SEQ ID NO: 67098 - DNA, 601 bp, Human; identical to SEQ ID NO: 24817

SEQ ID NO: 67099 - DNA, 601 bp, Human; identical to SEQ ID NO: 24818

SEQ ID NO: 67100 - DNA, 601 bp, Human; identical to SEQ ID NO: 24819

SEQ ID NO: 67101 - DNA, 601 bp, Human; identical to SEQ ID NO: 24820

SEQ ID NO: 67102 - DNA, 601 bp, Human
gcactttgggaggccgaggtgggtggatcacaaggtagggagatcgagaccagcctgaccaacacggtgaaaccccatctctaccaaaataccaaaaattagccagatgtggtggtgcgtgcctgtagtccctgctactcgggaggctgaggcaggggaattgcatgaaaccaggaggtggagactgcagtgagctgagatcatgccactgcactccagactggcgacagagtgagacgccatctcaaacaaataaacaaacaaacaaaaccaaaaattagctgggcatggtggcacacasctataatcccagctactcgggaggctgaggcatgagaatcgcttgaacccaggaggcagaggttgcagtgagctgagatcgggccactgcactccagcctggatgacagagcaagactcattgtcaataaataaataaatataaataaaataaataaataaatcatgcctgtaatcccagcactttgggacgccaaggcgggcagatcacttgaggccaggagttcgagatcagcctggtcaacgtggcgaaaccccgtctctactcaaaatacaaaaaaattagccgggtgtggtggca

SEQ ID NO: 67103 - DNA, 601 bp, Human
gcgggcagatcacttgaggccaggagttcgagatcagcctggtcaacgtggcgaaaccccgtctctactcaaaatacaaaaaaattagccgggtgtggtggcatgtgcctgtaatcccagctactggggaggctgaggcaggagaatcgcttgaaaccaggaggtggaggctgcagtgagccaggattgcactattgcaccccagcctgggcaacaagaacaaaactccgtctcaaaaaaaaaaaaattctgatctctgaaacctcggggtcttctcattcccgtagcttgtttccccaaytacctttccctgattatggccccgttggcctaagcccggggatgctagcctgggagggtcttctgggatccccgagctctgggttgggggctggagaaggtctcaagtcttctggactcgcgtttgtctgccccgggcaaagagcttgatcatcccgtgatggttgctatcgtcctttcctcgttcagtgggaagaggccgcccgagaggaaagagagagaacatcgagtgggatggtggggacccccaggaactgcaccttcactgggggccctttctttcttttttcttttcttattt

SEQ ID NO: 67104 - DNA, 601 bp, Human
gtcaacgtggcgaaaccccgtctctactcaaaatacaaaaaaattagccgggtgtggtggcatgtgcctgtaatcccagctactggggaggctgaggcaggagaatcgcttgaaaccaggaggtggaggctgcagtgagccaggattgcactattgcaccccagcctgggcaacaagaacaaaactccgtctcaaaaaaaaaaaaattctgatctctgaaacctcggggtcttctcattcccgtagcttgtttccccaattacctttccctgattatggccccgttggcctaagcccggggatgctagcctgggagggtcttctgggatccccgagctctgggttgggggctggagaaggtctcaagtcttctggactcgcgtttgtctgccccgggcaaagagcttgatcatcccgtgatggttgctatcgtcctttcctcgttcagtgggaagaggccgcccgagaggaaagagagagaacatcgagtgggatggtggggacccccaggaactgcaccttcactgggggccctttctttcttttttcttttcttatttttatttttatttttttgagacggagtcttgctctgtcaccc

SEQ ID NO: 67105 - DNA, 601 bp, Human
gtggttcattcctgtaatcttagcactttgggaggcctaggtgggaggattgcttgagcttaggagtttcagaccagcctgggcaacttagcaagacccagtctctaaaaaaaataaataaataaaataattagccaggcatggtggtgcgcacctgtagttccaactacttgggatgctgaggtgagaggatcacttgagcctgggaggttgaggctgcagtgagctatgatcatgccactgcactccagcctgggtgacagagcaaagctgactctgtctcaaaaaaaaaaaaaaaaaatgccgggtgcagtggctcatgcctgtaatcccagcactttgggaggccgaggtgggcagatcatgaggtcaggaggttgagaacatcctggctaacacggtgaaaccccatctctactaaaaatataaaaaatcaggtctgggcgcggtggctcatgcctgcaatcacagcactttggggggccgaggagggtggatcacgaggtcaggagatggagaccatcctggctaacgtggtgaaaccccatctctactaaaaatacaaaaattagccaggcgtggtggtgcgcacctgtagtcc

SEQ ID NO: 67106 - DNA, 601 bp, Human
gcttgagcttaggagtttcagaccagcctgggcaacttagcaagacccagtctctaaaaaaaataaataaataaaataattagccaggcatggtggtgcgcacctgtagttccaactacttgggatgctgaggtgagaggatcacttgagcctgggaggttgaggctgcagtgagctatgatcatgccactgcactccagcctgggtgacagagcaaagctgactctgtctcaaaaaaaaaaaaaaaaaatgccgggtgcagtggctcatgcctgtaatcccagcactttgggaggccgasgtgggcagatcatgaggtcaggaggttgagaacatcctggctaacacggtgaaaccccatctctactaaaaatataaaaaatcaggtctgggcgcggtggctcatgcctgcaatcacagcactttggggggccgaggagggtggatcacgaggtcaggagatggagaccatcctggctaacgtggtgaaaccccatctctactaaaaatacaaaaattagccaggcgtggtggtgcgcacctgtagtcccagctacttgggagggtgaggcaggagaattgctctaacttggaggcagag

SEQ ID NO: 67107 - DNA, 601 bp, Human
taaaataattagccaggcatggtggtgcgcacctgtagttccaactacttgggatgctgaggtgagaggatcacttgagcctgggaggttgaggctgcagtgagctatgatcatgccactgcactccagcctgggtgacagagcaaagctgactctgtctcaaaaaaaaaaaaaaaaaatgccgggtgcagtggctcatgcctgtaatcccagcactttgggaggccgaggtgggcagatcatgaggtcaggaggttgagaacatcctggctaacacggtgaaaccccatctctactaaawatataaaaaatcaggtctgggcgcggtggctcatgcctgcaatcacagcactttggggggccgaggagggtggatcacgaggtcaggagatggagaccatcctggctaacgtggtgaaaccccatctctactaaaaatacaaaaattagccaggcgtggtggtgcgcacctgtagtcccagctacttgggagggtgaggcaggagaattgctctaacttggaggcagaggttgcagtgagccaagatcacaccactgaactccagcctaggcaataagagtgaaactccatctcaaaaaa

SEQ ID NO: 67108 - DNA, 601 bp, Human
aaaaatcaggtctgggcgcggtggctcatgcctgcaatcacagcactttggggggccgaggagggtggatcacgaggtcaggagatggagaccatcctggctaacgtggtgaaaccccatctctactaaaaatacaaaaattagccaggcgtggtggtgcgcacctgtagtcccagctacttgggagggtgaggcaggagaattgctctaacttggaggcagaggttgcagtgagccaagatcacaccactgaactccagcctaggcaataagagtgaaactccatctcaaaaaaaaaaaatctatctatctatctatctatctatctatctatctatctatctatctatatttgacatattaatgtgtcatattatgtcacattatgacgtatcatatcgatatgtcttattattttaaataaatagggctacttaggctatctacttcttcttgtgtgggttttgatcatttgtgtctttcaaataatttgtccattttgcctgtgttatcaaatttattggcataacatttataacgttcccttgttctcctgctactgtctgtaggatctgcagtgatgtcctctcttttgctcttg

SEQ ID NO: 67109 - DNA, 601 bp, Human
gaccatcctggctaacgtggtgaaaccccatctctactaaaaatacaaaaattagccaggcgtggtggtgcgcacctgtagtcccagctacttgggagggtgaggcaggagaattgctctaacttggaggcagaggttgcagtgagccaagatcacaccactgaactccagcctaggcaataagagtgaaactccatctcaaaaaaaaaaaatctatctatctatctatctatctatctatctatctatctatctatctatatttgacatattaatgtgtcatattatgtcacattatgaygtatcatatcgatatgtcttattattttaaataaatagggctacttaggctatctacttcttcttgtgtgggttttgatcatttgtgtctttcaaataatttgtccattttgcctgtgttatcaaatttattggcataacatttataacgttcccttgttctcctgctactgtctgtaggatctgcagtgatgtcctctcttttgctcttggtatcgatcatttctgcctttgctcatttttttcttgatctatcaagctaggggtttatcacttttagtgctctttcctcgcatacctc

SEQ ID NO: 67110 - DNA, 601 bp, Human
attatgacgtatcatatcgatatgtcttattattttaaataaatagggctacttaggctatctacttcttcttgtgtgggttttgatcatttgtgtctttcaaataatttgtccattttgcctgtgttatcaaatttattggcataacatttataacgttcccttgttctcctgctactgtctgtaggatctgcagtgatgtcctctcttttgctcttggtatcgatcatttctgcctttgctcatttttttcttgatctatcaagctaggggtttatcacttttagtgctctttcctcgmatacctcaaggtcatttatccctgacctttgcctggctggccctttcactccatgtaggtctcaacccaagtgtcgcctcctcagagaagtcttccctgactaccctagctataaagacagtcctatcttctccttccccttactctgtttgatttttcttcctggccctcactatttgttcacttgtttattgtttatctctccagctatacagcaagcaacaaaagggtagggaccacatctgtcttcttcatccctgtgtctccagcatctagcacaggtgtacaatgagcctgcca

SEQ ID NO: 67111 - DNA, 601 bp, Human
caagtgtcgcctcctcagagaagtcttccctgactaccctagctataaagacagtcctatcttctccttccccttactctgtttgatttttcttcctggccctcactatttgttcacttgtttattgtttatctctccagctatacagcaagcaacaaaagggtagggaccacatctgtcttcttcatccctgtgtctccagcatctagcacaggtgtacaatgagcctgccatatagtagatgctcaagaaatgcgaatgaatgaatgaatgaatgaatgaatcatttttggggagaacytcccccagacactgtatcatatcttcctggagctgggaaagtcccttccacataccactctgggcactactcagccagcctcaaagcaggaagccccttctactgatggagggcaggggatgtcatccatgtccccaggcactgatgtagcactgtggactgtggtttaaaccacctcatccctggagacaggtctgagggcaacctccagacctctgtcccttcttggaaacaggaattgaatccaaaagctgttttttttttacctggaggtggctgatccttttgaggaagatggca

SEQ ID NO: 67112 - DNA, 601 bp, Human
attgtttatctctccagctatacagcaagcaacaaaagggtagggaccacatctgtcttcttcatccctgtgtctccagcatctagcacaggtgtacaatgagcctgccatatagtagatgctcaagaaatgcgaatgaatgaatgaatgaatgaatgaatcatttttggggagaacttcccccagacactgtatcatatcttcctggagctgggaaagtcccttccacataccactctgggcactactcagccagcctcaaagcaggaagccccttctactgatggagggcaggggatgwcatccatgtccccaggcactgatgtagcactgtggactgtggtttaaaccacctcatccctggagacaggtctgagggcaacctccagacctctgtcccttcttggaaacaggaattgaatccaaaagctgttttttttttacctggaggtggctgatccttttgaggaagatggcaaaaaggaccagggtgggggtgggtctgtccctgacatgaagcaaccctcatattggggaagggggagagtcagaatgaagccgtgagccgggtatggtggcacatacctgtagtcccagttac

SEQ ID NO: 67113 - DNA, 601 bp, Human
cgaatgaatgaatgaatgaatgaatgaatcatttttggggagaacttcccccagacactgtatcatatcttcctggagctgggaaagtcccttccacataccactctgggcactactcagccagcctcaaagcaggaagccccttctactgatggagggcaggggatgtcatccatgtccccaggcactgatgtagcactgtggactgtggtttaaaccacctcatccctggagacaggtctgagggcaacctccagacctctgtcccttcttggaaacaggaattgaatccaaaagctgatttttttttacctggaggtggctgatccttttgaggaagatggcaaaaaggaccagggtgggggtgggtctgtccctgacatgaagcaaccctcatattggggaagggggagagtcagaatgaagccgtgagccgggtatggtggcacatacctgtagtcccagttactcgggaggctaaggcaggaggattgcttgagcccaggagttcaagaccagcctggacaacattgcgagacccagtctctaaacaaaaacaaaaaaagaaaagaaaagaaagtgaacaacaacaaaaacagga

SEQ ID NO: 67114 - DNA, 601 bp, Human
atatcttcctggagctgggaaagtcccttccacataccactctgggcactactcagccagcctcaaagcaggaagccccttctactgatggagggcaggggatgtcatccatgtccccaggcactgatgtagcactgtggactgtggtttaaaccacctcatccctggagacaggtctgagggcaacctccagacctctgtcccttcttggaaacaggaattgaatccaaaagctgttttttttttacctggaggtggctgatccttttgaggaagatggcaaaaaggaccagggtgggggtgggtctgtccctgacatgaagcaaccctcatattggggaagggggagagtcagaatgaagccgtgagccgggtatggtggcacatacctgtagtcccagttactcgggaggctaaggcaggaggattgcttgagcccaggagttcaagaccagcctggacaacattgcgagacccagtctctaaacaaaaacaaaaaaagaaaagaaaagaaagtgaacaacaacaaaaacaggaaaataaagctgtgaaagggaccagttatgtccttagcactttaaacattttattttttattttt

SEQ ID NO: 67115 - DNA, 601 bp, Human
tgggtctgtccctgacatgaagcaaccctcatattggggaagggggagagtcagaatgaagccgtgagccgggtatggtggcacatacctgtagtcccagttactcgggaggctaaggcaggaggattgcttgagcccaggagttcaagaccagcctggacaacattgcgagacccagtctctaaacaaaaacaaaaaaagaaaagaaaagaaagtgaacaacaacaaaaacaggaaaataaagctgtgaaagggaccagttatgtccttagcactttaaacattttattttttatttttwtttttgagacagagtcttactctatcaccccggttggagtgcagtggtgcgatctcggctcacggcaacctttgcctcctgggttcaagcaatcctcttgcctcagcttcctgagtagctgggactacaagtgtgcaccatcatgcccagctaatttttgtatttttagtagagacggggtttcaccatgttagccaggctggtctcgaactcctgacctcaggtgatccatctgccttggcctccccaaagtgacgagattagagatgtgagccattgtgcccggcctgttcttagcac

SEQ ID NO: 67116 - DNA, 601 bp, Human
tcaagaccagcctggacaacattgcgagacccagtctctaaacaaaaacaaaaaaagaaaagaaaagaaagtgaacaacaacaaaaacaggaaaataaagctgtgaaagggaccagttatgtccttagcactttaaacattttattttttatttttatttttgagacagagtcttactctatcaccccggttggagtgcagtggtgcgatctcggctcacggcaacctttgcctcctgggttcaagcaatcctcttgcctcagcttcctgagtagctgggactacaagtgtgcaccatcaygcccagctaatttttgtatttttagtagagacggggtttcaccatgttagccaggctggtctcgaactcctgacctcaggtgatccatctgccttggcctccccaaagtgacgagattagagatgtgagccattgtgcccggcctgttcttagcactttgaggcaggcactcctagtttcccccaaaggataaactgaggctcagagaggcagagcgacttgcccaaggtcacacagctgagactcgcacctagaattctggttccaaagtccatgctcctgactgccctgttcgcctgc

SEQ ID NO: 67117 - DNA, 601 bp, Human
gaaaataaagctgtgaaagggaccagttatgtccttagcactttaaacattttattttttatttttatttttgagacagagtcttactctatcaccccggttggagtgcagtggtgcgatctcggctcacggcaacctttgcctcctgggttcaagcaatcctcttgcctcagcttcctgagtagctgggactacaagtgtgcaccatcatgcccagctaatttttgtatttttagtagagacggggtttcaccatgttagccaggctggtctcgaactcctgacctcaggtgatccatcwgccttggcctccccaaagtgacgagattagagatgtgagccattgtgcccggcctgttcttagcactttgaggcaggcactcctagtttcccccaaaggataaactgaggctcagagaggcagagcgacttgcccaaggtcacacagctgagactcgcacctagaattctggttccaaagtccatgctcctgactgccctgttcgcctgccttgggggacagaaacaccacagaaccccagtgccagatggggaaaatgaggcccaaggaggcagcaggattgattgggggtcagcagct

SEQ ID NO: 67118 - DNA, 601 bp, Human
actttgaggcaggcactcctagtttcccccaaaggataaactgaggctcagagaggcagagcgacttgcccaaggtcacacagctgagactcgcacctagaattctggttccaaagtccatgctcctgactgccctgttcgcctgccttgggggacagaaacaccacagaaccccagtgccagatggggaaaatgaggcccaaggaggcagcaggattgattgggggtcagcagctagtttgagccagagcgggactgagaggccgagcctcctgcccctgcggctgcctggcctggctcmccacttccccagcagctgcgtttcctgtgagggcctggtgctggactctgtgcacatagctggctccagttgccttgtgatgactggggcttggcacggttaacccagttccttcctggcatctgccggttccacttcctcctgtcctcctccgtgcccaggaggaagcaggaacttcccgtctgggccgcatggcctttgggggtatcctaaaacagatcactccccccatttctatccaggagctgggggatgtctgggggtcggggggcaatggagaggtcccagaatcctttgtgg

SEQ ID NO: 67119 - DNA, 601 bp, Human
acacccagtcaagggccagcaagctcacaattccctccgctactagccccaaatagccaaagctccaaaaacttgatggtcccccatagtgtctccatgagaaactcaaagaaacgggtgggaggatgtttgtttattgcactgactcccattcctacattccgctgcaggaatattagtgagttgacatgtccccatcctaacatgcaataaattctggaatctgaagctctcacagctctgcatcagagaatttcagattgtggacctgggggatgttgtcgtttgagtagtttgtttrtttatttatttatttatattttatttatttttttttgagtcggagtctcgctctgtcacccaggctggagtgcagtggcatgatctcggctcattgcaagctccgcctccccggttcacgccattctcctgcctcagcctcccaagtagctggaactacaggcgcccgccaccatgcccggttaattttttgtatttttagtagagacggggtttcaccgtgttagccaggatggtctcgatctcctgacctcgtgatccgcccgccttggcctcccatagtgctgagattacaggcgtg

SEQ ID NO: 67120 - DNA, 601 bp, Human
ttagtgagttgacatgtccccatcctaacatgcaataaattctggaatctgaagctctcacagctctgcatcagagaatttcagattgtggacctgggggatgttgtcgtttgagtagtttgtttatttatttatttatttatattttatttatttttttttgagtcggagtctcgctctgtcacccaggctggagtgcagtggcatgatctcggctcattgcaagctccgcctccccggttcacgccattctcctgcctcagcctcccaagtagctggaactacaggcgcccgccaccaygcccggttaattttttgtatttttagtagagacggggtttcaccgtgttagccaggatggtctcgatctcctgacctcgtgatccgcccgccttggcctcccatagtgctgagattacaggcgtgagccaccgcgcctggccctttatttttattttttttgagacagagtctggctctgtcacccaggttggagtgcaatggcatgatctcggctcactgcagcctccgcctcccaggttcaagcaattctcctgcctcagcctcctgtgtagctgggattacaggtgcgcgccaccat

SEQ ID NO: 67121 - DNA, 601 bp, Human
tttatattttatttatttttttttgagtcggagtctcgctctgtcacccaggctggagtgcagtggcatgatctcggctcattgcaagctccgcctccccggttcacgccattctcctgcctcagcctcccaagtagctggaactacaggcgcccgccaccatgcccggttaattttttgtatttttagtagagacggggtttcaccgtgttagccaggatggtctcgatctcctgacctcgtgatccgcccgccttggcctcccatagtgctgagattacaggcgtgagccaccgcgccyggccctttatttttattttttttgagacagagtctggctctgtcacccaggttggagtgcaatggcatgatctcggctcactgcagcctccgcctcccaggttcaagcaattctcctgcctcagcctcctgtgtagctgggattacaggtgcgcgccaccatgcccagctaatttttgtatttttagtagagacagggtttttgtatttttagtagagacagggtttcaccatgttggtcaggctggtctcgaactcctgacctggtgatctgcctgcctcagcttcccaaagtgctggg

SEQ ID NO: 67122 - DNA, 601 bp, Human
ctgctaggtggagttggaggcgttggagacagccctttggggagatgggaggtgacacccccgccccttctccgtgctccggccttctcctctgctcccatttcctctttctgggccccaaccaagccactccttccctttttgctgccgcttgctcgatcaagtcctgcctgcaccgacccctacccccgccctctgcacgccaaccctggaggcagaagcagtcccatcccctctcccatcgctggttggggcccatgctggtgcccccaggagccagacgagatgctgggcaagcctscagcccccacctcccacctggtggatcatacccattttacagatgagaaaattgagacacagagagggggaagggcagccttgggatgtcagagcttagcggggggctgagctggtgtctttgaacctctagtcccaggctcttgaagactccagcatcagtatcccggacccagggccggtttggcaggtgcgcgaactgggctgtcccagagggttccaggctcagaagagcctgaagtttcagcttgcacccagccccagaaaatctgtggctggccctgcaaggaccctgccagat

SEQ ID NO: 67123 - DNA, 601 bp, Human
cacatacacaaatgaatgcacacacgtgcacacgtgtgcacacacacaaatgcacacaaggatccatgcagatgcccccacacagatgcacacaaataagtgcacacacaaatgtacacactcaaacacgcccatgcacgtgtacacactcacaaacacacacaagaatgcatgcaaattcccacatgcacacacacacatgcacatacacaaacacacacaagcatgcatgcaaattcccacatgcacacacacacatgcacatacacaaacacacaaggatacacacatgcctgcatgyaatccccccatgcacatgcacgcacatgtgtgcacacatacaaatgcacacacaagcacacctatgcacgcacccacaaatgcagccaaggatacatgcgcgtgccccacacacaaatatgcaaacaaatcacacacccagacacacccatgcacatgtgtacatctatacacacacacacacgagcacgcttgtacatgaacaaacacagagaaatgcacacacaacactcagagtccatcacaaaggtctgagcaacgcgagtgcctggggggagctagggctgtttggggaaaagaa

SEQ ID NO: 67124 - DNA, 601 bp, Human
cacacaaatatgcaaacaaatcacacacccagacacacccatgcacatgtgtacatctatacacacacacacacgagcacgcttgtacatgaacaaacacagagaaatgcacacacaacactcagagtccatcacaaaggtctgagcaacgcgagtgcctggggggagctagggctgtttggggaaaagaaggggaaacccagagtctggggggcagctcagggttcacgcgcctctgggggacttctgaggggcagattgcttcagtgctctgtgtcttagtcgcttcatctgtggaagsggggactgtgagtgccgtgcttcctgggagccagctagtgtaaagagcggggctgggtgccatgctccccctgagcctgggctcgcccgagcacatgtgccctctgcagcccctcatgtggtggtctgtgcttttccctctggggatccatgcaagaacagacggaggacaaatcagaagtgtgcgggggggtcgggagctctggggaagaaggagagcagtgggaagagagcgtgtttcagggagggacgtgggggcttgcagagatgcctgcggagggcagccccactcagaaaggct

SEQ ID NO: 67125 - DNA, 601 bp, Human
ggaagactgttcccaggctaccagcattcttggggtagcgccacccctgccatagcagctctcccgggggacaccactcctcgatgaggccattcctcatgtcacgccatccctcgggtcaccctgctctgcgtgtgaagctgcttttccttggggctccattgcctcaggtgggggacgctcctgggccatctgccaactccagggaccccacctccacccagggagctctcctcccccagcagggtccttgctgggcctttcgtagggcctgggaagcaaagggaggctggctgcaagsctgggcctcaggactccttgctctgcagctacctgtcccacctggagcgcatcaccgaggagggctacgtccccacagctcaggacgtgctccgcagccgcatgcccaccactggcatcaacgagtactgcttctccgtgcagaaaaccaacctgcggtgagcgctccacctaggcccagcctagggggcagggaaggcttcctgtaggaagggcaaaggagctggggccctgagggatgagtaggagtttcttaggcccagccttcaaggagctgccaagctaggggaagcaaagctcc

SEQ ID NO: 67126 - DNA, 601 bp, Human
gtactgcttctccgtgcagaaaaccaacctgcggtgagcgctccacctaggcccagcctagggggcagggaaggcttcctgtaggaagggcaaaggagctggggccctgagggatgagtaggagtttcttaggcccagccttcaaggagctgccaagctaggggaagcaaagctccatgtagacacctccaggcccccaggtagtcaggactgggacctgtaggagcccaggctgaggcatcagagatccaggagggaatatcttcttggaggagggaatattaatggggttttgaaagaygaataggagttcagtagtcctaaccctgaaggggctgctggggaggaggaaatagagactatacagtcaggaccaggtctggggaggcctggtctggggagctcagaggtgatccctgtagtcatcaacactgggggatggactagagtgtgaggctggaagtcaggaaactcagaaaaaggaggagccaggacagcgggcgtggggatggaaaggaagggatgggcaagagttgtttctgatgtggaatgggcaggactggatgagtgtgggaattagaacaggaagtcaaaaatgaca

SEQ ID NO: 67127 - DNA, 601 bp, Human
tagcaagatctgtttccatgggctgatggcggggagctgagcaggggtgcaaagtcatgcccagagacagcgattgtgtttgacctacccctatttggccttcctttccctaaatcccccaaacctattgttttggcctcttcaatagtccttactaggaaggttcataatttatctgttttctgtgggtctcctctacaagatggagagcctcacaaggttaggggctgagtttgattcttctgcttctttagtgaatagctaaaggtcagagtagaagttggtaaatgtgggtggatgrttggaaagatggaatgggggcaacccgctcgggtccccttccacgctgtggaagctttgttctttcgctcttcacaataaatcttgctgctgctcactctttgggtccacaccacctttaagagctgtaacacttactgcgaaggtctgcggcttcattcttgaagtcagcgagaccgagaacccacgagaaggaaccagctctgggacacaatagtagtgttagtacccaaggatgacttctatgggagagatacttggtctgggaatctttaaaaaaaaaaaaaaaggaaagatggaa

SEQ ID NO: 67128 - DNA, 601 bp, Human
acacacacacacacacacacacacacacatcacacacgcacatgcacacacgcacatacacaatgcatgcacacaaacacgcacagacacgtgcataatacatgcacatacacacgtgcacacacgggacacatgtacacacgcagtgcacatgcacaacacatgcacacgaacacacatgcaccacacacatgcacacttgcatgcactcacgtgcacaatacacgcatatgtacacatgcgcacacacatgaacacacacatgcacacacacagtacacacatgcacacgcacacacakgcacacacacgcacacacaggcacacaggcacacacatgcgtgcacacacacatgcacgcacacgcacaggctggagtgcagtggcgcgatctcggctcactggaaactccgcctcccgggttcacaccattctcctgcctcagcctccggagtaggtgggattacaggcacccgccaccacgctcggctaattttttttttgtattcttagaagagagggggtttcaccatgttagccaggatggtctcaatctcctgacctcgtgatccgcccgcctcggcctcccaaagtgctggga

SEQ ID NO: 67129 - DNA, 601 bp, Human
cccgagtagctgggtttacaggcacctgccatcatgcccggctaattttttgtatttttagtagaaacggggtttcaccatgttagccaggctggtctccaactcctggcctcaggtgatctgcccgccttggcctcccaaagtgctaggattacagccgtgagctgccgcgcccggccaggtctccctcttcttatgaggacagcagtcacggacttgagggccaccgtattctagtattgcctcaccttaacgacctcttcaaagaccctatctccaggccaggtgcagtggttcatgyctataaccccagcacgctgggaggccaggagttcaagaatctctctccagataaggtcacactctgaagctctggggggacatgaatttcgggaggacacacttccaaccagcacaggcacaaaaccatgtcaggcacacccaggcagctgtccatatggaaacacgggcacacccgcctcagccccagccaggcagataggggtgagcccatgcccctggagccaacagccccgtctccgcgatgggagggtttcctgtcccacctggctggttgaagcactaacctgcttctgccccc

SEQ ID NO: 67130 - DNA, 601 bp, Human
gtgctaggattatagacaggagccaccatgcccggccaaacattttattttatgcttgttggccaacatttggggtttgagccaagatccttcaagcatgggtttgctatgtagaggtcactgttgtaaagcacttctggaaagattgtctactatttccagaatctgcctaggttttaagaatgattctttttcttttctttctttcttctattttttctttttgagacagagtctcactctgtcacccaggctggagtacagtggtgcgatcttggctcatggcaacctccaactcccsggttcaagtgattctcctgccttagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttt

SEQ ID NO: 67131 - DNA, 601 bp, Human
caccatgcccggccaaacattttattttatgcttgttggccaacatttggggtttgagccaagatccttcaagcatgggtttgctatgtagaggtcactgttgtaaagcacttctggaaagattgtctactatttccagaatctgcctaggttttaagaatgattctttttcttttctttctttcttctattttttctttttgagacagagtctcactctgtcacccaggctggagtacagtggtgcgatcttggctcatggcaacctccaactccccggttcaagtgattctcctgcctyagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttttctttaatttttttttgtttgtt

SEQ ID NO: 67132 - DNA, 601 bp, Human
ccttcaagcatgggtttgctatgtagaggtcactgttgtaaagcacttctggaaagattgtctactatttccagaatctgcctaggttttaagaatgattctttttcttttctttctttcttctattttttctttttgagacagagtctcactctgtcacccaggctggagtacagtggtgcgatcttggctcatggcaacctccaactccccggttcaagtgattctcctgccttagcctcccaagtagctgtgattacaggcacgtgccaccaagcctggctaatttttagtagtttcytgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttttctttaatttttttttgtttgttttttgagacggagtctcgctctgctgcccaggctggagtgcagtggcgcaatctcagctcactgc

SEQ ID NO: 67133 - DNA, 601 bp, Human
aatgattctttttcttttctttctttcttctattttttctttttgagacagagtctcactctgtcacccaggctggagtacagtggtgcgatcttggctcatggcaacctccaactccccggttcaagtgattctcctgccttagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaastgctgggattacgggcgtgagccaccgcatctggccataacgtttctttttctaatctttcatagtgatctcatctatccctaattggatagcaatttctttttctttaatccattttttctttaatttttttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttt

SEQ ID NO: 67134 - DNA, 601 bp, Human
ttctcctgccttagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttttctttaattttkttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttttgtatttttggtcgagatggggtttcatcatgttacccaggttggtctcaatctcctgacctcatgatccacctgtctcggcctcccaaagtgctgggattacaggcgtgagccatcgtgcccagtctatt

SEQ ID NO: 67135 - DNA, 601 bp, Human
cctgccttagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttttctttaatttttttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttttgtatttttggtcgagatggggtttcatcatgttacccaggttggtctcaatctcctgacctcatgatccacctgtctcggcctcccaaagtgctgggattacaggcgtgagccatcgtgcccagtctatttttt

SEQ ID NO: 67136 - DNA, 601 bp, Human
tctggccataacgtttctttttctaatctttcatagtgatctcatctatccctaattggatagcaatttctttttctttaatccattttttctttaatttttttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttttgtatttttggtcgagatggggtttcatcrtgttacccaggttggtctcaatctcctgacctcatgatccacctgtctcggcctcccaaagtgctgggattacaggcgtgagccatcgtgcccagtctattttttctttaatttcttttctttttttttttttttttgagatggagttttgctctttttgcccaggctggagtgcaatggcacaatctcggctcaccgcaacctccgcctcccgggttcaagggattctcctgcctcagcctcccgagtagctgggattgcaggcatgagccaccaccccggctaattttgtgtttttag

SEQ ID NO: 67137 - DNA, 601 bp, Human
atttttttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttttgtatttttggtcgagatggggtttcatcatgttacccaggttggtctcaatctcctgacctcatgatccacctgtctcggcctcccaaagtgctgggattacaggcgtgagccatcgtgcccagyctattttttctttaatttcttttctttttttttttttttttgagatggagttttgctctttttgcccaggctggagtgcaatggcacaatctcggctcaccgcaacctccgcctcccgggttcaagggattctcctgcctcagcctcccgagtagctgggattgcaggcatgagccaccaccccggctaattttgtgtttttagtagagacggggtttctccatgttggtcaggctggacttgaactcccgacctcaggtgatccacccgcctcggcctcaaagtgctgggattacaggc

SEQ ID NO: 67138 - DNA, 601 bp, Human
tcggctcaccgcaacctccgcctcccgggttcaagggattctcctgcctcagcctcccgagtagctgggattgcaggcatgagccaccaccccggctaattttgtgtttttagtagagacggggtttctccatgttggtcaggctggacttgaactcccgacctcaggtgatccacccgcctcggcctcaaagtgctgggattacaggcgtgagccaccacacctggcctttctctttaatttttaaagcagagctttgaacaatgtttccaaagcacacagcttagttttgtaatacaaygaccttctttcatgcggcacttgtagctacagatttgcataacgtttcttttaattacatatgaatcaagacacgtacaatgggcaaaaacaggtttgggaacaaactctcagtccatccagagggtgaaagggccacagggcaactacagagaaacaccatctagtgttgggcaccacttagtatattttacaaaggggaggcagagttgtggttaatccagggaccaacgtggggaaggtacatattcactagcactttccccagaacaccactgtgaggataaagtgtggtggcggg

SEQ ID NO: 67139 - DNA, 601 bp, Human
ataagaaaccacactttgggaggctgaggcgcgcagatcgctttaggtcaggagtttgagaccagcctggccaacatggcaaagccccatctctgttaaaaatacaaaaattagctgggtgtggtggcgggggcctgtcatcccagttactcgggaggctgaggcaggagaatcgcttgaacccaggaggtggaggttgcagtgagctgagatcatgccacttcactccaacctgggtgacagagtgagactctgtctcaaaataataataataataataatgataataataataaaattrataacagcagctaacacatctaccgcactggtggaagcactctacaaagcttctttaatcttcatgttaaaaccctatgcagggctgggcacagtggctcacgcctgtaatcccagcgctttgggggggtcaaggcgggctgatcatttgaggtcaggagttcgagaccagcctggccaacatggcaaaaccccatctctactaaaaatacaaaaattacctgggcatggtggcaggcgcctgtaatcccagctactgccaagattgcaccattgcactccagcctgggcgacagagcga

SEQ ID NO: 67140 - DNA, 601 bp, Human
cagcctggccaacatggcaaaaccccatctctactaaaaatacaaaaattacctgggcatggtggcaggcgcctgtaatcccagctactgccaagattgcaccattgcactccagcctgggcgacagagcgaggccccatctcaagaaaaaaaaaaaaaagaggactctcttcccctcgtttggccttgatgccgccatcttcacagtcctgggatatttgtctatgcgattccagtcttccaactgcactggctgtaagcgaggccaagagagtgtctctctttaacacagttctgcccraagtcccagagctgggtctcattggtccatttcaggtcacatgactcgtgtgagacaatctcctgtgttcccattggctgggccggagtcgtgtgaccagctatgactacaaaagatggagtcaacgcacagaaaaatgacaggcgcgatccctgggtcccttcagtgctggttacagggaagagggtctccagaggccccctgggtccaaagagggagggtcctcacccccttcccacactgtttccccaggccctaagcaggatgctgaggcagccaagaggttcatcctggacatgt

SEQ ID NO: 67141 - DNA, 601 bp, Human; identical to SEQ ID NO: 20816

SEQ ID NO: 67142 - DNA, 601 bp, Human; identical to SEQ ID NO: 20817

SEQ ID NO: 67143 - DNA, 601 bp, Human; identical to SEQ ID NO: 20818

SEQ ID NO: 67144 - DNA, 601 bp, Human; identical to SEQ ID NO: 20819

SEQ ID NO: 67145 - DNA, 601 bp, Human; identical to SEQ ID NO: 20820

SEQ ID NO: 67146 - DNA, 601 bp, Human; identical to SEQ ID NO: 20821

SEQ ID NO: 67147 - DNA, 601 bp, Human; identical to SEQ ID NO: 20822

SEQ ID NO: 67148 - DNA, 601 bp, Human
gaagactcctccgtgtcccctatccccacattcccttcagggccattctcctgccttcctgttccgggaaaccccgtactcctcttggctggaatgcaccctgtgggaaaaagacagtctttcctctcctcagggttccgctcagctgagggtggggcggttgacacctgagggagcctttgcttgttgtcccaagcagctatctcggcagcctcccccgcccccttccttagagtcctggtgggagccacgctgagtcctcgttgagagcagccccccacctgccggctcctccccaccktcctggagaaggtttgctggtgaacctccttctccccaaggcacacctgctgcagggagccagtcgggccagctgtaaagtgttgtcactccaaataagggccccttcagtggtttacaaaacagaagctcttgccctgccccgcccctgccctcccgagctcctaggttagctcctgggccgggggcggggcggtggggaaggtcggaaatgcgtgagaggcagcggtgacggaggagggggcgtgctggtggcggtggctcttggggaggaggcaggtcgcatgttgtgtggggaaca

SEQ ID NO: 67149 - DNA, 601 bp, Human
ggaatgcaccctgtgggaaaaagacagtctttcctctcctcagggttccgctcagctgagggtggggcggttgacacctgagggagcctttgcttgttgtcccaagcagctatctcggcagcctcccccgcccccttccttagagtcctggtgggagccacgctgagtcctcgttgagagcagccccccacctgccggctcctccccaccgtcctggagaaggtttgctggtgaacctccttctccccaaggcacacctgctgcagggagccagtcgggccagctgtaaagtgttgtcacyccaaataagggccccttcagtggtttacaaaacagaagctcttgccctgccccgcccctgccctcccgagctcctaggttagctcctgggccgggggcggggcggtggggaaggtcggaaatgcgtgagaggcagcggtgacggaggagggggcgtgctggtggcggtggctcttggggaggaggcaggtcgcatgttgtgtggggaacacgttgcctctcctgccgtgagcctcttagggccctccgtgtcccgggttacagaggtgccttggatgaaacgccttcctgatttttttcc

SEQ ID NO: 67150 - DNA, 601 bp, Human
cctgccctcccgagctcctaggttagctcctgggccgggggcggggcggtggggaaggtcggaaatgcgtgagaggcagcggtgacggaggagggggcgtgctggtggcggtggctcttggggaggaggcaggtcgcatgttgtgtggggaacacgttgcctctcctgccgtgagcctcttagggccctccgtgtcccgggttacagaggtgccttggatgaaacgccttcctgatttttttccccaaacttgtgttttgatttacctaagggttctaaaatgggccatctttccaggggrccgcgggtaggcagagccgtggtcctcacgtttggaggaaatgtgcagtgcggcccgcgtggtggcactttgcacagagtggcactggctggcttttgtagtgggtcgtggactttgtttggatggaggggagttaggaattactggtgtcataaagatcttaccagatggccttgccctgtggctctgtgacctccagaacccccgccgccatccctgcatgcacccggtcttctgtgcctgcactttggacttgagattgacacggggttcaaggacgaaggtcaggggctcccgtgt

SEQ ID NO: 67151 - DNA, 601 bp, Human
gggcactgcagggtgctgagcagtgtccgaggcctccacccactccatgccaggagctcccccaagtcgtgataaccacagatgtctctagacagtgcccattgtcccttggggggcacgttgcccccatttgagaccctttactgtgtggtagcgtacaacgtaaaatgctcgtggcaaagctgagggataatgagtgcaaattattttgtcagaagtttccatgagtgcttatagagtatttttctaagcaccgtcaaagccgtgtgtgtgtgaattcactactcagtgtatgcatgartgtgaatgcatgtattgttttatacccgtggtattccaggtttgtccctatgcacacttctgtcgatgctggtgacagctgtggatgggtacaggagtggcaagcacgtactgcgcacttagtgcacacgctgctcccgcctccgtccgcgccgccgccatcctggggtccgccctgtggcctggagagctcttgcaggccctgccagcagctcttggatctgggttcccattccccaggcccgctgggcttctgcctatcacgggcagccctcggctgttaggtttccgtctcactggt

SEQ ID NO: 67152 - DNA, 601 bp, Human
tgtcccttggggggcacgttgcccccatttgagaccctttactgtgtggtagcgtacaacgtaaaatgctcgtggcaaagctgagggataatgagtgcaaattattttgtcagaagtttccatgagtgcttatagagtatttttctaagcaccgtcaaagccgtgtgtgtgtgaattcactactcagtgtatgcatgaatgtgaatgcatgtattgttttatacccgtggtattccaggtttgtccctatgcacacttctgtcgatgctggtgacagctgtggatgggtacaggagtggcragcacgtactgcgcacttagtgcacacgctgctcccgcctccgtccgcgccgccgccatcctggggtccgccctgtggcctggagagctcttgcaggccctgccagcagctcttggatctgggttcccattccccaggcccgctgggcttctgcctatcacgggcagccctcggctgttaggtttccgtctcactggtaaactgtggaggggacccccgtatagttctttgtggcaggtttgtggttggaaacgtggggacttccatgggaatgcctgttcccagggcctgaggctgcta

SEQ ID NO: 67153 - DNA, 601 bp, Human
tccgccctgtggcctggagagctcttgcaggccctgccagcagctcttggatctgggttcccattccccaggcccgctgggcttctgcctatcacgggcagccctcggctgttaggtttccgtctcactggtaaactgtggaggggacccccgtatagttctttgtggcaggtttgtggttggaaacgtggggacttccatgggaatgcctgttcccagggcctgaggctgctagcgaggctgagccggagtggctccaggctttctaaataaagcaggatggttagttccggaggcttcytgtccggcctgcgccagcccccacggggcagtgacaaggcccgggatccagcatggggtgcggtggccccacgggaagggccgggcctctgttggcccagtgttgggaggcgtggagcgtggcctctggcgcctggcagggtggctgtgccgtgtcccagaagactctgggagcaggaagcgcccttggatggcctcgtccaaccttgacttcccaagcccgagcccaggccagggagacgtggggacttggtccgggcctgctctcacgtcctttgtgtttacatgtaatcagttatga

SEQ ID NO: 67154 - DNA, 601 bp, Human
gcgtggcctctggcgcctggcagggtggctgtgccgtgtcccagaagactctgggagcaggaagcgcccttggatggcctcgtccaaccttgacttcccaagcccgagcccaggccagggagacgtggggacttggtccgggcctgctctcacgtcctttgtgtttacatgtaatcagttatgatgattgtggctgaaagggtctgcttttcccgggcatggtccgggaagctccgttccacagctgtgagctccgtggagcttcctcccgagcctcctgcccggctctgccggtgctgtrgtgagagtggaggaagtgctttcctccgagatttaaccacgagaggtttcactttctgagtcttgtggtggagcctgtctctgtctgggacctggaccctgggcagcacggggaggacgccgtggcatcaggaggttggagaggtgtgtggtggagtcggacggatcttagaggggcgctcgcggggcctgctcggccctaccctgtagacagctgggacccagcgccccttctgggtccccagcagggctgtgttctccccactgggcaccccagcttgtgcgtggaggatgggaagcc

SEQ ID NO: 67155 - DNA, 601 bp, Human
tggcctcgtccaaccttgacttcccaagcccgagcccaggccagggagacgtggggacttggtccgggcctgctctcacgtcctttgtgtttacatgtaatcagttatgatgattgtggctgaaagggtctgcttttcccgggcatggtccgggaagctccgttccacagctgtgagctccgtggagcttcctcccgagcctcctgcccggctctgccggtgctgtggtgagagtggaggaagtgctttcctccgagatttaaccacgagaggtttcactttctgagtcttgtggtggagyctgtctctgtctgggacctggaccctgggcagcacggggaggacgccgtggcatcaggaggttggagaggtgtgtggtggagtcggacggatcttagaggggcgctcgcggggcctgctcggccctaccctgtagacagctgggacccagcgccccttctgggtccccagcagggctgtgttctccccactgggcaccccagcttgtgcgtggaggatgggaagccttgtatggcttgcccacctgggtgactgagagcggtggatgcgattaggggcggccaggggctctgggaaggcc

SEQ ID NO: 67156 - DNA, 601 bp, Human
cgggcatggtccgggaagctccgttccacagctgtgagctccgtggagcttcctcccgagcctcctgcccggctctgccggtgctgtggtgagagtggaggaagtgctttcctccgagatttaaccacgagaggtttcactttctgagtcttgtggtggagcctgtctctgtctgggacctggaccctgggcagcacggggaggacgccgtggcatcaggaggttggagaggtgtgtggtggagtcggacggatcttagaggggcgctcgcggggcctgctcggccctaccctgtagacaactgggacccagcgccccttctgggtccccagcagggctgtgttctccccactgggcaccccagcttgtgcgtggaggatgggaagccttgtatggcttgcccacctgggtgactgagagcggtggatgcgattaggggcggccaggggctctgggaaggcccacgtgcagggtcattatctggcagaaattaagtcctttcgcagaaccgggatcctaagtgccggtttgctggcgtgcaggtggttgcaggtgcatgtagctcctgccgccaggccctgtgtggagcatcccgcccggg

SEQ ID NO: 67157 - DNA, 601 bp, Human
gccccttctgggtccccagcagggctgtgttctccccactgggcaccccagcttgtgcgtggaggatgggaagccttgtatggcttgcccacctgggtgactgagagcggtggatgcgattaggggcggccaggggctctgggaaggcccacgtgcagggtcattatctggcagaaattaagtcctttcgcagaaccgggatcctaagtgccggtttgctggcgtgcaggtggttgcaggtgcatgtagctcctgccgccaggccctgtgtggagcatcccgcccggggggcctcccaccrtgtctgtcatctgtagggcacctggcaggtcttagaattggctgccctggatccagactctcgctgtcatctgggcctggccacatccctcccctgccatcaagatgtctgtggtccagtctcccaccctccatccccactccctgcctctgggtcagaagcctccgatggtctctgctgtgggggttcctggtccagcctggcctcccgcagtctgccgacaggcgctttcaggacagcactggtgggtgggtcttcgggccacctgcagggcctgggagcagtgtggtgtccggatca

SEQ ID NO: 67158 - DNA, 601 bp, Human
ccctccatccccactccctgcctctgggtcagaagcctccgatggtctctgctgtgggggttcctggtccagcctggcctcccgcagtctgccgacaggcgctttcaggacagcactggtgggtgggtcttcgggccacctgcagggcctgggagcagtgtggtgtccggatcaggtacgtggcctggggagactcaggttcagagcctacctctgcctcttgtaactgtgggacttcaggtctgtgcctcagtttcctcagggggcggtggggtgaggactcggtggtgatccccatccygccgcacgtggggacccacggaatgctggctgctgcttccgctgccggtgtggtgatatcttgtcgcgtccacagcacctggcgtgtgtggcacacattgggtgctctgagaaactgctccatgggggatcctgccctgggatctgggatctgggatctgcccacagacaccttgatcaggattccccagcctcggctccgtgggtgttttacactggatcgttctctggggtggagctgtcttgggcactgcagggtactgagcagcgtccctggcctccacccacaccagaccaggag

SEQ ID NO: 67159 - DNA, 601 bp, Human
ggcctcagtttccccatcggtcacgtgggaaggctgtccctccccctgtaggattgtggaaggattaaatgagctgaggccagtgcggcagacagcggggagggagccctcttgtcccctgtggctgcccttcctgctggctgctttgcaccgaaaagctgcggagtaaccctgggcggtggtgctccctggatggcgtccacatggggaccccaaggcctgggaggctccaggagggacggtgctggcccaggtttctgtccctgtctgacctcggagttggtgttctgggtaccgcacygtccggcggcccaggctccgttttctcttctgtcaaactgtgtggtcaccctgatgtttcaggggccctgcagggacggagtggggtggggggctgaagggtgtggtcaaactggagggcgctgtgtctgttgctattgttaaccgtgtccacactgatgggtgctgggccccgccaccgagcgggacttgtgcggcctgcagagatgtggctgttctgttgcctgtcttaatccccagggactgtggggccaggtccacactgtgggatgagtgcagcccccacggctgtggtggggct

SEQ ID NO: 67160 - DNA, 601 bp, Human
gtttccccatcggtcacgtgggaaggctgtccctccccctgtaggattgtggaaggattaaatgagctgaggccagtgcggcagacagcggggagggagccctcttgtcccctgtggctgcccttcctgctggctgctttgcaccgaaaagctgcggagtaaccctgggcggtggtgctccctggatggcgtccacatggggaccccaaggcctgggaggctccaggagggacggtgctggcccaggtttctgtccctgtctgacctcggagttggtgttctgggtaccgcactgtccggyggcccaggctccgttttctcttctgtcaaactgtgtggtcaccctgatgtttcaggggccctgcagggacggagtggggtggggggctgaagggtgtggtcaaactggagggcgctgtgtctgttgctattgttaaccgtgtccacactgatgggtgctgggccccgccaccgagcgggacttgtgcggcctgcagagatgtggctgttctgttgcctgtcttaatccccagggactgtggggccaggtccacactgtgggatgagtgcagcccccacggctgtggtggggctgggtcca

SEQ ID NO: 67161 - DNA, 601 bp, Human
ttctgggtaccgcactgtccggcggcccaggctccgttttctcttctgtcaaactgtgtggtcaccctgatgtttcaggggccctgcagggacggagtggggtggggggctgaagggtgtggtcaaactggagggcgctgtgtctgttgctattgttaaccgtgtccacactgatgggtgctgggccccgccaccgagcgggacttgtgcggcctgcagagatgtggctgttctgttgcctgtcttaatccccagggactgtggggccaggtccacactgtgggatgagtgcagcccccasggctgtggtggggctgggtccacgctgtgggatgaatgcagcccccagggactgtggggccgggtccacgctgtgggatgaatgaagcagccttttctccagccacactggtttgctcggccttagtcccactggatgcggcgagggttgaccggtcaggcccttgctggtggcctgggtagatgtctggagagggggcctgggcctccggactcctgcccttcccccatcagtgatcctatcccacactctttggcgatggtcagtgagctgggcaggggcgggggtctgtccctgtcc

SEQ ID NO: 67162 - DNA, 601 bp, Human
gatcactcaagtccaggagttcgagaccagcctgggcaacatgacgagacccctgtctctactaaaaatgcaaaaaattagccagacttggtgatgtgcacctgtagtcccagctacctgggtggctaaggtgggaggatcacttgagtccaggaggcagaggttgcagtgagccgagattgcaccactgcactccagcctgggcgaccgagggagaggttctgtctcaaaaacaaacaaacaaacaaaacaaaacaaacaaaaaaaaaacgtagaaaacatgagtgagtgacaccatccrcttccagtggaggggtggggtcactcccacttgggagccagtctgcacggaagcctcagtgggaacagaacaaggtggcatggcccctgaccggcgaggggcagttagtatctgcacctttgaggcacctggggactctgctgctgtggagatgggattgggttccagtccagaggctgtcctgccatcgctgcccctggctgtcatgccccacctggggtagtgagtttcggggcagctctttcttgagcctcagcagcggggtgagccgggtgcacttcctctctcagggcgccccct

SEQ ID NO: 67163 - DNA, 601 bp, Human
ccaggtggggccctgtggctctggccttgctcccggtgtgtgcactggcctggcctccccgcagcctggtgggggcttcctggcttctcggcccacatctcacagtcttgggcactgtggggctcggctcaggcgtcgtagacgggaagcagcctggaaccctggaagtctgactcccaggtgtcggctcccaggtctcagccctgccactggggtcatgggttacttgaatctttatatactttttatttgttatttatttatttatttatttatttttgagagagagtctcactctgtygcccaggctggagtgcagtggtgcagtcttggctcactgcaacctctgcctcctggttcaagtgattctcctgcctcagcctcccgagaagctgggattacaggcgcatgccaccacacccggctaatttttgtatttttagtggagatgtggtttcactatgttggccaggctggtctccaacttctgacctcaggtgatccgcttgccttggcctcccaaagtgctgggattacaggcgtgagccactgcgcccggccttgaatctttttttttttttttttttttttttttttttga

SEQ ID NO: 67164 - DNA, 601 bp, Human
tgtagttttagtggagacgcggtttcaccgtgttagccaggatggtctcgatctcctgacctcgtgatccgcccaccttggcctcccaaagtgccgggattacaggtgtgagccaccatgcctggccatttttgtaaattttttggtagagacggggtttcaccatgttggctaggctggtcttgaactcctgacctcaaatgatccacctgcctcggcctcaaagtgctgggattacaggcgtgagccaccgcgcccggctttgaatcttgagcatcggatgagcccccagctcctgctstcagggctgcgccctcttgtggcgcttggagcctccttttcttccgttttcctttcccaccggggaaaaggaagctggggcacggacttcgttcctcctggttggcctctccagatcttggccagcgggtccagtcgggagggtggttttctcctctggaagctggctcagtgggagcagtgggcggactctggcccctcctagtggtggcgtgctgagtgtacctgaggatgtacctcctgcaggctccctagcgtctggggtccactgtggggcggcctgtggcaggcccaccaggaa

SEQ ID NO: 67165 - DNA, 601 bp, Human
gggagcagtgggcggactctggcccctcctagtggtggcgtgctgagtgtacctgaggatgtacctcctgcaggctccctagcgtctggggtccactgtggggcggcctgtggcaggcccaccaggaaccatgcttgcacaggcaaagcaccttgcttgtggttgtgtggggggctccctcaggtgtgggagatgtgggccccattctcccaggagccatggctggtgacatgcagtcaggtccatcctgacgggcactggagtgcgggggacccaatggggacatgagggatccagcacygtggaccagggccaggttcatttggttcgctcaggaaacatgtacacagcgccttctgcataggggctagggatgcaggtgggcagggcagccacagcccctgcgctcaggaagctggcgaggcaggctgcagacgggcactgccacacctcactgaggagggaatggcagagccaccctcaaagggcctgtgctgtgggggtgctgggcgcttcctgaacgccgggctcttggatttctgcagtgggggttctccgggcgtttgggaaggggaaggacctgatggaaggggtagtttat

SEQ ID NO: 67166 - DNA, 601 bp, Human
tgcacaggcaaagcaccttgcttgtggttgtgtggggggctccctcaggtgtgggagatgtgggccccattctcccaggagccatggctggtgacatgcagtcaggtccatcctgacgggcactggagtgcgggggacccaatggggacatgagggatccagcactgtggaccagggccaggttcatttggttcgctcaggaaacatgtacacagcgccttctgcataggggctagggatgcaggtgggcagggcagccacagcccctgcgctcaggaagctggcgaggcaggctgcagaygggcactgccacacctcactgaggagggaatggcagagccaccctcaaagggcctgtgctgtgggggtgctgggcgcttcctgaacgccgggctcttggatttctgcagtgggggttctccgggcgtttgggaaggggaaggacctgatggaaggggtagtttatatttaactctggtgctgaagcaagggtcgcacacagctgccagtgcccacgacggcctcctgggaggctgagctcaccagctccagacccagtctgaggcaggaacctgggggtctcacagcgggaccggtggtg

SEQ ID NO: 67167 - DNA, 601 bp, Human
ggtgcgttgcccttggggtggcggtgtggtcagtggtccattcctgcccagcgccgagcagcggtctgtgcgtggggtctttgcacccgtgcacctgctgaagggtctctggagctttggctttttggcttttacgagtaaagctgccgtggtgcttggtgtgcggtgaggagtggacagaaggctctgtcctggcaggtgccctgcagtggcctgagaccgggagatgagggccggcaaggggctgtggacgagtccagagtgaggcggcatctcggaggggctcacacattgtctcagraggagtgggctggcatttctttccagtgggcagctgttgaagattttggagccaaaagagcgttccagctcagatgtctttcaggtggagtgtggctgcaggtggggcaggctgggtcagggtggagccatgtgggctgaggcccgagttggggctgtggctttggggccacatggctgccggtcgggtgggagcgagtctctgctgaccagggccctggatgttgagccccagccgcggggtgtgaggtctcaggcaggacccaggcattcagacattgggtccactgtgtgtggaccc

SEQ ID NO: 67168 - DNA, 601 bp, Human
ctttccagtgggcagctgttgaagattttggagccaaaagagcgttccagctcagatgtctttcaggtggagtgtggctgcaggtggggcaggctgggtcagggtggagccatgtgggctgaggcccgagttggggctgtggctttggggccacatggctgccggtcgggtgggagcgagtctctgctgaccagggccctggatgttgagccccagccgcggggtgtgaggtctcaggcaggacccaggcattcagacattgggtccactgtgtgtggacccctgcgtcccagctccaagrcgctgtgtgacgggaggcggcagcagctgagttggcgcggggagacagggcgatttgaaaagcaggctgggaccaaagcatcttgaaaacccaaatgtagtcacgttgcctggcttgagtgctgtccagagcctcgcccttggcctctgtacggcagggcttaacagtggccagcacctcagggccaccagaggcccggggccacctgggcctggcttggcttccggtggcccagaactcctgctgggctcctgcctccctctgcaacctctcctggctttggtgggttatgtgggagac

SEQ ID NO: 67169 - DNA, 601 bp, Human
ctgcgtcccagctccaagacgctgtgtgacgggaggcggcagcagctgagttggcgcggggagacagggcgatttgaaaagcaggctgggaccaaagcatcttgaaaacccaaatgtagtcacgttgcctggcttgagtgctgtccagagcctcgcccttggcctctgtacggcagggcttaacagtggccagcacctcagggccaccagaggcccggggccacctgggcctggcttggcttccggtggcccagaactcctgctgggctcctgcctccctctgcaacctctcctggctttsgtgggttatgtgggagacacgagtggcttcacccagcgggagtggtgcacatgggttaacatgccagccacccagctgtgtacgggctgcatgtgtgtgtacatgtacatgcatgtgtgcgtgcaccatgcacgtgtgtgctgatgtacatgcatgcatacatgtatgtgtgggtgtgcacgtgtgcattgtgtgcatatatgcacgttaatgcatatgtatgtgtgcatgcctgggtgcataggtgtgagccacctccctcccccatcagtgtatccatattgcctctgcagagctcca

SEQ ID NO: 67170 - DNA, 601 bp, Human
agggcgatttgaaaagcaggctgggaccaaagcatcttgaaaacccaaatgtagtcacgttgcctggcttgagtgctgtccagagcctcgcccttggcctctgtacggcagggcttaacagtggccagcacctcagggccaccagaggcccggggccacctgggcctggcttggcttccggtggcccagaactcctgctgggctcctgcctccctctgcaacctctcctggctttggtgggttatgtgggagacacgagtggcttcacccagcgggagtggtgcacatgggttaacatgccagccacccagctgtgtacgggctgcatgtgtgtgtacatgtacatgcatgtgtgcgtgcaccatgcacgtgtgtgctgatgtacatgcatgcatacatgtatgtgtgggtgtgcacgtgtgcattgtgtgcatatatgcacgttaatgcatatgtatgtgtgcatgcctgggtgcataggtgtgagccacctccctcccccatcagtgtatccatattgcctctgcagagctccatgggggtccttggcgagccagggctgtggttgtcatttttgccttccttacaaaacgcaaaacag

SEQ ID NO: 67171 - DNA, 601 bp, Human
catctgggcagtgacctgtggcgtttcagactccttctcggccgtcttggtcttcccggcatcctcgctgagagctgaggcttgcttttctgtttcatagttgagatgtttatggcctgagggaccttgtgtcttgggtgcaaagttaccaaggggcggcgccttctgacccgagtgcagggccctcctcgcctcctgcctgcagcatggggcctgtgctggggtgcaggcttgcagtgtgtgctggtctcgtgtcaggtgtggctttcagtgtgtgtgagtgtttgctgtttccaggtgmaacacccttccaaacaaacacggagcagccatcttttgtaatagcattttgttagacatagagtctcatctgggggcagtcttgacccatgggacactggcactgtctggggacatctgtggtggtcacaattcgggggggtgctcctgagatggagtgggtgggggccagggttgctgctgagcacccctcagggcccagggttcagcaccggtcagtagagctgaggccgaggatccctggcctcagattgcatcccctccatgccaccgcccttctcttcagggcgcggtgagggaa

SEQ ID NO: 67172 - DNA, 601 bp, Human
gtggtggtcacaattcgggggggtgctcctgagatggagtgggtgggggccagggttgctgctgagcacccctcagggcccagggttcagcaccggtcagtagagctgaggccgaggatccctggcctcagattgcatcccctccatgccaccgcccttctcttcagggcgcggtgagggaagggcgtgtgggggtccctctggggagaaggtgttttcaccttcacactcaccctcactcctcctgtcctggaacttgggtgggtttgaccttttgtggatgaggtgagggctgagaggyggattactacctgagacaatcaaaatcaattttctttcttctgaaaaggactcagggtgtttgagaaaagtactggggagaggcagctgccaccggggctccccactcgggatgtgttgggtgttttgcgagaccccccacagggagctcaggtgctgtgggcagttcctgggctttgtcgagggcctcccgaaggcagcactgtggccaccgtgggacacatgcagcctgtctcatctctaggagctgccaggtgaggggtcctgcgacaggcacctgtgcaaagatatctaccatggg

SEQ ID NO: 67173 - DNA, 601 bp, Human
aattcgggggggtgctcctgagatggagtgggtgggggccagggttgctgctgagcacccctcagggcccagggttcagcaccggtcagtagagctgaggccgaggatccctggcctcagattgcatcccctccatgccaccgcccttctcttcagggcgcggtgagggaagggcgtgtgggggtccctctggggagaaggtgttttcaccttcacactcaccctcactcctcctgtcctggaacttgggtgggtttgaccttttgtggatgaggtgagggctgagaggcggattactacytgagacaatcaaaatcaattttctttcttctgaaaaggactcagggtgtttgagaaaagtactggggagaggcagctgccaccggggctccccactcgggatgtgttgggtgttttgcgagaccccccacagggagctcaggtgctgtgggcagttcctgggctttgtcgagggcctcccgaaggcagcactgtggccaccgtgggacacatgcagcctgtctcatctctaggagctgccaggtgaggggtcctgcgacaggcacctgtgcaaagatatctaccatgggcagcaaggaag

SEQ ID NO: 67174 - DNA, 601 bp, Human
ctgcttgagggtcctcacagcgtggcggctgcctaccccagagcccctgacccgagactgagggcaaggaggaaggcctgtgccttttgtgaactggccttggagatggcacactgtcacttccatcacattctgtttgctagaagcaggtcactaagtgtagcccatgctcaaggggaggggaattaggttccagtatggaagggatgagcatcagagatttgtggacacactggaaaacccagcattggcatcccagcgtgtgagggtgaagaaaagtggggagacggagtctctgccsaggaggtgaccaggtgagaggcagaggcaggagaggggctggagtgaggacccccatgtcacccagaatgtgtggggggctcatctggaggctggggtggagcgacagctggccacatgggcccccttcccgatagtttttccaggctgacttgctaatccttttcatcctctggggccctgggaccatcagtgtgcccatctctgagatggggtggtagcgtactcgtctctggaagcattgtgggtattagcaaggtcgtggcaggcgtggagacgtaaaggggttcagggatgtgct

SEQ ID NO: 67175 - DNA, 601 bp, Human
tggaagcattgtgggtattagcaaggtcgtggcaggcgtggagacgtaaaggggttcagggatgtgctcagggccacctgtggcaggcacaacggtcctggctgaccccgccacagcaccaagagggagaggggagagcctcgtgggtgcttggtgcgcagggggcagtgtggccgtggccgctgagcaaagctctggggaagggggcgcccagcccttggggtggtctgtgcagagatgccgttggggtgagtccgtctgtcagggcaccgccgccacgtctgtgtgctgtccctctggygagcattggtcatgaactggcgtgaccgtggtggagctgcacagtcccagctgcggggccggtgccgtgcgacttgatttggcctgagaccgtgtggtctttgacgtaaataccaacaattggcccccaggaaagtgtgtccttgcagaacttctggaaaaggggtggttccagtaagaccctggcttggtggaagatgggaagggcgctttgtaaactctttccgaggagtcaggaggccgtggcgtctggtggagagacggtcagcctcacgtgccttggtttcctgtgctgggtgct

SEQ ID NO: 67176 - DNA, 601 bp, Human
gctgggtgctgcagcacggcagggtctgggtaagagggggcagcagcacgagagtcaggccccggctgccgcccgccctcacgtgccccgtcccccaggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggtgagcccgcgggcgcckggggaggggagcgcctgggcagctgtgggcttggtggtgagcatggtggccgcgctgccagggtggggccatgccgggggtcccggccggcccaggctacccctggtcatccatccgttcctgtcatggacatggaaacagcaaccgctgacttcctgggggccaactggagagttgtgatgggcattgcgtggccaagccccacagcctccctcccaagtagctgtgggcgcccacatcctgtgggtggggaagctgaggccctggggaagctgaggccctgtgaggtgagccactcgc

SEQ ID NO: 67177 - DNA, 601 bp, Human
gaggaggacaagcgcggcttcaccaagctcgtctaccagaacatcttcaccgccatgcaggccatgatccgggccatggagacgctcaagatcctctacaagtacgagcagaacaaggtgagcccgcgggcgcctggggaggggagcgcctgggcagctgtgggcttggtggtgagcatggtggccgcgctgccagggtggggccatgccgggggtcccggccggcccaggctacccctggtcatccatccgttcctgtcatggacatggaaacagcaaccgctgacttcctgggggccarctggagagttgtgatgggcattgcgtggccaagccccacagcctccctcccaagtagctgtgggcgcccacatcctgtgggtggggaagctgaggccctggggaagctgaggccctgtgaggtgagccactcgcccaggtcgccttgggagtaagcagcgtgagctcctggttccggccccttccccaggctgagcagcctaccaggcacctcgtttcggccctgacactcacccatggggctgtacttctcaccttctcacactgtttttttgttttgttttgttttgttttgttttga

SEQ ID NO: 67178 - DNA, 601 bp, Human
gggccatggagacgctcaagatcctctacaagtacgagcagaacaaggtgagcccgcgggcgcctggggaggggagcgcctgggcagctgtgggcttggtggtgagcatggtggccgcgctgccagggtggggccatgccgggggtcccggccggcccaggctacccctggtcatccatccgttcctgtcatggacatggaaacagcaaccgctgacttcctgggggccaactggagagttgtgatgggcattgcgtggccaagccccacagcctccctcccaagtagctgtgggcgcccrcatcctgtgggtggggaagctgaggccctggggaagctgaggccctgtgaggtgagccactcgcccaggtcgccttgggagtaagcagcgtgagctcctggttccggccccttccccaggctgagcagcctaccaggcacctcgtttcggccctgacactcacccatggggctgtacttctcaccttctcacactgtttttttgttttgttttgttttgttttgttttgaaaacagggtctcgctctgtcgcccaggctggagtgcagtggaatggtcaaggctcatcacagcctggacc

SEQ ID NO: 67179 - DNA, 601 bp, Human
gctgccagggtggggccatgccgggggtcccggccggcccaggctacccctggtcatccatccgttcctgtcatggacatggaaacagcaaccgctgacttcctgggggccaactggagagttgtgatgggcattgcgtggccaagccccacagcctccctcccaagtagctgtgggcgcccacatcctgtgggtggggaagctgaggccctggggaagctgaggccctgtgaggtgagccactcgcccaggtcgccttgggagtaagcagcgtgagctcctggttccggccccttccccrggctgagcagcctaccaggcacctcgtttcggccctgacactcacccatggggctgtacttctcaccttctcacactgtttttttgttttgttttgttttgttttgttttgaaaacagggtctcgctctgtcgcccaggctggagtgcagtggaatggtcaaggctcatcacagcctggaccttctgggctcaggtgatcccaccacagcctcccgggtagctgggactgcaggtgcatcaccacgcctagctaatttttgtattttttgtagagatggaatttcaccatgttgcccagg

SEQ ID NO: 67180 - DNA, 601 bp, Human
ccttccctcagttgcatgctacgcctgggagcagaattgctgggtcccagggtgactctggctttgccctctgagaagcgtccagagagtttgccccagtggccgccctatggggcaggcccagcagccgtgcagccgtggctcctgccagtggcctccctggggcctttcagctgaggggccattgatcccgctttcgtagccctgctttcaggggtagggctcttgcccttagatcttggtttgccacttgccctgtctcccgctgtgatctcttccagctgtggccctctctgagagtccatattcatatttgggcttagatctccatcagcttctgaaacacgcatctgcaaactgcagactgattttgtcgataaagttttattggcacatacccatttctgccatgttgcccatggtgcttcagcagcagcagcagagccgagtgctggagacagtccgtgtggtcgggaaggctgggtgtgctctctggctctctgcagaagcagattgctgctgtctaatctggaagtttccagggagtgggatttttggggtttgtgtctctttttccaagtccccctaggtgtgcttatcc

SEQ ID NO: 67181 - DNA, 601 bp, Human
ccctcagttgcatgctacgcctgggagcagaattgctgggtcccagggtgactctggctttgccctctgagaagcgtccagagagtttgccccagtggccgccctatggggcaggcccagcagccgtgcagccgtggctcctgccagtggcctccctggggcctttcagctgaggggccattgatcccgctttcgtagccctgctttcaggggtagggctcttgcccttagatcttggtttgccacttgccctgtctcccgctgtgatctcttccagctgtggccctctctgagagtccayattcatatttgggcttagatctccatcagcttctgaaacacgcatctgcaaactgcagactgattttgtcgataaagttttattggcacatacccatttctgccatgttgcccatggtgcttcagcagcagcagcagagccgagtgctggagacagtccgtgtggtcgggaaggctgggtgtgctctctggctctctgcagaagcagattgctgctgtctaatctggaagtttccagggagtgggatttttggggtttgtgtctctttttccaagtccccctaggtgtgcttatcccagc

SEQ ID NO: 67182 - DNA, 601 bp, Human
agggtgactctggctttgccctctgagaagcgtccagagagtttgccccagtggccgccctatggggcaggcccagcagccgtgcagccgtggctcctgccagtggcctccctggggcctttcagctgaggggccattgatcccgctttcgtagccctgctttcaggggtagggctcttgcccttagatcttggtttgccacttgccctgtctcccgctgtgatctcttccagctgtggccctctctgagagtccatattcatatttgggcttagatctccatcagcttctgaaacacgcrtctgcaaactgcagactgattttgtcgataaagttttattggcacatacccatttctgccatgttgcccatggtgcttcagcagcagcagcagagccgagtgctggagacagtccgtgtggtcgggaaggctgggtgtgctctctggctctctgcagaagcagattgctgctgtctaatctggaagtttccagggagtgggatttttggggtttgtgtctctttttccaagtccccctaggtgtgcttatcccagcccagattgagaggctgggggcagggcaaggggagggctgaagtc

SEQ ID NO: 67183 - DNA, 601 bp, Human
cctctgagaagcgtccagagagtttgccccagtggccgccctatggggcaggcccagcagccgtgcagccgtggctcctgccagtggcctccctggggcctttcagctgaggggccattgatcccgctttcgtagccctgctttcaggggtagggctcttgcccttagatcttggtttgccacttgccctgtctcccgctgtgatctcttccagctgtggccctctctgagagtccatattcatatttgggcttagatctccatcagcttctgaaacacgcatctgcaaactgcagactgrttttgtcgataaagttttattggcacatacccatttctgccatgttgcccatggtgcttcagcagcagcagcagagccgagtgctggagacagtccgtgtggtcgggaaggctgggtgtgctctctggctctctgcagaagcagattgctgctgtctaatctggaagtttccagggagtgggatttttggggtttgtgtctctttttccaagtccccctaggtgtgcttatcccagcccagattgagaggctgggggcagggcaaggggagggctgaagtcggagtccggggcagggagc

SEQ ID NO: 67184 - DNA, 601 bp, Human
agtgggatttttggggtttgtgtctctttttccaagtccccctaggtgtgcttatcccagcccagattgagaggctgggggcagggcaaggggagggctgaagtcggagtccggggcagggagcgttgctcagaggggacaagcaagggctgagtctccactctggggggcctgggagggccccgtggctcccagagcccagggcaaggctcccttctttcccatctgggtcccacccagtatgtcccctccccagtccctcagccaaactgtggctggtcatgtcggcctgtgcgccccsgggacggggacacagagcatcaggaggggaaaggatggcccccccacagtgtctgccccaaagggtgttcacatgtgtgtgcaagcacgtgtctgtgcggttggccttcctttgtgacagggcagcaagctggggcctgatgccacccgccgcccagggttccgtgagggggaggcggctcgtgttggggcaccatgtaaactgttgagtgcggcagctcgggggccacacgccgtccttagcaccgggtgtggtatctgctcttgatgatgtttgataagcatttttcggacgaaagag

SEQ ID NO: 67185 - DNA, 601 bp, Human
tgggcttcctgcctcccggtgtgtctggagaattcgaggcagcgagtgctggggctgttggttagttctgtcgtcgtgcttggtcgtgctcggcgctgcactgccctcctgtgggtcctgggtttgaagtgtgtgtgttctacacgtgcttgttccccacaccgtcccctccccacctctaagaagtgaatcgaagcccggcctccccggcaccctgcagaccgcaccgccgggaggctttgcttgtggggccttgttcggaggaaccacaccgccaggcggcctcgcgtttttctgacaygtgttcacacggaactgtcagtggtcctgactgcacagcctgcggaatgccgcccgggccagccgaggcctggaagaggggccgtcacaagctttctggtggatgtgtggccccagcgagctctcgacgtctcccctgcccgccctcgcaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgc

SEQ ID NO: 67186 - DNA, 601 bp, Human
cgccgggggcagggatgcggtgggcccgggccacctggccggatggagggaccagagcagatccctggaggggccacgccttggcaggagccggtggactctggtgtgacactggcctgcttgtatgcctggccctgccgctgccctccctgggtcaggagtgagctcctggccaccctcggtgctggagcccggcctgtggcctgtgggggaaacccagggtctcctaggagggccgtgggatgggaggtagacacaacctgggccgtctcgctcctgcctgggacatcgtccccagagscacgtctcccactattgactggctgtgaccttgactgatgtcagggttctcccagtctctgggcctgggatagggggtgacttgtgtgctgacaggtggccgggccatggccgcaggtggaggcccccgcgtggcaggctgtgcactgctgccctccatgcttggcaggcagaggccccggccctcccccagcaccgggagagaccctaaggcgacagggacaggcctgtcccccgcccctcctgcccgtcctctgtgtgttccctgcctctgggaggttgtgggagggcccagataacc

SEQ ID NO: 67187 - DNA, 601 bp, Human
tgcggtgggcccgggccacctggccggatggagggaccagagcagatccctggaggggccacgccttggcaggagccggtggactctggtgtgacactggcctgcttgtatgcctggccctgccgctgccctccctgggtcaggagtgagctcctggccaccctcggtgctggagcccggcctgtggcctgtgggggaaacccagggtctcctaggagggccgtgggatgggaggtagacacaacctgggccgtctcgctcctgcctgggacatcgtccccagaggcacgtctcccactaktgactggctgtgaccttgactgatgtcagggttctcccagtctctgggcctgggatagggggtgacttgtgtgctgacaggtggccgggccatggccgcaggtggaggcccccgcgtggcaggctgtgcactgctgccctccatgcttggcaggcagaggccccggccctcccccagcaccgggagagaccctaaggcgacagggacaggcctgtcccccgcccctcctgcccgtcctctgtgtgttccctgcctctgggaggttgtgggagggcccagataaccaagcacttggaacaa

SEQ ID NO: 67188 - DNA, 601 bp, Human
gcacccggcctcttacaacccccaccccaggcagaccactcgaggggcgccccactcaggactgcccagggcgtcaaaaacgggaaactgtcccaacccagagggctgggcaggaaaaggcatgaggggaaccaaggaagccggaatcaagcgtggacttcagtagctgcgctgtgtagacactggctcattgctcgtggtgggtgccgcacccacgtacagggagcagcagggagacgggcacggggatctgctgggacctctgcagcctctgcagctgcgactctcctaatgatgcgcytgtttgtgaagcctcatccctggggccagccaggcctctctcgggaagtcccctgccctgggtcaccgtctccctccttggtggccgtctctggacagctctactacaaaccccccgaaccagctggagtcctcgtcctgggactttctcttgtgctgggtcatttctgtcccctgagaccccagagaggatagaggttgggaggctcgtatcccgaccccagggtctccattggcccgagccctccgggctgcttcagacactgccgtaggtggcgcagtgcgcggtccaccccctcct

SEQ ID NO: 67189 - DNA, 601 bp, Human
cctggggccagccaggcctctctcgggaagtcccctgccctgggtcaccgtctccctccttggtggccgtctctggacagctctactacaaaccccccgaaccagctggagtcctcgtcctgggactttctcttgtgctgggtcatttctgtcccctgagaccccagagaggatagaggttgggaggctcgtatcccgaccccagggtctccattggcccgagccctccgggctgcttcagacactgccgtaggtggcgcagtgcgcggtccaccccctcctggtggctttccgtcctccygctggtttgggtgctgtgtccctgtcctgcccccccacccccggcagccggcctgagcacccaccgctgtgttgcagctacctgaccgacgttgaccgcatcgccaccttgggctacctgcccacccagcaggacgtgctgcgggtccgcgtgcccaccaccggcatcatcgagtaccctttcgacctggagaacatcatcttccggtaccgcccgggccacagcaggcggggagggggcactgagaggctcatttgcccggtgtgccggctcatgcctgcgcacccagtgctttgggag

SEQ ID NO: 67190 - DNA, 601 bp, Human
ttctcccgcctgtgcgtggcctgagagtgtgaggttgagctgctcaccacgcggggcagggcgctgcgcctgctcttctgccccaggaggataccggcaactctgccctctgcagccgtcactggagggtccctgcagggagcaactgtggcatcagtgtttactcctgcgagtgacgcttggtgaacatctgtgtccctggcccagtgaggggaaaggcttctgtgctcagggtgacatccagatgccagatgtagggtccctgggcacccatcgcaggttcccgcagcagctggcgccyagaatcctctgggttctcacacccccacactagcgcccgcttccctgggcccagtggtctcaggcccctttgccagtgagggaagggtctgcggtggtcacccctggaggcggtgcggccgctctctgagagcgtccttgcccgttctaagagtgggggctcttcctgctccagccgatgtcagtctggtgtggcaggaggggcttgggtgggagccgtcctgggattgcagattgggccttggggcgccaggtggctgagtcctggcgctgtgtcctttcaggatggtggatgtggggg

SEQ ID NO: 67191 - DNA, 601 bp, Human
gcgccaggtggctgagtcctggcgctgtgtcctttcaggatggtggatgtggggggccagcggtcggagcggaggaagtggatccactgctttgagaacgtgacatccatcatgtttctcgtcgccctcagcgaatacgaccaagtcctggtggagtcggacaacgaggtgggccctgccctgagcaggggcagcgttgggggccgggccttccccacctgccaagcctgggtcccctcacctgggtccccccagctgccccttgggctgtgtgcagtggggagggcccctctgattccckctgccttcgctcccgccagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtgcgccgggctgcggcatggggaggggctcgcgggcagggccttactggggggagggggctgatatgggagaggggctcatacaggccgggagctctaagggagggcgtctgatgggaggtgtcat

SEQ ID NO: 67192 - DNA, 601 bp, Human
gccagcggtcggagcggaggaagtggatccactgctttgagaacgtgacatccatcatgtttctcgtcgccctcagcgaatacgaccaagtcctggtggagtcggacaacgaggtgggccctgccctgagcaggggcagcgttgggggccgggccttccccacctgccaagcctgggtcccctcacctgggtccccccagctgccccttgggctgtgtgcagtggggagggcccctctgattccctctgccttcgctcccgccagaaccggatggaggagagcaaagccctgttccggacyatcatcacctacccctggttccagaactcctccgtcatcctcttcctcaacaagaaggacctgctggaggacaagatcctgtactcgcacctggtggactacttccccgagttcgatggtgcgccgggctgcggcatggggaggggctcgcgggcagggccttactggggggagggggctgatatgggagaggggctcatacaggccgggagctctaagggagggcgtctgatgggaggtgtcatgtatgggagtggagtctcagggaagggagatctcgtatgaggggggcctgtacgg

SEQ ID NO: 67193 - DNA, 601 bp, Human
gccaagcctgggtcccctcacctgggtccccccagctgccccttgggctgtgtgcagtggggagggcccctctgattccctctgccttcgctcccgccagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtgcgccgggctgcggcatggggaggggctcgcgggcagggccttagtggggggagggggctgatatgggagaggggctcatacaggccgggagctctaagggagggcgtctgatgggaggtgtcatgtatgggagtggagtctcagggaagggagatctcgtatgaggggggcctgtacgggaatgagttctccgacgcgggtgtctcatacccgtgggagatctgttaatgcagggactccttatacaggaggggtctcgggtgggaggggtctcgggcagggggatctcgggtgggaggagtcttgtacaaggagggcaccatgggagggggagtcttgtattg

SEQ ID NO: 67194 - DNA, 601 bp, Human
ctgggtcccctcacctgggtccccccagctgccccttgggctgtgtgcagtggggagggcccctctgattccctctgccttcgctcccgccagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtgcgccgggctgcggcatggggaggggctcgcgggcagggccttactggggggagggggctgatatgggagaggggctcatacaggccgggagctctaagggagggcgtctgatgggaggtgtcatgtatgggagtggagtctcagggaagggagatctcgtatgaggggggcctgtacgggaatgagttctccgacgcgggtgtctcatacccgtgggagatctgttaatgcagggactccttatacaggaggggtctcgggtgggaggggtctcgggcagggggatctcgggtgggaggagtcttgtacaaggagggcaccatgggagggggagtcttgtattggtgggtc

SEQ ID NO: 67195 - DNA, 601 bp, Human
ccgtgggagatctgttaatgcagggactccttatacaggaggggtctcgggtgggaggggtctcgggcagggggatctcgggtgggaggagtcttgtacaaggagggcaccatgggagggggagtcttgtattggtgggtcttgtacgggagggagttgtcgtatgggggtgtcctgtataggtgatcccatatgggaggggtctcacaggaagggttcacgcacactgccagcgcagccccgtggggaccttggtggtagtccctgcatcctcctctgtgccctactgcccccaccctcrgacccgtccctccctacgtggcccctgccccacggggtgtgtcagggcagctgagcactgagggtcttcacatgcccagccctctctgggcctggggatggcggccaggggagggtgttgtgtgccctcgtctgtgtggtcagtggctgccgttagtgctgtcaccactcagagctgtccctgccaggcacagtgaggccctgggcagctctggcgccctcatttccaccccggatctgtgctcctcccgtgagtctcgggtgtcatcttcgggagggcccctcagggtgccctgcctct

SEQ ID NO: 67196 - DNA, 601 bp, Human
agggtcttcacatgcccagccctctctgggcctggggatggcggccaggggagggtgttgtgtgccctcgtctgtgtggtcagtggctgccgttagtgctgtcaccactcagagctgtccctgccaggcacagtgaggccctgggcagctctggcgccctcatttccaccccggatctgtgctcctcccgtgagtctcgggtgtcatcttcgggagggcccctcagggtgccctgcctctggatgtgcagcgagagggaggggtctggcacacggtatagcctcggccgctggctgcaggygcagggccctgctgtccctgggcaggggagtggcggggggcgctgcacctgctccagccgcacgtggcccctgcccagcagcctgtcctgtgggctcagagagccctggtggggggaggccaagggactggggcatagacccctgtcccaccagtccccagagcagccccttgaacacccccaggggcctttccaccggggcaggcaggagttactgggcgggtcgcctgcattgtccagggtggtggaggggcaggggtggccggtgggaagcagcgcccctgctggagcccctggatg

SEQ ID NO: 67197 - DNA, 601 bp, Human
agagctgtccctgccaggcacagtgaggccctgggcagctctggcgccctcatttccaccccggatctgtgctcctcccgtgagtctcgggtgtcatcttcgggagggcccctcagggtgccctgcctctggatgtgcagcgagagggaggggtctggcacacggtatagcctcggccgctggctgcaggcgcagggccctgctgtccctgggcaggggagtggcggggggcgctgcacctgctccagccgcacgtggcccctgcccagcagcctgtcctgtgggctcagagagccctggyggggggaggccaagggactggggcatagacccctgtcccaccagtccccagagcagccccttgaacacccccaggggcctttccaccggggcaggcaggagttactgggcgggtcgcctgcattgtccagggtggtggaggggcaggggtggccggtgggaagcagcgcccctgctggagcccctggatgtctctgaggcctggctgcagcaggggcaccgtgggtgggtgggggccactgttcctgctctgtaggctctgtgcccagccctgggggcctctcctctcaccctgggcctt

SEQ ID NO: 67198 - DNA, 601 bp, Human
tgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaayttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcatgaatgaatgaatgaatgaatgaatgaatgtttttggttgagaggcgggactttggtcttcccgagcctccatttctccgccaacataaaataaaaaacataatggcactttcctcagagacatcgatgtaccttag

SEQ ID NO: 67199 - DNA, 601 bp, Human
agtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaacttttttttttttttttttttgaggtagagtctcrctctgtcgcccaggctggagtgcagcggtgcgatcttggctcactgcagcctccggggaggcaggacatttctgaggtccacagtgcagggcttggtactcagtaggtgcccaataaatacctgttgcatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataag

SEQ ID NO: 67200 - DNA, 601 bp, Human
ttgctaaactaattctcctctttcctgactctggtgggtgacctgcccccacccccggaccgtttcttgccctgaaatgaagtcagcagaaacccccacttcctcagggctgctgcagattcagggaggcagcacaacttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcgtgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaa

SEQ ID NO: 67201 - DNA, 601 bp, Human
tcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccracagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggggggggggtgccaggaggcccagggaccagtcccagctcagttcctccctgactgtgtgactttggtggaagatttcatgcctcagtctcctcctcgaggtagtg

SEQ ID NO: 67202 - DNA, 601 bp, Human
ggtgcatggataaggggggtcccagaggcagaagatgggagcattgcttcagtggtctggatgctggagatgctaacagatcaaagctgtgcccttgtgggaccaacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggkgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaat

SEQ ID NO: 67203 - DNA, 601 bp, Human
actttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccacckcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctc

SEQ ID NO: 67204 - DNA, 601 bp, Human
cgcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacytggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattc

SEQ ID NO: 67205 - DNA, 601 bp, Human
aggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggartttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacctggtctgatcccctggggaggacaagggaggatggggcagcaggtccatgacccagttacaagctgtttgtcttcctgcctctgtaactagccggggtcaccactgacgtgggcccccacccctgcccgcctccctggcacc

SEQ ID NO: 67206 - DNA, 601 bp, Human
gccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccrgccaaccaggccctgcctctcacctggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggg

SEQ ID NO: 67207 - DNA, 601 bp, Human
gttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactrccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagc

SEQ ID NO: 67208 - DNA, 601 bp, Human
cagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcrttttttgtttttttgttttttgttttcccaagatggagtctcgccctgtcacccaggctggagtacagtggagtgatcttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccg

SEQ ID NO: 67209 - DNA, 601 bp, Human
cagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcgttttttgtttttttgttttttgttttcccaagatggagtctcgccctgtcacccaggctggagtacagtggagtgaycttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcgg

SEQ ID NO: 67210 - DNA, 601 bp, Human; identical to SEQ ID NO: 32897

SEQ ID NO: 67211 - DNA, 601 bp, Human
ggggtgaggagaggagagggacaggccatcccagccctccgagggagagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggkcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacc

SEQ ID NO: 67212 - DNA, 601 bp, Human
ggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtktttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggc

SEQ ID NO: 67213 - DNA, 601 bp, Human
gtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggca

SEQ ID NO: 67214 - DNA, 601 bp, Human
tccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttwtatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggctta

SEQ ID NO: 67215 - DNA, 601 bp, Human
ggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgcccygttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgac

SEQ ID NO: 67216 - DNA, 601 bp, Human
caaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaaygatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggg

SEQ ID NO: 67217 - DNA, 601 bp, Human
tcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcrgcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggc

SEQ ID NO: 67218 - DNA, 601 bp, Human
agcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagktccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggc

SEQ ID NO: 67219 - DNA, 601 bp, Human
accgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgtttttttttaaggggtgattgaggccaggtgtggtggctcacacatgtaatcccagctacacaggaggctgaggcaggagagtcgcttgaacctaggaggcggaggttgcagcgagc

SEQ ID NO: 67220 - DNA, 601 bp, Human
ccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggrcctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattc

SEQ ID NO: 67221 - DNA, 601 bp, Human
aaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagygagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatgg

SEQ ID NO: 67222 - DNA, 601 bp, Human
acagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgygatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagg

SEQ ID NO: 67223 - DNA, 601 bp, Human
cccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctygctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggca

SEQ ID NO: 67224 - DNA, 601 bp, Human
gttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaayttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccag

SEQ ID NO: 67225 - DNA, 601 bp, Human
ccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccmcacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctg

SEQ ID NO: 67226 - DNA, 601 bp, Human
ccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggkccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgt

SEQ ID NO: 67227 - DNA, 601 bp, Human
gggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccrgtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgt

SEQ ID NO: 67228 - DNA, 601 bp, Human
cctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctctctctgtcgcccaggctggagtgcagcggtgcaatctcggctcactgcaacctccacctcctgggttcaagcagttctcctgcctcagcctcccgagtagctgcctcagcttcccragtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtggga

SEQ ID NO: 67229 - DNA, 601 bp, Human
agtatactggggaaattaattttaacattattttaagtaatgttaattttttttttccttgagacagagtctctctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtat

SEQ ID NO: 67230 - DNA, 601 bp, Human
aatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccmccccccccccccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacata

SEQ ID NO: 67231 - DNA, 601 bp, Human
tcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccccmccccccccccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacatagg

SEQ ID NO: 67232 - DNA, 601 bp, Human
cctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccaccccccccccccmcccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatc

SEQ ID NO: 67233 - DNA, 601 bp, Human
accccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctrtgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggtt

SEQ ID NO: 67234 - DNA, 601 bp, Human
acctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcrgggctgcagccaggctgggggctgggcaggtctcaaacccctggacctggggaatcagggaggtgtgagctgcatctgaggtcgggtgtctctgtgactctgtctctgtctctctacctctgattctccccaagctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtc

SEQ ID NO: 67235 - DNA, 601 bp, Human
aaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcggggctgcagccaggctgggggctgggcaggtctcaaacccctggacctggggaatcagggaggtgtgagctgcatctgaggtcgggtgtctctgtgactctgtctctgtctctctacctctgattctccccargctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggg

SEQ ID NO: 67236 - DNA, 601 bp, Human
gttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcckgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtg

SEQ ID NO: 67237 - DNA, 601 bp, Human
caggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggmgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaa

SEQ ID NO: 67238 - DNA, 601 bp, Human
atgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgkggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggat

SEQ ID NO: 67239 - DNA, 601 bp, Human
aggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcasaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggtta

SEQ ID NO: 67240 - DNA, 601 bp, Human
ggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctytttttttttcttttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcct

SEQ ID NO: 67241 - DNA, 601 bp, Human
ccgtgcagtcactaagcaactaagcaaatccataggcaatcactaacttcctctgaaggaaagaaaacagaaggctgagattgagggtggccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgaggrggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcacca

SEQ ID NO: 67242 - DNA, 601 bp, Human
gtcactaagcaactaagcaaatccataggcaatcactaacttcctctgaaggaaagaaaacagaaggctgagattgagggtggccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgt

SEQ ID NO: 67243 - DNA, 601 bp, Human
aggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgccaggatgtggaggctcagagagggagagtgcttttagtgaggtcacacagcactggcaaaactgacagctgcttccctccttagagcaycttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctg

SEQ ID NO: 67244 - DNA, 601 bp, Human
cagattttcctccctgtccctggggcgggcggggagtgcggagaacatctatgggcttgtgttttttcctcttttgatttgtccagacaggcgatggacaagggctgggcaggggttttaggtcatctgcactgccaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaattwatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgc

SEQ ID NO: 67245 - DNA, 601 bp, Human
ttttcctccctgtccctggggcgggcggggagtgcggagaacatctatgggcttgtgttttttcctcttttgatttgtccagacaggcgatggacaagggctgggcaggggttttaggtcatctgcactgccaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttattwatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgccc

SEQ ID NO: 67246 - DNA, 601 bp, Human
agggctgggcaggggttttaggtcatctgcactgccaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgrgttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggctt

SEQ ID NO: 67247 - DNA, 601 bp, Human
gcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcraactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaa

SEQ ID NO: 67248 - DNA, 601 bp, Human
cacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggrttgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctg

SEQ ID NO: 67249 - DNA, 601 bp, Human
aaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttcsgccagtttcattgcctccgtagaacctagaaccgtgtgaaatgatctgaggcttcctccgtgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagc

SEQ ID NO: 67250 - DNA, 601 bp, Human
cacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaayatagcgagactgcgtctctacttttttttttcctgagacggagtctcgctcctttgcccaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatg

SEQ ID NO: 67251 - DNA, 601 bp, Human
cagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaatatagcgagactgcgtctctacttttttttttcctgagacggagtctcgctcctttgcccaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgt

SEQ ID NO: 67252 - DNA, 601 bp, Human
tggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaatatagcgagactgcgtctctacttttttttttcctgagacggagtctcgctcctttgcmcaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaa

SEQ ID NO: 67253 - DNA, 601 bp, Human
tcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaatatagcgagactgcgtctctacttttttttttcctgagacggagtctcgctcctttgcccaggctggagtgcagtggttcgatctcggctcactgcaagctccgcctcccgggytcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagag

SEQ ID NO: 67254 - DNA, 601 bp, Human
ggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggagscccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattgg

SEQ ID NO: 67255 - DNA, 601 bp, Human
gcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttayagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgtttttgttttttttgagatagggtctccctctgttgcccaggctggagtgcagtggctcaatcatagctcacccactgcagcctcgacctcctgggctc

SEQ ID NO: 67256 - DNA, 601 bp, Human
cagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttacagatgagcggagagccgctggaggttggaggctccgrcagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgtttttgttttttttgagatagggtctccctctgttgcccaggctggagtgcagtggctcaatcatagctcacccactgcagcctcgacctcctgggctcaagcagtcctcctgcctcagcctcttgagtagctgat

SEQ ID NO: 67257 - DNA, 601 bp, Human
aacctctagctatccccgtcccctccgtaagctcctctgagcatagcaacagaacgggaaggtaaggcagcgattggaaacgcccgcgttacagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgtttttgtkttttttgagatagggtctccctctgttgcccaggctggagtgcagtggctcaatcatagctcacccactgcagcctcgacctcctgggctcaagcagtcctcctgcctcagcctcttgagtagctgatactacaggtgtgcatcaccacagccaggtaacttttttttttaaagtagagatggggtggggtatcctgtgttgcccaggcttgtctcaaactcctgagctcaagtaatcctccctccttgaccttccaaagtgcaggaattataggtgtgagccaccatgcccagccctcc

SEQ ID NO: 67258 - DNA, 601 bp, Human
tgagatagggtctccctctgttgcccaggctggagtgcagtggctcaatcatagctcacccactgcagcctcgacctcctgggctcaagcagtcctcctgcctcagcctcttgagtagctgatactacaggtgtgcatcaccacagccaggtaacttttttttttaaagtagagatggggtggggtatcctgtgttgcccaggcttgtctcaaactcctgagctcaagtaatcctccctccttgaccttccaaagtgcaggaattataggtgtgagccaccatgcccagccctccagtgcttttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgc

SEQ ID NO: 67259 - DNA, 601 bp, Human
gacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaaktcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcact

SEQ ID NO: 67260 - DNA, 601 bp, Human
tcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactrgactgagctcagctgcagaaagcagcacatttcagagggtgtctaccgggccaggagaaaacacacaaaccgccaacattttaaagcttgtaatcgacatcgtatacaactggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaa

SEQ ID NO: 67261 - DNA, 601 bp, Human
gtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaattcctgacctcaagcaatcctcctgccaaggcaatcctctcaaaatgcagggattacaggtgtgagccactgtgcccagcctgttcatacgttttaaagagaggtgcagacaaaactgggttggtgcatccacwtccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagc

SEQ ID NO: 67262 - DNA, 601 bp, Human
gccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctccyaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttcc

SEQ ID NO: 67263 - DNA, 601 bp, Human
aaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgtttyttgagatggagtctcgctctgtctcccaggctggagtacaatggcgcgatcttggctcactgcagccatcccccgggttcaagcaattctcccgtctcagcctccggagtagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttatttgctgacttgtt

SEQ ID NO: 67264 - DNA, 601 bp, Human
ttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagtagctgggattacaggcacgcaccaccaygccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttatttgctgacttgttcatttcctgtcacgttcccattagaacatcagtgcctcgagaggagggattcttgtctgtctctgtcgccgctgtgtcccttgggcgtctggcatccgggtggctctctgcaatctgtttgctgagtgatcaaaggaa

SEQ ID NO: 67265 - DNA, 601 bp, Human
ccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttatttgctgacttgttcatttcctgtcacgttcccattagaacatcagtgcctcgagaggagggattcttgtctgtctctgtcgccgctgtgtcccttgggcgtctggcatccgggtggctctctgcaatctgtttgctgagtgatcaaargaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagt

SEQ ID NO: 67266 - DNA, 601 bp, Human
aggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaggaaaagaccatacttagctgactgtgcaagaataggcawccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgc

SEQ ID NO: 67267 - DNA, 601 bp, Human
ggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcrtgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccg

SEQ ID NO: 67268 - DNA, 601 bp, Human
attaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagcgagctgagatcgcaccattgcactccagcctgggcgacacrgcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcctgagatcaggaacaagacaaggacaccactttccccatttctattgaacattgtactggaagttctgccagaccaataaggcaagaaaagaggctggacgtggtagctcacacctgtaatcccagcactttgagag

SEQ ID NO: 67269 - DNA, 601 bp, Human
tggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagcgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcctgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggat

SEQ ID NO: 67270 - DNA, 601 bp, Human
agctcaaagtgatctgcccgcctcggcctcccaaagtgctgggattacaggagtgagccactgcacctggactgtttttttgtattttttgtaaaaacggggtctcactatgttgccctggctagtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatmccagcactttgggaggccgaggcgggcggatcaccaggtcaggagatcgagaccatcctggctaacacggtgaaaccccgtctctattaaaaattcaaaaaattagccaggcgtggtggcgggtgcctgtagtcccagctactcaggagactgaggcaggagaatggcgtgaacccaggagacggagcttgcagtgagccgagatcatgccactgcactccagcctgggcgacagagcgagactccgtctcaaaaaaaaaaggaaagtgaccttctcaggagcacaaagacccggggggt

SEQ ID NO: 67271 - DNA, 601 bp, Human
tacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgttkgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgc

SEQ ID NO: 67272 - DNA, 601 bp, Human
ccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagayggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttg

SEQ ID NO: 67273 - DNA, 601 bp, Human
ggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctstctcagtctcccaagtagctgggattacaggtgcgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattc

SEQ ID NO: 67274 - DNA, 601 bp, Human
caagtagctgggattacaggtgcgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaasttcttacccacgactgagccggccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctcttt

SEQ ID NO: 67275 - DNA, 601 bp, Human
cgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaacttcttacccacgactgagccgsccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggca

SEQ ID NO: 67276 - DNA, 601 bp, Human; identical to SEQ ID NO: 32898

SEQ ID NO: 67277 - DNA, 601 bp, Human; identical to SEQ ID NO: 32899

SEQ ID NO: 67278 - DNA, 601 bp, Human; identical to SEQ ID NO: 32900

SEQ ID NO: 67279 - DNA, 601 bp, Human; identical to SEQ ID NO: 32901

SEQ ID NO: 67280 - DNA, 601 bp, Human; identical to SEQ ID NO: 32902

SEQ ID NO: 67281 - DNA, 601 bp, Human; identical to SEQ ID NO: 32903

SEQ ID NO: 67282 - DNA, 601 bp, Human; identical to SEQ ID NO: 32904

SEQ ID NO: 67283 - DNA, 601 bp, Human; identical to SEQ ID NO: 32905

SEQ ID NO: 67284 - DNA, 601 bp, Human; identical to SEQ ID NO: 32906

SEQ ID NO: 67285 - DNA, 601 bp, Human; identical to SEQ ID NO: 32907

SEQ ID NO: 67286 - DNA, 601 bp, Human; identical to SEQ ID NO: 32908

SEQ ID NO: 67287 - DNA, 601 bp, Human; identical to SEQ ID NO: 32909

SEQ ID NO: 67288 - DNA, 601 bp, Human
cgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgyggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtc

SEQ ID NO: 67289 - DNA, 601 bp, Human
ccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggsggggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcac

SEQ ID NO: 67290 - DNA, 601 bp, Human
ccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggcggagacaaagaggaagcccccaccagcttctgctctgtgattgggaatcgcagagctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcaccca

SEQ ID NO: 67291 - DNA, 601 bp, Human
tctgtgattgggaatcgcagagctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttyagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagaca

SEQ ID NO: 67292 - DNA, 601 bp, Human
agctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcacygtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggac

SEQ ID NO: 67293 - DNA, 601 bp, Human
aacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacytcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggct

SEQ ID NO: 67294 - DNA, 601 bp, Human
tgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccacccgcctcggcctcccaaagtgctgggattacaggcgtgagccactgcgccyggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgct

SEQ ID NO: 67295 - DNA, 601 bp, Human
ctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacktggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggccc

SEQ ID NO: 67296 - DNA, 601 bp, Human
cgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccastgcactccagtctgggcaacagagtgagaccctatctcaaaaaaaaaaaaagaaaaagaaaaaagtctgccccctgctcacaacggattaaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacct

SEQ ID NO: 67297 - DNA, 601 bp, Human
tgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccactgcactccagtctgggcaacagmgtgagaccctatctcaaaaaaaaaaaaagaaaaagaaaaaagtctgccccctgctcacaacggattaaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagagg

SEQ ID NO: 67298 - DNA, 601 bp, Human
acctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccactgcactccagtctgggcaacagagtgagaccctatctcaaaaaaaaaaaaagaaaaagaaaaaagtctgccccctgctcacaacggawtaaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattg

SEQ ID NO: 67299 - DNA, 601 bp, Human
gggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagcyggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgt

SEQ ID NO: 67300 - DNA, 601 bp, Human
gatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaragaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggaggggcgtatggatgtgttccctgagaggaaagatggcc

SEQ ID NO: 67301 - DNA, 601 bp, Human
acagagaggaggtcagatgggcgtgtgtgttaaacagacaggaagaagctctgatgggggagccctcgggcctgcgtcctcctcacagtcaatattctcagatggggcattcaggatgccgggaggggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcrtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatata

SEQ ID NO: 67302 - DNA, 601 bp, Human
gagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggamggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagc

SEQ ID NO: 67303 - DNA, 601 bp, Human
tgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtygcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacag

SEQ ID NO: 67304 - DNA, 601 bp, Human
actgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactccyaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcg

SEQ ID NO: 67305 - DNA, 601 bp, Human
ggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagcctycgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaag

SEQ ID NO: 67306 - DNA, 601 bp, Human
gacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcrcagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggc

SEQ ID NO: 67307 - DNA, 601 bp, Human; identical to SEQ ID NO: 32910

SEQ ID NO: 67308 - DNA, 601 bp, Human; identical to SEQ ID NO: 32911

SEQ ID NO: 67309 - DNA, 601 bp, Human
aagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttmaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggc

SEQ ID NO: 67310 - DNA, 601 bp, Human
cagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgyccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgca

SEQ ID NO: 67311 - DNA, 601 bp, Human
agaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacaccccyggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccac

SEQ ID NO: 67312 - DNA, 601 bp, Human
cccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccrcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagagggga

SEQ ID NO: 67313 - DNA, 601 bp, Human
gggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggargggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggtt

SEQ ID NO: 67314 - DNA, 601 bp, Human
tctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacrtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggg

SEQ ID NO: 67315 - DNA, 601 bp, Human
gagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctcyggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccagg

SEQ ID NO: 67316 - DNA, 601 bp, Human
aaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactcygtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgca

SEQ ID NO: 67317 - DNA, 601 bp, Human
tactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggygtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgt

SEQ ID NO: 67318 - DNA, 601 bp, Human
tcccgccggccgcttcagccgtcccggctcggggaggtcgggagggacctgagggcggggagaggtcaagcgaaagcccccatctgccgttcctggttcatttacaaaaaaattggggcccggaaatgggcgaggaaggcctctggctcgtcgcgagagtgtgttttgaaagagtcgcagcaggcgcctctcccggctggtggccctggggcctggcgctcacctggcgggcgccaggccgcagccctccgtctctgcgcggctgcaggttttggggtggggggtctcgggatgtccccargcgcggggtgccctggctctgcctccgcgggtccgggctctctgggcccggtagccggcgccggacaagcacggctggaacccggctcttccaaaaaacctggcgttccctgttacccgctagctctttctaggcgggtgggcggggtggagggggccctctgccagcgtccctcaattcgcacattttcagaaaggccccagagacctatttattcacacccttctccttgaccttttcccagagctagtgcctttggtttttagacaggtctcttacctcctggcttcaggaatggaa

SEQ ID NO: 67319 - DNA, 601 bp, Human
cctttcacctggagaagttcaggagagttctgaaatgtaaaaaaagaagaccaggcctgtgtagtttgaggaaaaaagatcgaacactttccagctctaagtttgttcctaaagaagaaacaggggtaaaacatcgggcagaaaaagtgtggggctttctgagtccagccagaccgaattctgccctgattcccctactcagagcctgccttgacacggatgacatagcccctccggcagcaggcgtcctctaccctgctgtcgccaggttttaaacaatcgtttctgcggatggggcgcyctttgcccacgttctgtgcggatcagcagttaggtggaaatgcggtagaggcagacttaatattatttactatactacttcctgcataatatgaatcttgacccttggtgttcagagaactctctttccctctccactcccctccccttcctctctcttaagattttagtttcagtattgttcttaatggttgaatcgaatgtcaaatgctgaggcaggtactggctttaaagatcaagaagtgtgtggatttgcacttgctttttaaatgtacccctcagagtgtatgagttacagcta

SEQ ID NO: 67320 - DNA, 601 bp, Human
gggctccatccttcaggcctcctcactcacagccggctctcttatcaggctggctgggattaagtccgagtcagggaactcagggccattgaaggaaacccataaatcaagtcaggttctagagagagaccttggggaatgtgatttaggcggtgtatctggagaggccaaataagcaaaggggcccttctccccctctgcagcaacctctcgggtgtcagccacaggcccttcattctgctacatttgatgggacatccctgtgggagagatgggtgaaggattctgtccccagcctgamccccaggtgtgccaggcaggtactccggggaccgccgggaattgagagtgggcctgagcccgggcttttgctgaaaaggaggccgatgcgaggtagagattccccaggtgtccctgacggcctcccagggccacactcaccctccttctctctcctgccctttccccgttgccccacagggagccaggtgtgccgcccgcctctgcttcatggatccctaccctggctggacggcggcaaagccctgggcagccaccacaccgcctccccctggaatctcagccccttctccaagacgtc

SEQ ID NO: 67321 - DNA, 601 bp, Human
gtttccaagaccaaatggaaggccgagggaataattcttgagtgtttcatgctaaaacgaaacctcctcaagcctaaacaaacacaggtccctctatgacccctttggcctctgtcattctgactgttcctctcgctcagctcaaaggggaccacgcagtgaggacagtcctttattagacgtgtagacacaaagtgtgtgtgcatgagcctggccaaagctgcacgcatattctctgcgtggaaaagggggctctcagctgaactgggagaaagcggtggctttgcattggggaagcagmgttgaatgaaaatcaaatgtcgcctggcccagttagttacctgcagcgtctcctagagctctcagtgcagtcaggggcaggaaaccgtattaggacatattgcttggctgagctgcagccagaggaggtagaaaggaacggaaaagtgctccaggtgtgtatctcagcttcctgtgctctgttcctttccaaaatgcaaacgctgcctagcagcacgctgcatttttattcagttggtgtcattacttgcatgaagaaaaaccccacacaaaatactttggctttaaaaataaatcgatc

SEQ ID NO: 67322 - DNA, 601 bp, Human
gcagccttgaaaccgagctcccaaagctccggtttgaaaaacttcagagggagtactctgggagcccagtgaccatgagatcagttttcagggtttttttccagggtgacattcactccgactgcctgagcaggactgtctctatttagttgatatgttttagctaatccaattattttcagactgctgcacgcgacagttgcattgtttatcctgagccaggaactttaatagagtccggatgcggttaggctgacagaagaacccagacctgcatgttcagtacatgaaagtaggcagragggagagggaggcaggctagctggtggagtcaaaaagaaagcaagaggccgggagagctggaggcacaaagtggccacggtgcctggcaggggctgggcttgggggtggagggaaggattaagaagtggggtgcagcttgactcagaaacacaggctggggagctgaatcgaaagagagcagacctatgcattttgaggttgtgatgggatttcttttctttttcttttttttttaaagttctcttttctggtaaggctatgaggttggggagagctcgtggtatctgaggccggcgta

SEQ ID NO: 67323 - DNA, 601 bp, Human
ccgtggtttccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctcctttttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagg

SEQ ID NO: 67324 - DNA, 601 bp, Human
gtggtttccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctcttctttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagggt

SEQ ID NO: 67325 - DNA, 601 bp, Human
tggtttccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctctttcttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagggtt

SEQ ID NO: 67326 - DNA, 601 bp, Human
ggtttccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctcttttctttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagggttt

SEQ ID NO: 67327 - DNA, 601 bp, Human
tccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctcttttttttmcccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagggtttcagg

SEQ ID NO: 67328 - DNA, 601 bp, Human
cccctccttttgcagggggtggaggtggtgggaattcttcaggaggggattctcttggttttagtggttgctctctctctctctctctctcttttttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctccmctgccacctttccagttgggcatctccctccactgtcgtctgatcgagctcctgccctgctccctaccccctcccacagcctggtttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtcacagaccag

SEQ ID NO: 67329 - DNA, 601 bp, Human
tcaggaggggattctcttggttttagtggttgctctctctctctctctctctcttttttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcrtctgatcgagctcctgccctgctccctaccccctcccacagcctggtttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtcacagaccagaggcagcaaggaaaaaagaagaagaaaagcccatagga

SEQ ID NO: 67330 - DNA, 601 bp, Human
cttagctcccctgccacctttccagttgggcatctccctccactgtcgtctgatcgagctcctgccctgctccctaccccctcccacagcctggtttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtsacagaccagaggcagcaaggaaaaaagaagaagaaaagcccataggaggcaatggcaaccttgccgagtgaatcaagacagaaaattaccctagtgtgcagaaccttgttgaagaggtaaccgttgctagctttcaaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactg

SEQ ID NO: 67331 - DNA, 601 bp, Human
tttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtcacagaccagaggcagcaaggaaaaaagaagaagaaaagcccataggaggcaatggcaaccttgccgagtgaatcaagacagaaaattaccctartgtgcagaaccttgttgaagaggtaaccgttgctagctttcaaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacaggg

SEQ ID NO: 67332 - DNA, 601 bp, Human
agctttcaaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacagggccagtgctgccccagaaggggctgacccagcagcyaccagggacacaaaaaggcaggcctgcggcctggcctgggctgcagccggttactcgcccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatc

SEQ ID NO: 67333 - DNA, 601 bp, Human
caaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacagggccagtgctgccccagaaggggctgacccagcagctaccagsgacacaaaaaggcaggcctgcggcctggcctgggctgcagccggttactcgcccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttgg

SEQ ID NO: 67334 - DNA, 601 bp, Human
ctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacagggccagtgctgccccagaaggggctgacccagcagctaccagggacacaaaaaggcaggcctgcggcctggcytgggctgcagccggttactcgcccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttggaatgtggagcaaaaaaaaaacctctcttac

SEQ ID NO: 67335 - DNA, 601 bp, Human
cccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttggaatgtggagcaaaaaaaaaacctctcttacatcctcatttttttttttttttaaaaaaacaaagtagacaaaaactagtgggcaccatccctgactttcaagggtgcaagaccctcttccatttgcaaaagtctttaactttcctgaagaacttacccctggagagtatcacaggcccccaagtgtgaacccccctagttccctcctacttgatctggggctttccaaaggcccaataggtcccatatctgccaaggcagatttttcctccttttaggggaatcaaaattctcaagcaccctactgggttctcttcttctaccccagtggtccgggcaggttggaggtcatt

SEQ ID NO: 67336 - DNA, 601 bp, Human
acccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttggaatgtggagcaaaaaaaaaacctctcttacatcctcatttttttttttttttaaaaaaacaaagtagacaaaaactagtgggcaccatccctgactttcaagggtgcaagaccctcttccatttgcaaaagtctttaactttcctgaagaacttacccctggagagtatcacaggcccccaagtgtgaacccccctagttccctcctacttgatctggggctttccaaaggcccaataggtcccatatctgccaaggcagatttttcctccttttaggggaatcaaaattctcaagcaccctactgggttctcttcttctaccccagtggtccgggcaggttggaggtcattaattact

SEQ ID NO: 67337 - DNA, 601 bp, Human
cctaggctaagaatcttttggaatgtggagcaaaaaaaaaacctctcttacatcctcatttttttttttttttaaaaaaacaaagtagacaaaaactagtgggcaccatccctgactttcaagggtgcaagaccctcttccatttgcaaaagtctttaactttcctgaagaacttacccctggagagtatcacaggcccccaagtgtgaacccccctagttccctcctacttgatctggggctttccaaaggcccaataggtcccatatctgccaaggcagatttttcctccttttagggkaatcaaaattctcaagcaccctactgggttctcttcttctaccccagtggtccgggcaggttggaggtcattaattactctcttaaaacaaaacagtcttcagagctcatttttcttccctacctaccctccggggtcctcctctgggcctcccctctctgggggaccaacttgagttaagcctcctgttcctgcaaggaaggggagtcctggctttctctgggcacccagagaactgggcgctagagacccgtgtgtccctgggtcccccaaaaccaaggagattctcctagaaagcat

SEQ ID NO: 67338 - DNA, 601 bp, Human
ttaactttcctgaagaacttacccctggagagtatcacaggcccccaagtgtgaacccccctagttccctcctacttgatctggggctttccaaaggcccaataggtcccatatctgccaaggcagatttttcctccttttaggggaatcaaaattctcaagcaccctactgggttctcttcttctaccccagtggtccgggcaggttggaggtcattaattactctcttaaaacaaaacagtcttcagagctcatttttcttccctacctaccctccggggtcctcctctgggcctcccytctctgggggaccaacttgagttaagcctcctgttcctgcaaggaaggggagtcctggctttctctgggcacccagagaactgggcgctagagacccgtgtgtccctgggtcccccaaaaccaaggagattctcctagaaagcatctttctcttcctcttgcaaagttgaaatcagttagccaactcccccatgtcttgaaatggtaatttaagggattcttccaaggagctttctgggtgggtctgggtcgctttccagcctgggctgagggagtgaatgctgctcagacttcctaccg

SEQ ID NO: 67339 - DNA, 601 bp, Human
agagaactgggcgctagagacccgtgtgtccctgggtcccccaaaaccaaggagattctcctagaaagcatctttctcttcctcttgcaaagttgaaatcagttagccaactcccccatgtcttgaaatggtaatttaagggattcttccaaggagctttctgggtgggtctgggtcgctttccagcctgggctgagggagtgaatgctgctcagacttcctaccggcctggctggtttttcgtttattttgtttgtttgtgtttttgggaaaagagaaactgtaggcaggccttggttamtgagcagccaccccgctttgttaacttgcctcttctcctgatcttcctctgatcggcttcactctgtcctcccaaaccttcccttttcctttttccctccctccccctcttccaggttccctgcctaaagtttgcatttcccccttgcaccccctggctggggtcatactttaacttcagtctccgtaacagcggctggaaagctatggaaacccctgctgggtcctaatcgcttcctttccagccagggacatttgcagtttgattggaagtaaaatctaaaaccctagctagtgaaat

SEQ ID NO: 67340 - DNA, 601 bp, Human
atcggcttcactctgtcctcccaaaccttcccttttcctttttccctccctccccctcttccaggttccctgcctaaagtttgcatttcccccttgcaccccctggctggggtcatactttaacttcagtctccgtaacagcggctggaaagctatggaaacccctgctgggtcctaatcgcttcctttccagccagggacatttgcagtttgattggaagtaaaatctaaaaccctagctagtgaaatcaatcagccgattgatcaatctatgcatctatttattatctgttcacctatytagccattgatgaatccttcctttcccccatcctaatcttcattatttaatcaatctctatagacagacccatgatgataatgggtcacctttgtcttcctttttttcctttgagggaaatgaatggaatgtttgccttttgccaccatccagggctcaggattttctcagggaagtatttgtagctggaatctgcattcctccttggtcctgcccgatcttctccatcaagtcgggcaagccaagaacagggttctgttgcaacgatgcatctgccccttctgcgggcgcctccgtgtg

SEQ ID NO: 67341 - DNA, 601 bp, Human
ctatctagccattgatgaatccttcctttcccccatcctaatcttcattatttaatcaatctctatagacagacccatgatgataatgggtcacctttgtcttcctttttttcctttgagggaaatgaatggaatgtttgccttttgccaccatccagggctcaggattttctcagggaagtatttgtagctggaatctgcattcctccttggtcctgcccgatcttctccatcaagtcgggcaagccaagaacagggttctgttgcaacgatgcatctgccccttctgcgggcgcctccrtgtgtgtcgggggaacggtcatgccaggacagcattccccagctcaactttggagcatcttggaaagaggtgggggtggacacgctccccaaaagaggagggagaaggaaaaaagttctccattttacgtttctcccccagttccaaatgctgtcagctttcctgcgtgttttccttccctaagtggcttatctgtgcttttgtttccagaaggcagggagtgtgtgaactgtggggcaacctcgaccccactgtggcggcgagatggcacgggacactacctgtgcaacgcctgcgggc

SEQ ID NO: 67342 - DNA, 601 bp, Human
cctccaatcgtgtcagctggcttgggacagtttttttttttttcctttttctttctttcttttcttcttcttctttttttttttttttttcaaatttgatacacagaacagctcttttcccctctttttccccatccatgtttcttaagtcgcttgtgaacattttaaggagactgaattcttggttatcaaatctgcagtgtattcctgaatagaataatggtatgaacaggaccagagcagctggtttaagtgcattgatgagcaccgtttgacagatagagacatttagtatgaggayggaatgttccagaaaccatccagaatgggttcctgaagttgtggcgtgtggcttcccaggaaggattacagactcagtgcaatggatggatttgttatgctaatgcttcaaaatggttggagctgattaaatgaatttcagaggcttcaccagcaaccagtgagcctaatgccactttcctcctttcttggtctcagcctttgagaactttccacaggcaattcctatgggaaacgtcgtgtgagtcctctcatacctggcatttggtcttcttttctctttgaactactaccagtaagg

SEQ ID NO: 67343 - DNA, 601 bp, Human
gtgtattcctgaatagaataatggtatgaacaggaccagagcagctggtttaagtgcattgatgagcaccgtttgacagatagagacatttagtatgaggatggaatgttccagaaaccatccagaatgggttcctgaagttgtggcgtgtggcttcccaggaaggattacagactcagtgcaatggatggatttgttatgctaatgcttcaaaatggttggagctgattaaatgaatttcagaggcttcaccagcaaccagtgagcctaatgccactttcctcctttcttggtctcagcmtttgagaactttccacaggcaattcctatgggaaacgtcgtgtgagtcctctcatacctggcatttggtcttcttttctctttgaactactaccagtaaggtgatagttttttctctcctctctcattattcttttaaaaactttttaagcatgagggatccttgagaaaacctggctctgtcaagcatttataaggaagacttataggggacattcatttgcaagctcctctttggaagtttgaatagtgaatgtatgtgacagacaaataacaactctagccacagctaagagatcaa

SEQ ID NO: 67344 - DNA, 601 bp, Human
ggtttaagtgcattgatgagcaccgtttgacagatagagacatttagtatgaggatggaatgttccagaaaccatccagaatgggttcctgaagttgtggcgtgtggcttcccaggaaggattacagactcagtgcaatggatggatttgttatgctaatgcttcaaaatggttggagctgattaaatgaatttcagaggcttcaccagcaaccagtgagcctaatgccactttcctcctttcttggtctcagcctttgagaactttccacaggcaattcctatgggaaacgtcgtgtgastcctctcatacctggcatttggtcttcttttctctttgaactactaccagtaaggtgatagttttttctctcctctctcattattcttttaaaaactttttaagcatgagggatccttgagaaaacctggctctgtcaagcatttataaggaagacttataggggacattcatttgcaagctcctctttggaagtttgaatagtgaatgtatgtgacagacaaataacaactctagccacagctaagagatcaaaatgctttatgtggtgctgacattcaccaagtcgagatgggaggag

SEQ ID NO: 67345 - DNA, 601 bp, Human
ttttctgttttttttctaataaaagtaaagaaggaaaaagagggattaaaagtctcaaggcatgggctgattggtgagcaaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgttttkagttctatagaattcataagctacagggaggtagaacacaggacacattcggatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagat

SEQ ID NO: 67346 - DNA, 601 bp, Human
aaagtctcaaggcatgggctgattggtgagcaaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgtttttagttctatagaattcataagctacagggaggtagaacacaggacacaytcggatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagatgaccgaagggaagactcatagattcttttccccctggcattgccagga

SEQ ID NO: 67347 - DNA, 601 bp, Human
gtctcaaggcatgggctgattggtgagcaaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgtttttagttctatagaattcataagctacagggaggtagaacacaggacacattcrgatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagatgaccgaagggaagactcatagattcttttccccctggcattgccaggattt

SEQ ID NO: 67348 - DNA, 601 bp, Human
aaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgtttttagttctatagaattcataagctacagggaggtagaacacaggacacattcggatttctttttctttctttctttcttttttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagatgaccgaagggaagactcatagattcttttccccctggcattgccaggattttcatacatctcaccactagtgagaggct

SEQ ID NO: 67349 - DNA, 601 bp, Human
cttttctttcttaatcatctgtctttggtggtttgatgtttttagttctatagaattcataagctacagggaggtagaacacaggacacattcggatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgygtatttaaccctgaaaaaactaatgcaagaaataggagagatgaccgaagggaagactcatagattcttttccccctggcattgccaggattttcatacatctcaccactagtgagaggctgagctgcttgctttaatatactgtacctcctgctagtgacccaaacagtgtggctttgagagaccctaagttcccataaagtttgtagtactggaagcatcttcctttgcttttatttagattgctgtcaatagactgcaaaagattacatgctgtaccttgtcatctggagctctgac

SEQ ID NO: 67350 - DNA, 601 bp, Human
tctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagatgaccgaagggaagactcatagattcttttccccctggcattgccaggattttcatacatctyaccactagtgagaggctgagctgcttgctttaatatactgtacctcctgctagtgacccaaacagtgtggctttgagagaccctaagttcccataaagtttgtagtactggaagcatcttcctttgcttttatttagattgctgtcaatagactgcaaaagattacatgctgtaccttgtcatctggagctctgactttaccagttggcattatatgcttgtactctgtacattcagaattgctgggctaggaaacccaggtgcctgagtgatattaatctgctatatctgagtagctct

SEQ ID NO: 67351 - DNA, 601 bp, Human
ttagaacacagaaaagaaagaatttttttaaaaaggtcatatatactctgttatttacatcccacagaagcatatctgtgaaacaatttagcaactttgaaagaaaaagggtcactcaggttaattcaaaattgtcactgggttctccatatctggcagcttcgggtgttggcttcaactttttgcttgataaaatattgatataaaactgtaccagaatcccaggccgggtgcggtggctcactcctgtaatcccagcactttgggaggccaaggcgggtagatcatgaggtcaggagakagagaccatcctggctaacacaggtgaaaccccgtctctactaaaaatacaaaaaattagctggggcggtggcgggcgcctgtagtcccagctacttgggaggctgaggcaggagaatggtgtgaacccaggaggcggagcttgcagtgagccgagatcgcgccactgcactccagcctgggcgacagagcgagactccgtctcagaaacaaaagaaaacataacaaaacaaaaaacaaaaaacaaaactgtaccaggatccctatagttcttgttctgtgttcttataaccataccaga

SEQ ID NO: 67352 - DNA, 601 bp, Human
tagaacacagaaaagaaagaatttttttaaaaaggtcatatatactctgttatttacatcccacagaagcatatctgtgaaacaatttagcaactttgaaagaaaaagggtcactcaggttaattcaaaattgtcactgggttctccatatctggcagcttcgggtgttggcttcaactttttgcttgataaaatattgatataaaactgtaccagaatcccaggccgggtgcggtggctcactcctgtaatcccagcactttgggaggccaaggcgggtagatcatgaggtcaggagatmgagaccatcctggctaacacaggtgaaaccccgtctctactaaaaatacaaaaaattagctggggcggtggcgggcgcctgtagtcccagctacttgggaggctgaggcaggagaatggtgtgaacccaggaggcggagcttgcagtgagccgagatcgcgccactgcactccagcctgggcgacagagcgagactccgtctcagaaacaaaagaaaacataacaaaacaaaaaacaaaaaacaaaactgtaccaggatccctatagttcttgttctgtgttcttataaccataccagaa

SEQ ID NO: 67353 - DNA, 601 bp, Human
aagcatatctgtgaaacaatttagcaactttgaaagaaaaagggtcactcaggttaattcaaaattgtcactgggttctccatatctggcagcttcgggtgttggcttcaactttttgcttgataaaatattgatataaaactgtaccagaatcccaggccgggtgcggtggctcactcctgtaatcccagcactttgggaggccaaggcgggtagatcatgaggtcaggagatagagaccatcctggctaacacaggtgaaaccccgtctctactaaaaatacaaaaaattagctggggyggtggcgggcgcctgtagtcccagctacttgggaggctgaggcaggagaatggtgtgaacccaggaggcggagcttgcagtgagccgagatcgcgccactgcactccagcctgggcgacagagcgagactccgtctcagaaacaaaagaaaacataacaaaacaaaaaacaaaaaacaaaactgtaccaggatccctatagttcttgttctgtgttcttataaccataccagaattttcttcatcacagacagagactaaactctttcttctcttacctttcctttgataatatttttga

SEQ ID NO: 67354 - DNA, 601 bp, Human
cttgcagtgagccgagatcgcgccactgcactccagcctgggcgacagagcgagactccgtctcagaaacaaaagaaaacataacaaaacaaaaaacaaaaaacaaaactgtaccaggatccctatagttcttgttctgtgttcttataaccataccagaattttcttcatcacagacagagactaaactctttcttctcttacctttcctttgataatatttttgatccaggaatggggataattttgcagttaaaattttctttttatgatggaaggtgaggaggagagagaggtttayattagaagtgacccaactccattttcttccaatggtttttttcagttttatttttttaaagcgtgaacagagaatagtcacctgatcaatttaaatatgtcaaaaagtgaaagaaaaatctctcttttaaaggaaatgagggcagtaacacaaccaaggaatcaaaattcaggttgaggctgacctttgacctgcaactatgctactccatgaacagcaagtaggaaatggctgatttcatgaaggtggactggcatcagaggaggcgagggatccagggttcctgatgagtggcaacat

SEQ ID NO: 67355 - DNA, 601 bp, Human
gccgtgaggtggaggttgcagtgagctgagatcgcaccactgcactccagcctgggtgacagagcgagactccatctcaaaacgagaaaaaaagaaagtgcaggctgtataaatttaggaggtcttgttgacctaggatgtcctacttggcgcttcctcaggtgtgtcacccatgtgtatgtgccacacacttgcacagacattctttgcagaatttgctgttgtgttggcacactgttctctttataactcagcatttctttatttgcgatccagagtgtttttggtgcttggctttgcrcctcctttgctgtgaatgcatcctgatggctggagcctgtttgaggatggatattcttgggagttgtgtttgaaaacaacctcttgtggccctggacttggtgaaaaaggcaactgaaagcccagttccaaaatgaggctggctaattcaaaattgccacccataaaaattaaccctctggtgtactttgtgggttgagggtaggaggctaagactgccagggaggaggccccggcttcctgctcctaccggggagcagcaggtgaaactctgaccacgttactgcaatcctgacatgct

SEQ ID NO: 67356 - DNA, 601 bp, Human
taaccctctggtgtactttgtgggttgagggtaggaggctaagactgccagggaggaggccccggcttcctgctcctaccggggagcagcaggtgaaactctgaccacgttactgcaatcctgacatgctccagtggagtggcgacatttttcttctcgaggcagcttttggggatctgtattactttcatgtggaccacttgctagttttgatttcaatgataatttcttccttcctttttttttttttcaagcctgtcttcatagtgatgacaacacatttaacatttgttttgatttyaccctctcctctctccccactctcagtctgcagccaggagagcagggacgtcctgtgcgaactgtcagaccaccacaaccacactctggaggaggaatgccaatggggaccctgtctgcaatgcctgtgggctctactacaagcttcacaatgtaagtggactgggatcagcaagaacagggctcgcttcctgatggtgaccagcaaacagcgtcaccaccaccctctccaagtgaatcgctcaccatgggggcagatgacaggttccaaataattgatgcaataggacctagcttggaa

SEQ ID NO: 67357 - DNA, 601 bp, Human
gggaggaggccccggcttcctgctcctaccggggagcagcaggtgaaactctgaccacgttactgcaatcctgacatgctccagtggagtggcgacatttttcttctcgaggcagcttttggggatctgtattactttcatgtggaccacttgctagttttgatttcaatgataatttcttccttcctttttttttttttcaagcctgtcttcatagtgatgacaacacatttaacatttgttttgattttaccctctcctctctccccactctcagtctgcagccaggagagcagggacrtcctgtgcgaactgtcagaccaccacaaccacactctggaggaggaatgccaatggggaccctgtctgcaatgcctgtgggctctactacaagcttcacaatgtaagtggactgggatcagcaagaacagggctcgcttcctgatggtgaccagcaaacagcgtcaccaccaccctctccaagtgaatcgctcaccatgggggcagatgacaggttccaaataattgatgcaataggacctagcttggaaaactactttgtctagcatagccgtgctgaggccgagggggctcacagcct

SEQ ID NO: 67358 - DNA, 601 bp, Human
atttcaatgataatttcttccttcctttttttttttttcaagcctgtcttcatagtgatgacaacacatttaacatttgttttgattttaccctctcctctctccccactctcagtctgcagccaggagagcagggacgtcctgtgcgaactgtcagaccaccacaaccacactctggaggaggaatgccaatggggaccctgtctgcaatgcctgtgggctctactacaagcttcacaatgtaagtggactgggatcagcaagaacagggctcgcttcctgatggtgaccagcaaacagygtcaccaccaccctctccaagtgaatcgctcaccatgggggcagatgacaggttccaaataattgatgcaataggacctagcttggaaaactactttgtctagcatagccgtgctgaggccgagggggctcacagcctggcagccacacaacccccttggtatgcattggacactccacataccatgcagcaatccgatgtgctgagtgggcctgtgtggtttataaggaaaaaaaaaaaatcttccttttggaaaacaaaaaaagccaccggtcctattttgttgtttccttacatttt

SEQ ID NO: 67359 - DNA, 601 bp, Human
gtaagtggactgggatcagcaagaacagggctcgcttcctgatggtgaccagcaaacagcgtcaccaccaccctctccaagtgaatcgctcaccatgggggcagatgacaggttccaaataattgatgcaataggacctagcttggaaaactactttgtctagcatagccgtgctgaggccgagggggctcacagcctggcagccacacaacccccttggtatgcattggacactccacataccatgcagcaatccgatgtgctgagtgggcctgtgtggtttataaggaaaaaaaaaaaatcttccttttggaaaacaaaaaaagccaccggtcctattttgttgtttccttacattttaaactctttgcagaaagagagaatgaaagagaaaggtaaatagaattgtaatgtgtggcagggggtctggaaactaagaggacccatttggttactgagaggtaaaaagtcttggctaaatctgtgctacaaatttgaaatggatcctctgtataaaagacatggaaaaaaatgtctgacagatttcgtctgatgtctttgtccgaaccaactttcacgtgcagagagctagctcctgagg

SEQ ID NO: 67360 - DNA, 601 bp, Human
cagcaatccgatgtgctgagtgggcctgtgtggtttataaggaaaaaaaaaaaatcttccttttggaaaacaaaaaaagccaccggtcctattttgttgtttccttacattttaaactctttgcagaaagagagaatgaaagagaaaggtaaatagaattgtaatgtgtggcagggggtctggaaactaagaggacccatttggttactgagaggtaaaaagtcttggctaaatctgtgctacaaatttgaaatggatcctctgtataaaagacatggaaaaaaatgtctgacagatttcrtctgatgtctttgtccgaaccaactttcacgtgcagagagctagctcctgaggaaggtggctggcctgggggatgttaccataccagggaaaataaactgtcattttctccttttatatcatgttagcagagcggtaattgccagtcacctgaatttagttgtgtcatttctgatctttccatttggggtcctctcattttgtaatatatcttaatcttaaaaaatttttttttcagttttttttttttcctgaaatcattctggctcagaggccatgattctagtgaggcttcaagttt

SEQ ID NO: 67361 - DNA, 601 bp, Human
ctgtgctacaaatttgaaatggatcctctgtataaaagacatggaaaaaaatgtctgacagatttcgtctgatgtctttgtccgaaccaactttcacgtgcagagagctagctcctgaggaaggtggctggcctgggggatgttaccataccagggaaaataaactgtcattttctccttttatatcatgttagcagagcggtaattgccagtcacctgaatttagttgtgtcatttctgatctttccatttggggtcctctcattttgtaatatatcttaatcttaaaaaatttttttttcagttttttttttttcctgaaatcattctggctcagaggccatgattctagtgaggcttcaagtttacattaactctaaagacaaaaatggttattttggtctttctctgtgttgctctctctctccttcctttttagctctttctgattctcctaaattctcttggccaacctgactttggcaaagtccggggctgaacagggaggagacagggacttttgcttgcggcggttctggcaatgaactcatcttactcaggaatacctgggaattggggaggaagcttttctggttggatt

SEQ ID NO: 67362 - DNA, 601 bp, Human
gcttttctggttggattttttgagtcataaagaacttctcagggtgaccccagcaccctgcttctttttcacttcttgggagcaagttgctgtgattccgaggagccctgtacgctcattccctgcctgtgccaactctctcgctgtggccctggtgcagtgaatgaaactagagtcttactacgatcccttattctcccttaggtcctgggactgtggtctatatacatttatcagcaattcaatccaagttctattttcactttggggaatttgcttgctgactacagtagagatagakattcgtgattaaaatctggaaggcttgggcttataagctattaggttattagcattagggtttattagctatccagtcatcagcactgcctatgaaattatttttgggctgtaatttatggatttcaaagaactttcatgttacttgattacatttgagcctgagatagtcccatgatgtagacagggcagaaattatttttatttcagttttacttgagggagttatgactcagaaaagcaagtcgcttgcacaaggtaacgtggctgagaaagtataagagtcagggcccatttcaga

SEQ ID NO: 67363 - DNA, 601 bp, Human
aggcttgggcttataagctattaggttattagcattagggtttattagctatccagtcatcagcactgcctatgaaattatttttgggctgtaatttatggatttcaaagaactttcatgttacttgattacatttgagcctgagatagtcccatgatgtagacagggcagaaattatttttatttcagttttacttgagggagttatgactcagaaaagcaagtcgcttgcacaaggtaacgtggctgagaaagtataagagtcagggcccatttcagagtcaggaggctttcctgggaagttggcagtgtcagaactaagaggagaaccaggggaaagggaatgctctctttttttagagtataacaaaattgtaacaaattgtgtgtgtgtatatttcatccctatattcgtggaagtataggaattataggagattaactagctatatgtttttttgaatagttagctgggatgagatatgatctcacttgtgtctgatcacatatatatatatttctgaagaacatgaatttctcaaatcaaagtaaagctgaggaatcctctccatggctcacttctacctcctcaatcttaatg

SEQ ID NO: 67364 - DNA, 601 bp, Human
gagtataacaaaattgtaacaaattgtgtgtgtgtatatttcatccctatattcgtggaagtataggaattataggagattaactagctatatgtttttttgaatagttagctgggatgagatatgatctcacttgtgtctgatcacatatatatatatttctgaagaacatgaatttctcaaatcaaagtaaagctgaggaatcctctccatggctcacttctacctcctcaatcttaatgagcttggtcttcatggctgggctccagtgaatgggagacagaaacttcctcatcctcargagtggtttttctgtcttctctggtttaccaggaatttgtaaaaggaggcgattgatgtgtattgaacaataagagataataatctattaacattgtcatcacgttgcgttttgctctgcccttccagacatctctacatggatgccataagctctttcttcttatctaggtgttgagataactgcctacctcggtatcagcatctctcagtggtgttgtgactggttatctggggttgtgtggctactggtgtaactagatattatatttagatacctggctatgtatagctagatatc

SEQ ID NO: 67365 - DNA, 601 bp, Human
gcttggggaaaataaggtctcagctccagtgtggggctttgtttccttctccaggtgacctctcccagctcagcttcgggaagctgggtgttggctgctctcagcaggttggccatttgaattcttcctttcttagctgtgattttctggctttgggaacagacaggtaaaacccagagccaagggttctccacccttgagaactgtggcggaaggcgatgctttcagcccgggaagtcaggaatggccaggacactgacattcactccttgagtctgtttgccaccctcccctgggaacrtggccagatgtggagtttgctcttccgggcagatgtctgctgttggggttaatctgcttctgcctccctgtggggagtaacttctgtttactttgtaaagtttcctttcttgattctgggcccccaaagcaaatgtatttttaaaggcaaatgaggtttattaagaagagagaaatggtagatgtctccgagactgaagtctcttgatcttgagagtagggtctggtctctgtctctttactctagcacattcttggtctttccttttcaagatgagtgcccttttgtgctttgcacccc

SEQ ID NO: 67366 - DNA, 601 bp, Human
ccaagggttctccacccttgagaactgtggcggaaggcgatgctttcagcccgggaagtcaggaatggccaggacactgacattcactccttgagtctgtttgccaccctcccctgggaacatggccagatgtggagtttgctcttccgggcagatgtctgctgttggggttaatctgcttctgcctccctgtggggagtaacttctgtttactttgtaaagtttcctttcttgattctgggcccccaaagcaaatgtatttttaaaggcaaatgaggtttattaagaagagagaaatggyagatgtctccgagactgaagtctcttgatcttgagagtagggtctggtctctgtctctttactctagcacattcttggtctttccttttcaagatgagtgcccttttgtgctttgcaccccataggtggttattaaatacatgttgattggttggttggctgtttgtctggttagaagtagagagtcagagctaggtggaaatagcacttgcaaccattgcagctgctgttggaatgacacaggcaagagatcacttttgggccaggcgcggtggctcatgcctgcaattccagcacttt

SEQ ID NO: 67367 - DNA, 601 bp, Human
tcgcgccactgcactccagcctgggcgacagcgggagacttcgtctcaaaaaaaaaaaaaaaaaaaaaaaaagatcacctttaagaaaggcatggtttcataaaatacaacccggctacatataaattctagcggaagattttatggcacctcttaaaggccaggtagaagagaggcaaccgaaagttactcagtagaacagtacagtcctcatttcttcaaggcagacagccttaaccacctagaggctgatggcctggggagtacttttcaagttctgaagcagatttgtcaaagtagmcaaaatggcatttccctcctgaagattcttcactacctcgattcttatgaaatagtctaaggaagttctaaagaaataagacaagtgaattctattttcgttaccagagaaatacaatcgtactagacggggctgtaatctggtaactgtatgtattttagttcttcagtccctgggaaggagacaggagaaggtgggagggaggaaggggccagctgaaatggaaacagatccctgatccggggcggtcagtggaacccttcttggtgtgcgagagcctgtgcatttcagaggcagcaa

SEQ ID NO: 67368 - DNA, 601 bp, Human
atgatacctgttacttatttacaaccaaccatcatgtcatccttacagccacctcacaatgaagctacctgtattacacgtgttttacttaaccccattttaggcagtcagcggatggcctgccctagaaccacaggcatcacaagctcaatttaatgtgaagctgcagaattaagagacattggggcctatatgactcccttcaccctttaattgttccatgtcatgatagtttcacaatcacaggaaacaaagatcatggatcttgggctcttgacctgaccagtggatattcagggayagctgcccaactcactgatttgctttacttgcagcatctcatttaattctcaccttaccctaagaggtggacatttctccacttcagactcggaacgccactgccagtaagtggcagagcagggactggatgagggaagatcagtccccactgcctcttctcctgccatggtgttcaacctctctcatcctgtacccactgccagcgaggacacctctgggaaagagtggggtagaagtgacagcccacatctcctctggtggcaaacttcaaccccccaacctacacagagccacatct

SEQ ID NO: 67369 - DNA, 601 bp, Human
acttaagtctgaagcaaaaggagctgtttcgtagaggaggaatgtgaatgctattaaaaatggcacttatactagaaataggtgaggcagtaagaacattctaaaatgagtgagttacagagctggccatgaggggaggagaaacagagtggttatatcttcagaatacattgattggtagcatacagaatagtaacacaggaaagtaggaatatcccagattgaagccatttgaagatatgcttcttccaataatgaccgtacaagtagagctgctttgtccttccccttaagaaacttyaacagcttgattcagctggaacattgaaaatgccaggaagttacttgaaaggagattcatgatgcaactatgtaaacaaataatgcatctggcccaggtcctttttgatttttcccctgaacaatgactaaataccaattatcctgtgtctatgagatttaaggggcattctggcagtctccataaaaagttaatactaataaccacagtctataaacaatctattgtattctatttttgaagatatctaaaagatacttttagtattttaagattaatttttaatggtttaagatattt

SEQ ID NO: 67370 - DNA, 601 bp, Human
agccactggttatttcaacagaatgagctaacggttcttaaatggcaccatgaactaaaagtatagtttacaatggaaatttcaaccgcaactattattgccactagcaagagaaacttaagtctgaagcaaaaggagctgtttcgtagaggaggaatgtgaatgctattaaaaatggcacttatactagaaataggtgaggcagtaagaacattctaaaatgagtgagttacagagctggccatgaggggaggagaaacagagtggttatatcttcagaatacattgattggtagcatayagaatagtaacacaggaaagtaggaatatcccagattgaagccatttgaagatatgcttcttccaataatgaccgtacaagtagagctgctttgtccttccccttaagaaacttcaacagcttgattcagctggaacattgaaaatgccaggaagttacttgaaaggagattcatgatgcaactatgtaaacaaataatgcatctggcccaggtcctttttgatttttcccctgaacaatgactaaataccaattatcctgtgtctatgagatttaaggggcattctggcagtctccata

SEQ ID NO: 67371 - DNA, 601 bp, Human
ctctgggctgagcagatagtctttttataaaacttttccccccagctcagccactggttatttcaacagaatgagctaacggttcttaaatggcaccatgaactaaaagtatagtttacaatggaaatttcaaccgcaactattattgccactagcaagagaaacttaagtctgaagcaaaaggagctgtttcgtagaggaggaatgtgaatgctattaaaaatggcacttatactagaaataggtgaggcagtaagaacattctaaaatgagtgagttacagagctggccatgaggggargagaaacagagtggttatatcttcagaatacattgattggtagcatacagaatagtaacacaggaaagtaggaatatcccagattgaagccatttgaagatatgcttcttccaataatgaccgtacaagtagagctgctttgtccttccccttaagaaacttcaacagcttgattcagctggaacattgaaaatgccaggaagttacttgaaaggagattcatgatgcaactatgtaaacaaataatgcatctggcccaggtcctttttgatttttcccctgaacaatgactaaatacca

SEQ ID NO: 67372 - DNA, 601 bp, Human
ttgaatattgacagcaaccttatggggaagctgtgattatagagtcaggtccaaaagtttaaaaaattgaaatatctggatcccttcatggacccgctgaattgggatttctagagatgagaccctgataatactgagcttctcagcttattctgaggatttccctcccctccctctgatccccagttaagaatctccgttccaggcaatagggaactacagcaagttccagaaggctagcgggaaataatataaagagtagatcagaaagagaggggagtcaggaaactggctagaattrggtctaggagatgggagctacttctgggtagggaccttctaggtgggaaagactctaagtaagtctagaaggatcaagccactgagagatggccactggatgagtcaagtcattgcctgcagcatcctcggagaggaacacagtggaaagtaccaggattctggagtcagacaaggtgggttcaagtcctggctctgccacaaagtagctgtatgactttaggcaagataccaaatcccactaaacctcagcttgctcatttgtaaaatagggatgtcctactttgttgagtagatataa

SEQ ID NO: 67373 - DNA, 601 bp, Human
tccaggctcatgatcctccataacatctataccagatatgtcagtgacctcatatctgcacccaacttccccttccagatttatcaccctgtcctggccctgatgagtgggcagttgacaatgtgacctgttcacagctgatgggacccaaagggaggccacatcatagactaattgagccaatcagatactctctctaggaatttcaaatgagagacataaagagaagttctacctgatagttggcaattttccaacactgctatttttgactatgggctatttttatttttttttttaaaaaaagaatgctcaaaaagtattttcctatttaaaaaaatcactgtcctctatccccttaagtactagatgagcccctgctttaaccaccaggtttgctgagctgaggaggataagaggaaagaatcctcatgtctcaatgcaacacaaaaacactaaactcaaagtgtgaataaaacctggtaggcagaaaggctcaacaaggacttagtcagtggccggattctgtgctggattctgagatggctgctgagatgtttgaaacttgatcactggcttcataacaataataattctaaga

SEQ ID NO: 67374 - DNA, 601 bp, Human
ctccaggctcatgatcctccataacatctataccagatatgtcagtgacctcatatctgcacccaacttccccttccagatttatcaccctgtcctggccctgatgagtgggcagttgacaatgtgacctgttcacagctgatgggacccaaagggaggccacatcatagactaattgagccaatcagatactctctctaggaatttcaaatgagagacataaagagaagttctacctgatagttggcaattttccaacactgctatttttgactatgggctatttttatttttttttttwaaaaaagaatgctcaaaaagtattttcctatttaaaaaaatcactgtcctctatccccttaagtactagatgagcccctgctttaaccaccaggtttgctgagctgaggaggataagaggaaagaatcctcatgtctcaatgcaacacaaaaacactaaactcaaagtgtgaataaaacctggtaggcagaaaggctcaacaaggacttagtcagtggccggattctgtgctggattctgagatggctgctgagatgtttgaaacttgatcactggcttcataacaataataattctaag

SEQ ID NO: 67375 - DNA, 601 bp, Human
gtagaatctacgtagtctccctctaaggcctccagtgggatggagccctagatgcccgcagcagtaacctgcttgcaggcataccgttgattgtctttcttttctttcatcacactttcccacttcctgctagtgttttctgggagcacatcccaaatgcactatttgctcttaagtccttgtggcaggacctgttgttggtggtggtaggggcaggggatggagggaacctaaacttactccctgtaggtagggccacagctgtgtctccttccccaccctgcctcttgggtacccttgyaggaaatccttgcagagggacccttgtagagggtcagttaaccagttcccggggtccacaccccttctggttttcttagacatatgttcttctctggtgtcaggtttctgtggccgctgtcctcaaatcctccaggctcatgatcctccataacatctataccagatatgtcagtgacctcatatctgcacccaacttccccttccagatttatcaccctgtcctggccctgatgagtgggcagttgacaatgtgacctgttcacagctgatgggacccaaagggaggccacatcataga

SEQ ID NO: 67376 - DNA, 601 bp, Human
ctctaagggcattctctggtcaccaaagtatgctcagtctgcagaggccccaagtgctagggagttaacatcctagcaatgaaagtcaggctatggaggtaaacagtctagcttctcccttcgctagacaattctaaagcatgtagaatctacgtagtctccctctaaggcctccagtgggatggagccctagatgcccgcagcagtaacctgcttgcaggcataccgttgattgtctttcttttctttcatcacactttcccacttcctgctagtgttttctgggagcacatcccaaatrcactatttgctcttaagtccttgtggcaggacctgttgttggtggtggtaggggcaggggatggagggaacctaaacttactccctgtaggtagggccacagctgtgtctccttccccaccctgcctcttgggtacccttgtaggaaatccttgcagagggacccttgtagagggtcagttaaccagttcccggggtccacaccccttctggttttcttagacatatgttcttctctggtgtcaggtttctgtggccgctgtcctcaaatcctccaggctcatgatcctccataacatct

SEQ ID NO: 67377 - DNA, 601 bp, Human
gggtggagctgggatttgaacatgtttccactagatagtcttgctccctgtgtaaacgctgttgatgccctgcccatctcctggtggcctaatctggaggtcacctgtatccagttcccatacatgccaacaaccaactctgtctctctctaagggcattctctggtcaccaaagtatgctcagtctgcagaggccccaagtgctagggagttaacatcctagcaatgaaagtcaggctatggaggtaaacagtctagcttctcccttcgctagacaattctaaagcatgtagaatctacktagtctccctctaaggcctccagtgggatggagccctagatgcccgcagcagtaacctgcttgcaggcataccgttgattgtctttcttttctttcatcacactttcccacttcctgctagtgttttctgggagcacatcccaaatgcactatttgctcttaagtccttgtggcaggacctgttgttggtggtggtaggggcaggggatggagggaacctaaacttactccctgtaggtagggccacagctgtgtctccttccccaccctgcctcttgggtacccttgtaggaaatcctt

SEQ ID NO: 67378 - DNA, 601 bp, Human
cctactgagacatacataaaaacctatgagatagatcaattccacaaattcaatgctaggaaagggtctttttagacatccatttgctttctttttttcaaatgataatccctggacattcctttgcaactggactggcaggaagcctagggttaaatatattgcttaaatgcaaaagcagtttaggatcctgatacattgtctctccactttcaacagtaacattactccttctggttttcaatccgtattttatgattctcaattgtagtttgggcttgtatatcacatatgaaaaaamaaaaacaaaaaaaccttagttctctgatgggactggacgctatagaaaggaggaagtgctggccatgacttaccttgtgaatttctcggtgcacatggatggtattatttccaaccttcgtgtctgtgttggtctcattgtgatagctgggaggtaagtttgccaggttcacttctgatgatgctttagcagcagcttcttctgcctccatctattaaatcgatgaatttaatgagcaaaattattttctcttgttacaaatgggagtctattagaaaaaaaaaatctcttttcctcttc

SEQ ID NO: 67379 - DNA, 601 bp, Human
gccaaatcatgtcagagacattgcacaccaggggcaagctagtgctatgttccttgagattcgcagagctttcttcatcaggtcagaatgggaatgaacctggttgttcttcatgcatgatgttagaccaagaggcactcagacaggtggtagtttggggaaaaatctgccagagaattttgaacgcacaaccagcaaatgaatgtttaattttgtagcaatagagggtttctcttttggaaatggggtatatcatatttacattcctcctaaaaaaaagtgagggtcaattcaccataaygtggtctctagttcaatccctactgagacatacataaaaacctatgagatagatcaattccacaaattcaatgctaggaaagggtctttttagacatccatttgctttctttttttcaaatgataatccctggacattcctttgcaactggactggcaggaagcctagggttaaatatattgcttaaatgcaaaagcagtttaggatcctgatacattgtctctccactttcaacagtaacattactccttctggttttcaatccgtattttatgattctcaattgtagtttgggcttgt

SEQ ID NO: 67380 - DNA, 601 bp, Human
agcatccagtataggagtcgaaatgcccaccccgctttctttctgagttcccccagcagctgtgagatggacggcttcccctgggcacagtgataagaaatgttaacagagtcagcctcatagggttgctatgaggaggaaatgaggggatccggagaaatcactccgcacagtgcccgacacccagcaaaacgctcaaagatgtcagctgtttctatctttcttggggctcatcacttgaaactcaatgtcaactttattcttgacaaattacaagtccgggtgtctagttgaacatctytcatgaaaagcaagcaggttttagctctagcagccctacctgattctagtgaatggcttcatttcatcaagaaagtgcttaagtataatgagagacttgttccaatattcctgtatctgttgtctgcctctgattctgtaaccaggtgcaggcatctcaaagctaagtctaacatagaacccaggctcttcctgccccatgaaaggtcacgtctaatgtctgatttggtgatgaaggacagaaaagatgtttggtcacctggccaagatgatgaaaccccatctctactaaaaatacaaa

SEQ ID NO: 67381 - DNA, 601 bp, Human
ttgttggttatctacagtaaaacaggtacaatgaaagtaaaatagaaggaattctggacaaattccacaagttgtttttgtgttttgttttccattttctgaagcaggagcatccagtataggagtcgaaatgcccaccccgctttctttctgagttcccccagcagctgtgagatggacggcttcccctgggcacagtgataagaaatgttaacagagtcagcctcatagggttgctatgaggaggaaatgaggggatccggagaaatcactccgcacagtgcccgacacccagcaaaaygctcaaagatgtcagctgtttctatctttcttggggctcatcacttgaaactcaatgtcaactttattcttgacaaattacaagtccgggtgtctagttgaacatctttcatgaaaagcaagcaggttttagctctagcagccctacctgattctagtgaatggcttcatttcatcaagaaagtgcttaagtataatgagagacttgttccaatattcctgtatctgttgtctgcctctgattctgtaaccaggtgcaggcatctcaaagctaagtctaacatagaacccaggctcttcc

SEQ ID NO: 67382 - DNA, 601 bp, Human
tttgtccagtctggttgttggttatctacagtaaaacaggtacaatgaaagtaaaatagaaggaattctggacaaattccacaagttgtttttgtgttttgttttccattttctgaagcaggagcatccagtataggagtcgaaatgcccaccccgctttctttctgagttcccccagcagctgtgagatggacggcttcccctgggcacagtgataagaaatgttaacagagtcagcctcatagggttgctatgaggaggaaatgaggggatccggagaaatcactccgcacagtgcccracacccagcaaaacgctcaaagatgtcagctgtttctatctttcttggggctcatcacttgaaactcaatgtcaactttattcttgacaaattacaagtccgggtgtctagttgaacatctttcatgaaaagcaagcaggttttagctctagcagccctacctgattctagtgaatggcttcatttcatcaagaaagtgcttaagtataatgagagacttgttccaatattcctgtatctgttgtctgcctctgattctgtaaccaggtgcaggcatctcaaagctaagtctaacataga

SEQ ID NO: 67383 - DNA, 601 bp, Human
cctctggactaagcaacaggcaactaacagaagcaatcacaggggaccagagcctagccctgaaatggacggacagcctttttccctttaggccattgggctccacataaggtgttcttgttctcaaactgcctgaccagaggtgggattacaaaaggggtagccatcccagaggctctggggatttcaccacctgatataccaggtctgtcaccaaagtcccagtcaacatgtctggtacttgcttgtacccctttcaaagctgagatgggccatgcaaatgaccactcaatttaatttmtctgttgtttctgatgccaagtgcatggaggcgtaacctattactggactacatctgtctggtcagaaatgtaggaattgaggaatctcggtagaaatgagtcaggagactccactccctcctgcccatggtctgcatctgagtcaccgttggcaaactgaatgaaaatgaaagtgagtgtgtcggggtgcaagtacaggggaaatgacaacttacgtggctccttctgccttcttcgtctcccacagatgtgataactgtctctgaaaagaccatttgtccagtctggttgttggttat

SEQ ID NO: 67384 - DNA, 601 bp, Human
aggaataggaaggtggttgaatgaaagaattctgtggacatgggaaactagatctcacttccctgactctgggcaagccactgcgacaatgagtgcagctctgtagtgaggcacacatgccacattctctgccatatgacatccctctcacaggtggcttgaaaagtctccaatctgttctccaaagccctgtgggatcgtccagacactggccagtcaagcatcagatgcccccggtctcccttctagttaatcaaacgggaatttagtctaatatagaaacccaatatgctcatatccygagggtctgagcaggcatcaagacaaccttggcaagcctccagcacgtggggtacttagatctaccgctcccctcaaccacctgcattctcaggactgtcatatatgggggttcggattctgccctgcacaagggggccaaggtgtgtcctccatcacacaatggccacaggagactgcatgggcaggtgtggagattctgggcctcccagatgagatctgaagaagagtacacaggggcacacaaggccatgcatgcttgggaaaagtgacgcacagcacaaaagtgcaggcaaccagt

SEQ ID NO: 67385 - DNA, 601 bp, Human
tgctaagccttgtagctgcgagttggattttaaagaggatgtgtgccatcaaaagggtgccttggctaattgggccagacttttcctatgtggggacacagttccataaataaaagtgtcctattaatgcacaatggcttgcccatgctctagcttctacatgctgctttcctcctcacccccagcacaaaagcagcacagcatcagtgcgtctgccactgacctgtgaagtggggcaggcggcaagtgcagcacaaaagcctcacaacaaagacgtcagaccacatccccatcagccgaygtgctcaggtgcaataacaagctgcggtgtccttttcccctttcacatttgagtgtaaaaacagaccagggccttgcacatactgcgtgcaatttctagacaggcatatagtgttactctctgtaactttctgtgagcctccttgggttaccatacatattaatacacattccagcatttgaagaaaggaaagtatagggtgtgtggtgattacttttaattgaattcatctggaaattttaaagcctgaaaatttagctcctgtgtatagtattttaaggtttacacagcatatgattt

SEQ ID NO: 67386 - DNA, 601 bp, Human
tcttcaagtgatcctcccacctcagccctccaaagtgctgggactacaggtgtgggccactgtacccagccttccagaagtcttggccagtatcttggagttgcttgtacatgattgaacttacagcttcaaactaggtgtgttcacctagatacaaaccagctcactttttaacatcaaattctaatgtgaaaccggaaagacaacacatgcaggacatgctaagccttgtagctgcgagttggattttaaagaggatgtgtgccatcaaaagggtgccttggctaattgggccagactyttcctatgtggggacacagttccataaataaaagtgtcctattaatgcacaatggcttgcccatgctctagcttctacatgctgctttcctcctcacccccagcacaaaagcagcacagcatcagtgcgtctgccactgacctgtgaagtggggcaggcggcaagtgcagcacaaaagcctcacaacaaagacgtcagaccacatccccatcagccgatgtgctcaggtgcaataacaagctgcggtgtccttttcccctttcacatttgagtgtaaaaacagaccagggccttgcacat

SEQ ID NO: 67387 - DNA, 601 bp, Human
ggctaattttttttattttttattttttgtagaggggtctcaatttcttaccccggttggtcttgaactcctgtcttcaagtgatcctcccacctcagccctccaaagtgctgggactacaggtgtgggccactgtacccagccttccagaagtcttggccagtatcttggagttgcttgtacatgattgaacttacagcttcaaactaggtgtgttcacctagatacaaaccagctcactttttaacatcaaattctaatgtgaaaccggaaagacaacacatgcaggacatgctaagcmttgtagctgcgagttggattttaaagaggatgtgtgccatcaaaagggtgccttggctaattgggccagacttttcctatgtggggacacagttccataaataaaagtgtcctattaatgcacaatggcttgcccatgctctagcttctacatgctgctttcctcctcacccccagcacaaaagcagcacagcatcagtgcgtctgccactgacctgtgaagtggggcaggcggcaagtgcagcacaaaagcctcacaacaaagacgtcagaccacatccccatcagccgatgtgctcag

SEQ ID NO: 67388 - DNA, 601 bp, Human
tagagacagggtattcctgtcacccaggctggagtgcagtgatgcaatcatagctcactgcagcctcgaccgcctgggctcaagcgatcctcctgcctcagcctcctgagtggctggaaccacaggcatgtgccaccaggcccggctaattttttttattttttattttttgtagaggggtctcaatttcttaccccggttggtcttgaactcctgtcttcaagtgatcctcccacctcagccctccaaagtgctgggactacaggtgtgggccactgtacccagccttccagaagtcttrgccagtatcttggagttgcttgtacatgattgaacttacagcttcaaactaggtgtgttcacctagatacaaaccagctcactttttaacatcaaattctaatgtgaaaccggaaagacaacacatgcaggacatgctaagccttgtagctgcgagttggattttaaagaggatgtgtgccatcaaaagggtgccttggctaattgggccagacttttcctatgtggggacacagttccataaataaaagtgtcctattaatgcacaatggcttgcccatgctctagcttctacatgctg

SEQ ID NO: 67389 - DNA, 601 bp, Human
ttttggcaggaaaatccatccacctgtggcctcagaagtctgttgtttgtttgtttctagagacagggtattcctgtcacccaggctggagtgcagtgatgcaatcatagctcactgcagcctcgaccgcctgggctcaagcgatcctcctgcctcagcctcctgagtggctggaaccacaggcatgtgccaccaggcccggctaattttttttattttttattttttgtagaggggtctcaatttcttaccccggttggtcttgaactcctgtcttcaagtgatcctcccacctcagccytccaaagtgctgggactacaggtgtgggccactgtacccagccttccagaagtcttggccagtatcttggagttgcttgtacatgattgaacttacagcttcaaactaggtgtgttcacctagatacaaaccagctcactttttaacatcaaattctaatgtgaaaccggaaagacaacacatgcaggacatgctaagccttgtagctgcgagttggattttaaagaggatgtgtgccatcaaaagggtgccttggctaattgggccagacttttcctatgtggggacacagttccataa

SEQ ID NO: 67390 - DNA, 601 bp, Human
actggaacaaggaagtcactgggtcactcaaatctctacaagctgggtgcttttggcaggaaaatccatccacctgtggcctcagaagtctgttgtttgtttgtttctagagacagggtattcctgtcacccaggctggagtgcagtgatgcaatcatagctcactgcagcctcgaccgcctgggctcaagcgatcctcctgcctcagcctcctgagtggctggaaccacaggcatgtgccaccaggcccggctaattttttttattttttattttttgtagaggggtctcaatttcttaycccggttggtcttgaactcctgtcttcaagtgatcctcccacctcagccctccaaagtgctgggactacaggtgtgggccactgtacccagccttccagaagtcttggccagtatcttggagttgcttgtacatgattgaacttacagcttcaaactaggtgtgttcacctagatacaaaccagctcactttttaacatcaaattctaatgtgaaaccggaaagacaacacatgcaggacatgctaagccttgtagctgcgagttggattttaaagaggatgtgtgccatcaaaagggtg

SEQ ID NO: 67391 - DNA, 601 bp, Human
tgggcttggaggtgatgggtgctcactgctccatgggaaaagacggtcacggcttaacaccccattctccccaggctccaatacatttaacaggcaaagtatcctcacaacatgcggtctcacacttgtcgggaactccatgatcactgtcctcagtctgctgtcccagtcaaaaagccaccaccagcactggaacaaggaagtcactgggtcactcaaatctctacaagctgggtgcttttggcaggaaaatccatccacctgtggcctcagaagtctgttgtttgtttgtttctagagwcagggtattcctgtcacccaggctggagtgcagtgatgcaatcatagctcactgcagcctcgaccgcctgggctcaagcgatcctcctgcctcagcctcctgagtggctggaaccacaggcatgtgccaccaggcccggctaattttttttattttttattttttgtagaggggtctcaatttcttaccccggttggtcttgaactcctgtcttcaagtgatcctcccacctcagccctccaaagtgctgggactacaggtgtgggccactgtacccagccttccagaagtcttggccag

SEQ ID NO: 67392 - DNA, 601 bp, Human
acaaagccagcaccccactcgagagtgtatgaacaagttggggtcagggaagaacttgagacctgagggagaaagcgcttgttcgatacactttcctctcccactttctcgcttggtctctctgggcttggaggtgatgggtgctcactgctccatgggaaaagacggtcacggcttaacaccccattctccccaggctccaatacatttaacaggcaaagtatcctcacaacatgcggtctcacacttgtcgggaactccatgatcactgtcctcagtctgctgtcccagtcaaaaagcyaccaccagcactggaacaaggaagtcactgggtcactcaaatctctacaagctgggtgcttttggcaggaaaatccatccacctgtggcctcagaagtctgttgtttgtttgtttctagagacagggtattcctgtcacccaggctggagtgcagtgatgcaatcatagctcactgcagcctcgaccgcctgggctcaagcgatcctcctgcctcagcctcctgagtggctggaaccacaggcatgtgccaccaggcccggctaattttttttattttttattttttgtagaggggtctc

SEQ ID NO: 67393 - DNA, 601 bp, Human
tgtaaagttgctgggaaccagcaaattagaacccagttttaattactcttcagtaataatgaacctcacacaaagagcctttataaaccttgccacactagattctcactcagtcttgtgaaagggggattattagccccatttgatagctgaagaaaccgagtcacaaagggcagagcttgtaaaaggcaatgcagggctcgaaccgaggtctgcatctcaccttcttcaaacttcttcattctgcctcaaaatggacagaagggaagggctgcatttcctgggactcagccaccacccyagcctccctggaccttgcaggtctccccaggaggcagatcctctgggaactgattgagtccctctagaggtgccgcaccctcccctggtgcacttctgttaaaatcataagcccccagcgattcctcatcatgttaccttctgacactccattaaatggattgagtccagcatcaaaaaccagggcgcagggagaaaacaaagccagcaccccactcgagagtgtatgaacaagttggggtcagggaagaacttgagacctgagggagaaagcgcttgttcgatacactttcctctccca

SEQ ID NO: 67394 - DNA, 601 bp, Human
aacttatcagtacccaaccatcgcctagtcccctggtcgttcattttgacctatccttccctttgtctgtatccccaatcctcaacctagacatataggacaggcacggttaggaacaacagcgggatgagtcagccttgtggccaggaacacagagctcctggcagagcacatcactcagagagcgaggcaggctgctgcagaatgaaagcagcccgaggctacaaatgtcagaggaaagacgcctgtgcctgtggagacctttcgcatctccccccagtctcatgccattcttttttcygtaaagttgctgggaaccagcaaattagaacccagttttaattactcttcagtaataatgaacctcacacaaagagcctttataaaccttgccacactagattctcactcagtcttgtgaaagggggattattagccccatttgatagctgaagaaaccgagtcacaaagggcagagcttgtaaaaggcaatgcagggctcgaaccgaggtctgcatctcaccttcttcaaacttcttcattctgcctcaaaatggacagaagggaagggctgcatttcctgggactcagccaccaccct

SEQ ID NO: 67395 - DNA, 601 bp, Human
tgtggttgtcagactatggaactgaacattcacacaagcctttgctatcaaccttaggacaataagtctgtttctttctgcagaaaccagtatcaccccttgccaacttggggccccaacttggaacttatcagtacccaaccatcgcctagtcccctggtcgttcattttgacctatccttccctttgtctgtatccccaatcctcaacctagacatataggacaggcacggttaggaacaacagcgggatgagtcagccttgtggccaggaacacagagctcctggcagagcacatcastcagagagcgaggcaggctgctgcagaatgaaagcagcccgaggctacaaatgtcagaggaaagacgcctgtgcctgtggagacctttcgcatctccccccagtctcatgccattcttttttctgtaaagttgctgggaaccagcaaattagaacccagttttaattactcttcagtaataatgaacctcacacaaagagcctttataaaccttgccacactagattctcactcagtcttgtgaaagggggattattagccccatttgatagctgaagaaaccgagtcacaaagggcaga

SEQ ID NO: 67396 - DNA, 601 bp, Human
accttttataccatctccacagtattaactccaaagtattttgattttagatgtggaatcgcttctatttaatgaattctttcttggaagatattgaggttgaggagagtacaacttaatataccaggtagcagcacaaaaagaaatgcctaccccgtaaaaattgctcacccacatcaactttatttatttgggaattatttacccatttctcagaatgatacagagctcttcaatttttcttatatatcttttcctactgaataatgcaagtgggccttatatttagacataaatcackaagtcaacgcaaaatataaatctcgaaacacaaatgtacccaaactctgtgtggttgtcagactatggaactgaacattcacacaagcctttgctatcaaccttaggacaataagtctgtttctttctgcagaaaccagtatcaccccttgccaacttggggccccaacttggaacttatcagtacccaaccatcgcctagtcccctggtcgttcattttgacctatccttccctttgtctgtatccccaatcctcaacctagacatataggacaggcacggttaggaacaacagcggga

SEQ ID NO: 67397 - DNA, 601 bp, Human
aatatatgtcttaccaggattttttatgcgtacttttttctaaaactaagagatttcatataccatatatgtatattttatatactttaaatattatatatactgttctgcaattttttttcacttaatgtttgattgaagacaaccttttataccatctccacagtattaactccaaagtattttgattttagatgtggaatcgcttctatttaatgaattctttcttggaagatattgaggttgaggagagtacaacttaatataccaggtagcagcacaaaaagaaatgcctaccccrtaaaaattgctcacccacatcaactttatttatttgggaattatttacccatttctcagaatgatacagagctcttcaatttttcttatatatcttttcctactgaataatgcaagtgggccttatatttagacataaatcacgaagtcaacgcaaaatataaatctcgaaacacaaatgtacccaaactctgtgtggttgtcagactatggaactgaacattcacacaagcctttgctatcaaccttaggacaataagtctgtttctttctgcagaaaccagtatcaccccttgccaac

SEQ ID NO: 67398 - DNA, 601 bp, Human
aacacagcctcagaagttgatgctaaaaataaaatgggtgtagccttcctagaggaaaatttgtcagtatctctcaaaattttagatatgcataccctttgacttagcaatttaatttctagcatttgcactgaaagtatttgcaaaaccattcaaaaacatagagatgtttagaccaaaattgtaaattcacaaactcttttgaaaataaagaaatctataaagggtctctgcaagcttaaaatcctctggaaagatctactaatgatttaatatatgtcttaccaggattttttatgcrtacttttttctaaaactaagagatttcatataccatatatgtatattttatatactttaaatattatatatactgttctgcaattttttttcacttaatgtttgattgaagacaaccttttataccatctccacagtattaactccaaagtattttgattttagatgtggaatcgcttctatttaatgaattctttcttggaagatattgaggttgaggagagtacaacttaatataccaggtagcagcacaaaaagaaatgcctaccccgtaaaaattgctcacccacatcaactttat

SEQ ID NO: 67399 - DNA, 601 bp, Human
ctcctttatagcaatgcaaatgatctttatatttctttgatctaataatcaaagaaatataaacaaaacgaagatatcttttttctttgcctatcatatgatcacgcactgttaacacccactgtaggtgagggctggtgaaacacagcctcagaagttgatgctaaaaataaaatgggtgtagccttcctagaggaaaatttgtcagtatctctcaaaattttagatatgcataccctttgacttagcaatttaatttctagcatttgcactgaaagtatttgcaaaaccattcaaaaayatagagatgtttagaccaaaattgtaaattcacaaactcttttgaaaataaagaaatctataaagggtctctgcaagcttaaaatcctctggaaagatctactaatgatttaatatatgtcttaccaggattttttatgcgtacttttttctaaaactaagagatttcatataccatatatgtatattttatatactttaaatattatatatactgttctgcaattttttttcacttaatgtttgattgaagacaaccttttataccatctccacagtattaactccaaagtattttgat

SEQ ID NO: 67400 - DNA, 601 bp, Human
tcttttctttgtaaattacccaggcttgtgtactcctttatagcaatgcaaatgatctttatatttctttgatctaataatcaaagaaatataaacaaaacgaagatatcttttttctttgcctatcatatgatcacgcactgttaacacccactgtaggtgagggctggtgaaacacagcctcagaagttgatgctaaaaataaaatgggtgtagccttcctagaggaaaatttgtcagtatctctcaaaattttagatatgcataccctttgacttagcaatttaatttctagcatttrcactgaaagtatttgcaaaaccattcaaaaacatagagatgtttagaccaaaattgtaaattcacaaactcttttgaaaataaagaaatctataaagggtctctgcaagcttaaaatcctctggaaagatctactaatgatttaatatatgtcttaccaggattttttatgcgtacttttttctaaaactaagagatttcatataccatatatgtatattttatatactttaaatattatatatactgttctgcaattttttttcacttaatgtttgattgaagacaaccttttatacca

SEQ ID NO: 67401 - DNA, 601 bp, Human
ttgtataatattttgacctgggttattttattttatcttcatgacaatactatatggaaggtactgttattaagcccattttacatatgggaaaactaaggcttagagcagttcaggaacttaaccaaaggcacacagctaataagcaatagaattgccatttgaactggatctgcctgtgcccgagctgttaaccaccccctctgaagtgctgcttctatcagcagtcatctaaaccttgtctgtattcgcaggggtggaggcagtagcctgcatgtccccaccacccaccctctgtgaytcagcccatcagccgcctcacatagacattgagcactcaaatgttcctgctaggacttcccacctccctaatcacctcacactggaatagatggtatttgctcttggtatttgctcttgggcatggcctggaatgcaaaactgacctttctccctgacaaagaaaagaagggataagataaatttgcagactctacatttgataaaatttacagttctcaaacagccatcccccttgtttatatttctttgatctaataatcaaagaaatataaacaaggtgccatgctcgtatagcctg

SEQ ID NO: 67402 - DNA, 601 bp, Human
tactactttatagcaatgcaaatggactgagaagtgcctttgcttataaaatgagcagaaacagagacccgtagagaactgtctcccaagcaagtcttccatggctacctggttttcccctgcaccatgcccccacaatgccctgtgcaacctttgcctttcaaaattatgcatccatattgtaatgacttgtttattttttttgtccactatagcctggatgcttctccgatgttagagactgtcttttacacttctctgccaaaaacgtagcaggtactcaaggaatgtgcaaataaaygaatgaattaatactgataattttgatagccaaggattgggctaccaaaataatcaaatcataacaaatgcctgctatttactgacttcttactctttatgttccaggtattgtataatattttgacctgggttattttattttatcttcatgacaatactatatggaaggtactgttattaagcccattttacatatgggaaaactaaggcttagagcagttcaggaacttaaccaaaggcacacagctaataagcaatagaattgccatttgaactggatctgcctgtgcccgagctg

SEQ ID NO: 67403 - DNA, 601 bp, Human
ctgggtcatgggggcagatcccttatgagtggcttgctgctgttctcgctctattagttcccatgtgttctgattgttaaaaagaggctggacatagtggctcatgcctatagtcccagcactttgggaggccgaggtgggaggatctcctggggccaggagttcaaaaccagcttgggcaatatagtgagacactgtctctacaaaaacaaaaaaacagaaaaaagcctggcacctctcctctctctctctctgtctctctcctccctcccctcacttcctctcacaatgtgatgcctgygcaccttcatcttctgccatgagtgagggctttccgaagccgtcaccaggtgcagacactggtgccatgctcgtacagcccgcagaacggcaagccaaataaacctttctttgtaaattacccaggcttgtgtactactttatagcaatgcaaatggactgagaagtgcctttgcttataaaatgagcagaaacagagacccgtagagaactgtctcccaagcaagtcttccatggctacctggttttcccctgcaccatgcccccacaatgccctgtgcaacctttgcctttcaaaatt

SEQ ID NO: 67404 - DNA, 601 bp, Human
agaaactcaggtcagtggcatcagttaagctttaaaaacactccctgagactatggctgccacactgcagaggcaaccgctggaaacagagctggggaacgcactgccttatccaaggacagcaggggccaggaattttgagacagtccttcagcttacattgggcacttatgtcctctagtgcctacagtcatgaagactgaaaggttgaaaaaaaaacttctaccttgtgccctgctggtgggaatgcaaaatggcgcagccactatggaaaacagtatggtgtttcctcagaacattmaaaatagaatgaccttatgatctagcaattccacttctgggtatatatccaaaagaagtgaaagcatttgatatgaaagaatatcaaagagatatttgcatacctgtgttcatagcagcattattcacaatagccaaaaggtggaagcaacccaagggtgcattgacaaatgaatggagaaacaaaacatggtatgaatatatgaatatatctatgtatatacacaaaccatgtattatcattcagccttaaaaaggaatgagactctgatacctgctacagcatggatgaaccctgagg

SEQ ID NO: 67405 - DNA, 601 bp, Human
cctcatgcctctggggagtctttgaggacaccatggaggggtaagggtggggctcataaaggagggtgtggagtgggtgttaattcctgaatggtcaaggaaatcacatctctggatccccacaatctccaagatgcagcctgagcctgcatacgcccaggcctagggaaagttttcagcatgttggctacagaccagggtgaggggtgagaaactcaggtcagtggcatcagttaagctttaaaaacactccctgagactatggctgccacactgcagaggcaaccgctggaaacagagytggggaacgcactgccttatccaaggacagcaggggccaggaattttgagacagtccttcagcttacattgggcacttatgtcctctagtgcctacagtcatgaagactgaaaggttgaaaaaaaaacttctaccttgtgccctgctggtgggaatgcaaaatggcgcagccactatggaaaacagtatggtgtttcctcagaacattcaaaatagaatgaccttatgatctagcaattccacttctgggtatatatccaaaagaagtgaaagcatttgatatgaaagaatatcaaagag

SEQ ID NO: 67406 - DNA, 601 bp, Human
actggggcctctgttggcactgtcccctggcctacctcccgggaagccctcgctaccacaggtgggaattgataaacaaccatcatcaccacaaaacctccttggaggcctgagtcccccataggacctcttgggagtctggagcccctttacagggaagtgggaggcccctcatgcctctggggagtctttgaggacaccatggaggggtaagggtggggctcataaaggagggtgtggagtgggtgttaattcctgaatggtcaaggaaatcacatctctggatccccacaatctccamgatgcagcctgagcctgcatacgcccaggcctagggaaagttttcagcatgttggctacagaccagggtgaggggtgagaaactcaggtcagtggcatcagttaagctttaaaaacactccctgagactatggctgccacactgcagaggcaaccgctggaaacagagctggggaacgcactgccttatccaaggacagcaggggccaggaattttgagacagtccttcagcttacattgggcacttatgtcctctagtgcctacagtcatgaagactgaaaggttgaaaaaaaaacttc

SEQ ID NO: 67407 - DNA, 601 bp, Human
aggaaacaactctgcaattgattagcaatgtctgccatgtgcccggaggtggggtatggcagtggatgggccacatgtgttccttcctggttcagaggagttcaggggaccctgtgaattctaccatttataattgtgtgactcagtgatatactgttttactttatctttggcatgaggcctgtctttacacaaatagctttttcatctgtttggtctagcaccttagccaccatcatctttcagaagccttctcagttactctttcaaagcaacagcaaccttacaacaaaataaacayatttactgattcatcacactcaaattcagtaaactactgcttcctgccacaaggggtccaggaaattaggtcagaaaggagaatttacacttattcagcatctattaaacaccattctccagacatggcctcctacttgtaaaataccctcctcgggcagtcattaaatcctcttttcacagagcagcaaccaatgctcagagccatgagggaagtttccccagaagcagggatttcaacttgcagcagtttggattccaaattctaccactatgctcccctaaaacgtacccaaatatc

SEQ ID NO: 67408 - DNA, 601 bp, Human
tactcttttgttcctgcctcctttctgggaggccctgaattatgagactatggaaaattcaggctgttttccctgtggctgtattttccacatcgcatcactgaaatgtgtcaatggccaacctcttcagacacgggagcatgccacccacttaaaatgcccctctactggtttagaatgttccttttcagcagcagcaagtctgacaccccatcagtggtgagaacaaaagaaagtaggtgtgagattccacagtttcctaaccatcttccactgatatcttctcccctgagcccaaggrgctctgccatccctgggagaggaaaaccatacagttgtccttttgtgatgttggttttccatctgaggcctttggaagggggaggggctcaatgactcttgatgttaatgacacaagctgtaacccgggaatggaaggctggggatcaaaacaactcaacattatggctgcaaaccaccatgactttatcagaaatatatcttttaattgaaatggccaaaatttacaactgggttcatattccagttctaccattttaccgtctgccatgacttgcggaatttaacttctttaaactcc

SEQ ID NO: 67409 - DNA, 601 bp, Human
aggatgtatgttctttctggggaaggaggtccccatagatttaatcaaaaagggaggaccctggaaacaatggaaaaagcaaaggctactaggaatctcctgctcgtggggctgagcctaagttctgcttgccaggcatgagaaggatggaatctgctggcctctgcccaccccagccacccggggacccctggcctggagggcaggcccctccgccatcttcaagccagggtgtttttctatcctagccactactcttttgttcctgcctcctttctgggaggccctgaattatgagacyatggaaaattcaggctgttttccctgtggctgtattttccacatcgcatcactgaaatgtgtcaatggccaacctcttcagacacgggagcatgccacccacttaaaatgcccctctactggtttagaatgttccttttcagcagcagcaagtctgacaccccatcagtggtgagaacaaaagaaagtaggtgtgagattccacagtttcctaaccatcttccactgatatcttctcccctgagcccaaggagctctgccatccctgggagaggaaaaccatacagttgtccttttgtga

SEQ ID NO: 67410 - DNA, 601 bp, Human
ggtgaaatctctcaagaagaacaaggttccaggggctgtgacctgtaatcactcctgacatatcacaagtctccactggatgtcatgtctgcatcctccagctatgccatgggtaagacaggctgcagagggagaagggagtcagaggatgcttcacgcagcagttcaggctgccaagctgcagccacaggacagaggccttctccaccgaagatcagccttggctgcagttgtgggcagcaggagtcagtgcaggcccctatctgggctacactgctgtcaaatggtccatctgggagaygccccaggatgagctgggcactcctacatctgagacagagcccaggcccagcattttccagaccaacccccgacccaatgcctatacaacaatgctggtaatcagaatcttctcaaccttcagtttcttcaaaatggctcttcatagtctttaggattcaaaccacctgaatggggaagctggcatgattcgaggaacctcaaggttaagtcttatctacaatggtggggatgtcactccaatgaaggcaacagacagatccttctacagcctccctgctgcccactaggccatgtctgt

SEQ ID NO: 67411 - DNA, 601 bp, Human
gcttagggctggagccttcggtggggcaggtgaaatctctcaagaagaacaaggttccaggggctgtgacctgtaatcactcctgacatatcacaagtctccactggatgtcatgtctgcatcctccagctatgccatgggtaagacaggctgcagagggagaagggagtcagaggatgcttcacgcagcagttcaggctgccaagctgcagccacaggacagaggccttctccaccgaagatcagccttggctgcagttgtgggcagcaggagtcagtgcaggcccctatctgggctacrctgctgtcaaatggtccatctgggagacgccccaggatgagctgggcactcctacatctgagacagagcccaggcccagcattttccagaccaacccccgacccaatgcctatacaacaatgctggtaatcagaatcttctcaaccttcagtttcttcaaaatggctcttcatagtctttaggattcaaaccacctgaatggggaagctggcatgattcgaggaacctcaaggttaagtcttatctacaatggtggggatgtcactccaatgaaggcaacagacagatccttctacagcc

SEQ ID NO: 67412 - DNA, 601 bp, Human
tagctcagtctcttaaatttggttttcctttgccttgggaagaaagtaataaatgtgccaagtccctccacactctcagcacttggagatagcacctatgcaagagctggttcctcaggagacagtgcttctgagacacagtccctaggcacatggacttgagagaactgggaggtgacaaaaactgcatcatattttgtattttctctgtccatcccaaaggcttagggctggagccttcggtggggcaggtgaaatctctcaagaagaacaaggttccaggggctgtgacctgtaatcmctcctgacatatcacaagtctccactggatgtcatgtctgcatcctccagctatgccatgggtaagacaggctgcagagggagaagggagtcagaggatgcttcacgcagcagttcaggctgccaagctgcagccacaggacagaggccttctccaccgaagatcagccttggctgcagttgtgggcagcaggagtcagtgcaggcccctatctgggctacactgctgtcaaatggtccatctgggagacgccccaggatgagctgggcactcctacatctgagacagagcccaggccca

SEQ ID NO: 67413 - DNA, 601 bp, Human
aatgggattaagtttagagtgaatctcatgatttacctgcacccagataagcctaggactgttcacgggattggttgtgctattccttcattcatgcaagggaaggaatgatgcaggggatgagggctaggaattgggcaggattcagggacagggtggaagcgcatgcttctgtttttcagtaattacaaaaagccaagcaggctctgatagtgtcctcactgcccagcctcattttgatcacattcaggacactaccccgtccttggggatggatagagtttctccagattgactcaaytggtttcttgtttgccctttttagatgagtcagtgagctgacttggcctagctcagtctcttaaatttggttttcctttgccttgggaagaaagtaataaatgtgccaagtccctccacactctcagcacttggagatagcacctatgcaagagctggttcctcaggagacagtgcttctgagacacagtccctaggcacatggacttgagagaactgggaggtgacaaaaactgcatcatattttgtattttctctgtccatcccaaaggcttagggctggagccttcggtggggcagg

SEQ ID NO: 67414 - DNA, 601 bp, Human
ttgtgaggaagtccaggctacatggggaggccaacagcactgcctagggttccaggcaacagccaggagcttgggtgaaaagagcctctagatggctccagcgctggtcattgagtaccctggcttcaagtcagaggtctcaggcattacggagcagagacaaaccatccccatggtacctgtccaagttcctaacccacagaatccaggaacataataaacggttgttttatactgctaagtttgggtaacagatgcccagaacacggtgcatccaaactcaccctctgccttgccagcsttcctgctgggcactttgaaggtgatgatctcagagcttggcaggtatcaccaatgcttacggggctgggggtggggctgctcccctgcagcaaggctaaccagaagcataatcatggtggggtttgtgccctcagcaatcacacacagccgtctagagaaaaaaggcctgtctcatatccctctgccttagccttctctctatgcctccactttatagccccatgactgatgtcagcaacttttccatctctactttgaccctgcctggccttggctaggacccctgggccttcttggt

SEQ ID NO: 67415 - DNA, 601 bp, Human
agcagcacagatgtctcctcctcaaggaagccttcccagactctcccactgggcaactagcgcctctctcctgggtgctccccagtcctgagtacccaccccagttgggtactcagggctggagtgatgaagagaggaatagttcagggttcaaggaccaacaggtggttataagacatgccaagactcatactgggaaaggcaagattcagatgggagggctgtaagtgcccacagttggcttttctctctgaggggtggtcctgtccaggcgacccatggctggttggtcactggtgtytccaggcaacccaaggagggaaatgcctcagtccctaaagcccccaagacctgcactgaaatcactggcctcttctccacccagagcactcacagcttcttcgaccaagggactgcttccagaaacagaaaatagcagggggctggaaggcagcatgcccagccctcaatcataccgtcctcatcctagcagagcacttggctctaatgactcacttctaatgaactaactgtggaggaagtaatgctgcataacttcacagctgggttctaagaggcaacatagcttccatttggctct

SEQ ID NO: 67416 - DNA, 601 bp, Human
ttagcaagattgctgagcaggtccggtctctgaatctgcagggcttacgggttctggactctcacagactgaccaaggtcatgagttcctgtaagactgtcaccctgagcacattctacctcacaactgactgtctccacctactccagcaaccatgacctggagtccaaactgcatggtatacagagctcttattggtcagctcccaacctgttttccagcctgatttttctgacctccctaggacccagatttttggcccatgcttttagaatgcccttacctcccttatctgtcaatyaatctttagggagcagcacagatgtctcctcctcaaggaagccttcccagactctcccactgggcaactagcgcctctctcctgggtgctccccagtcctgagtacccaccccagttgggtactcagggctggagtgatgaagagaggaatagttcagggttcaaggaccaacaggtggttataagacatgccaagactcatactgggaaaggcaagattcagatgggagggctgtaagtgcccacagttggcttttctctctgaggggtggtcctgtccaggcgacccatggctggttg

SEQ ID NO: 67417 - DNA, 601 bp, Human
ttctgacatcataaaagaatgtgacaaggagagagggagtgaacaaaaggtgtgtcccagtgacccggggagagggaggcctggagctccgtggcagctctctgctctgactacaccaggcacccgggaacccatgacttcccttcaacaatctcaagctccctcggctctaattctcactcacccagcaacctacagaaaaccaaacttgccccccaggaccctgacaccacatagggagcatcccggatgggggtccccacatggaaagagatgttcctcaaccctgcaaattaatagsctgtgcttttggtttacacattagtgaggtcagaatttagttagcaagattgctgagcaggtccggtctctgaatctgcagggcttacgggttctggactctcacagactgaccaaggtcatgagttcctgtaagactgtcaccctgagcacattctacctcacaactgactgtctccacctactccagcaaccatgacctggagtccaaactgcatggtatacagagctcttattggtcagctcccaacctgttttccagcctgatttttctgacctccctaggacccagatttttggc

SEQ ID NO: 67418 - DNA, 601 bp, Human
cagctagtgagtgctggagctgggatgtgaagcagcagctggctctcctgctaggtcaggcagcagatggggtccgggatccaaaaagatggccaggctgagtatcccacggtaacaagagcagctacagaggtggggaacaggttcaccgacgcaaggaaaggcatgaatcacaacagcgagaacctcagactctccccagcctgacttttcccatccattcaggggccttggcctttgtttcccaacccgcagggagctccaactgtcctacccttgtgtcaggaaatggaggctgggyggggaagccttggcaggagcagccccctgacagctgctgctgtatctgctcagggcccacaggcctttcagctgctccaaactccaggctgcaaaccccgcgggacctacagcgtctggatgcagagcaggagagccagcccaggtcagtgtgaagtcccccatgtgactccgggagaaatgcttccggtcacaggcgggtagccaagttctcaccaggttctcaggaactgaatccggatgtggatcccaggagatgagtgccagagagaaaggaagctggcttcactcctaactctac

SEQ ID NO: 67419 - DNA, 601 bp, Human
caccccagggtatggagaacactgctcctaaccctttagtgcctgtcatgccttccttaatcaggaaagagtcctggagttctctctctcctcctatcctccctcttctccttccaatatatacagacagctcccacctccagagcacctctgggagccttctctctttgtcggtccctggaaaagcttgttccttcctccaggaatcttgtcctgctgccaggccaccgagagccagccctccacacacagagcctcccaacattctttcagcctgagtggcatttcctctggagaagtyagacgcatatttaactccaaaggaagcagcttgtctctactcatccaagtgcctgtcatcccacctgggttggcagccgttgggagagccctctctacccactccccccaacacttctccggggacttagggtctccacagccccgaccacctatccaaaggcacgctgtgtgggtggagccactgagcctggccggggtctattccccagacacaccgagtccacagttagcactccatatgcagaagatcaggaggctgatgggcatttcaggcccaaatgcactgacaagtccagca

SEQ ID NO: 67420 - DNA, 601 bp, Human
caggagccaggagcccatcagtgccagctattattattctaaagtgccaatgtctgcaaaggcctggctcgcctggggctgctcccaccaattttcttcccccaagtcacactgcccaggaaagaggaaaatgcacccccgagcagagcttggcaccccagggtatggagaacactgctcctaaccctttagtgcctgtcatgccttccttaatcaggaaagagtcctggagttctctctctcctcctatcctccctcttctccttccaatatatacagacagctcccacctccagagcasctctgggagccttctctctttgtcggtccctggaaaagcttgttccttcctccaggaatcttgtcctgctgccaggccaccgagagccagccctccacacacagagcctcccaacattctttcagcctgagtggcatttcctctggagaagttagacgcatatttaactccaaaggaagcagcttgtctctactcatccaagtgcctgtcatcccacctgggttggcagccgttgggagagccctctctacccactccccccaacacttctccggggacttagggtctccacagccccga

SEQ ID NO: 67421 - DNA, 601 bp, Human
gcaggagccaggagcccatcagtgccagctattattattctaaagtgccaatgtctgcaaaggcctggctcgcctggggctgctcccaccaattttcttcccccaagtcacactgcccaggaaagaggaaaatgcacccccgagcagagcttggcaccccagggtatggagaacactgctcctaaccctttagtgcctgtcatgccttccttaatcaggaaagagtcctggagttctctctctcctcctatcctccctcttctccttccaatatatacagacagctcccacctccagagcwcctctgggagccttctctctttgtcggtccctggaaaagcttgttccttcctccaggaatcttgtcctgctgccaggccaccgagagccagccctccacacacagagcctcccaacattctttcagcctgagtggcatttcctctggagaagttagacgcatatttaactccaaaggaagcagcttgtctctactcatccaagtgcctgtcatcccacctgggttggcagccgttgggagagccctctctacccactccccccaacacttctccggggacttagggtctccacagccccg

SEQ ID NO: 67422 - DNA, 601 bp, Human
tgacccgctgcagagactgccctgtggaaaaacccaggcaggagccaggagcccatcagtgccagctattattattctaaagtgccaatgtctgcaaaggcctggctcgcctggggctgctcccaccaattttcttcccccaagtcacactgcccaggaaagaggaaaatgcacccccgagcagagcttggcaccccagggtatggagaacactgctcctaaccctttagtgcctgtcatgccttccttaatcaggaaagagtcctggagttctctctctcctcctatcctccctcttctycttccaatatatacagacagctcccacctccagagcacctctgggagccttctctctttgtcggtccctggaaaagcttgttccttcctccaggaatcttgtcctgctgccaggccaccgagagccagccctccacacacagagcctcccaacattctttcagcctgagtggcatttcctctggagaagttagacgcatatttaactccaaaggaagcagcttgtctctactcatccaagtgcctgtcatcccacctgggttggcagccgttgggagagccctctctacccactcccccc

SEQ ID NO: 67423 - DNA, 601 bp, Human
tccttttttgaccttaaaaccaggccagtcgcaggagcctgtaagatgcacatttgtctggaacgcagcagggcgcctccagtctttcctggatgctacactggaaactctcagccagctcagggggtgggggccccaaacctcactgaggggctctagcctgacccgctgcagagactgccctgtggaaaaacccaggcaggagccaggagcccatcagtgccagctattattattctaaagtgccaatgtctgcaaaggcctggctcgcctggggctgctcccaccaattttcttcccycaagtcacactgcccaggaaagaggaaaatgcacccccgagcagagcttggcaccccagggtatggagaacactgctcctaaccctttagtgcctgtcatgccttccttaatcaggaaagagtcctggagttctctctctcctcctatcctccctcttctccttccaatatatacagacagctcccacctccagagcacctctgggagccttctctctttgtcggtccctggaaaagcttgttccttcctccaggaatcttgtcctgctgccaggccaccgagagccagccctccacaca

SEQ ID NO: 67424 - DNA, 601 bp, Human
aggatgggccaactaccaacaaggacaaggaggctgcacggaacaaggaaaaacagacacaattcgatcacccctgggggctagacccctgagcatccatcacctcagctcgtcctcacactatcctgtcttccacagtaagcaagagaagccccatttgacagatgaggaaactgagacagtacaatgaagtcacttgccaaaatcagaagtggcagagctacactcaagccaagttctgctcaactgcaacccagtgctctgtggagctctctctgggagtggttgggctgggtcgggrccccagccagggggcaggaggtggcagtgtgaggcaggagggaactctggaactctcagggaggtggagcactgccagctgtgcctgctgcaggagggcagggtccacaaggctggccctggcacaaggtgactggaggattagcaacagtgccctgaggaagagcagcaggaagcttcccttttatcctacaggattcccaagtcaggttttccccattcctgagagtccttttttgaccttaaaaccaggccagtcgcaggagcctgtaagatgcacatttgtctggaacgcagcagg

SEQ ID NO: 67425 - DNA, 601 bp, Human
aaaagaataacagaaagaacgaactgaccagtagatgaaccactggtcatagagccttagagcctaatggtgttgatggaagaaaagctcagatttacacacacattcataagagcacacatccttccctcacagctctcagaaggaaacaatcctgttgacatcttgatttcagacttccagcctccagaaccgtgacagaatagattcctgttaagtcgtcctgtttggggtactttgtgatggcagccctagcaaactaatacatgcaccttcccccgatacaagccagcagccccartctcctctgtttcggatcttccacgcacagtcagctctgttcctaagccttcagcatcttattgctagaaggtgacagaggggtggtcagtggggaggtgctggtacattccaaaggatgtggagccacagggaccagaacagcgtctcttggctgagccaggctctggcactccagccccgtacacattctagtcactgaaggtttgggtggggcatgttatctgtggattaccatttcctggcaccctgggggtggtgtggtcatgccaggccctgagtgctcccaggatgaacagat

SEQ ID NO: 67426 - DNA, 601 bp, Human
tcatggttctgcaggctggcaagtccaagattgaggagccagcatctggtgagggccttcttgctacatcatcccctggcagaaagtgaaagggccacaagaaagggcaagagaaaaggggaccaaacttgcccttttataagaaaccaactcccacaataatggcattaatccatttatgactgtggagccctcaggatctaaataccccttaaaggtctcacctcttaatactgttaaaatggaaattgaatttcaacatgagttctggagcagtctctgactctaattcccccagcaygtgcttgactcgcagctgccattcactaaaagaataacagaaagttagctgggcatggtgacatgcacctgtgattccagccacttgggaggctgaggtgggaggatcgcttgagcctgggaggcagaggttgcagtgagccaagatcgcaccactgcactccaacctgagtcagacagtggaccccatcttgaaaaaaaaaagaataacagaaagaacgaactgaccagtagatgaaccactggtcatagagccttagagcctaatggtgttgatggaagaaaagctcagatttacaca

SEQ ID NO: 67427 - DNA, 601 bp, Human
atctacctcttagccctgggaccagaagagggactccatcctgaagtgaaaggcacatcaaaaagcacttcaaaggctatgcctgcaatccatcacatgcaggcacagagccctggccagataggaccactagtgcccgccacctggcacaatttctctctagtctccttgacatagtccttatccctacttcatagatgtggaaactgagacttaaggatagaatctgcccagaggtcacccagcttgactggactggagctgacagacacttttcatttcctgctggggagatcaccakttctctctcctcttcttcagtcacaacttagtagcacctgcccgggacagggctctgggccccatgcatccccagagacagaaggcaggaactcacggtcaaggccatagccactgagcgtctgggcccaaatgtcatatggctggaagacagcaccctgctgcatggacttcagcagctcctctccagtcctggccactcctgtttgcccccactcctccctcccatcctgctgggggaatctgacaaacagcccagaagctggccatggggaatgcagtcattcagaggatggcttct

SEQ ID NO: 67428 - DNA, 601 bp, Human
cttgttttagtaaggaatgagtaccttgcagggcctctatctacctcttagccctgggaccagaagagggactccatcctgaagtgaaaggcacatcaaaaagcacttcaaaggctatgcctgcaatccatcacatgcaggcacagagccctggccagataggaccactagtgcccgccacctggcacaatttctctctagtctccttgacatagtccttatccctacttcatagatgtggaaactgagacttaaggatagaatctgcccagaggtcacccagcttgactggactggagcygacagacacttttcatttcctgctggggagatcaccatttctctctcctcttcttcagtcacaacttagtagcacctgcccgggacagggctctgggccccatgcatccccagagacagaaggcaggaactcacggtcaaggccatagccactgagcgtctgggcccaaatgtcatatggctggaagacagcaccctgctgcatggacttcagcagctcctctccagtcctggccactcctgtttgcccccactcctccctcccatcctgctgggggaatctgacaaacagcccagaagc

SEQ ID NO: 67429 - DNA, 601 bp, Human
tctgagaacaagtgtgtttaaggctatatcgttatattatttataatccagaaataacaaaaatgtccaaccagagggaactgattattgtacagtcatttcacagaaaaatccctccatgcagacattaaaaagaatgcagttgttctttgcataatgatttctaaaacaagcaagggttagaaccataaacaaaagcagggaaattttgaaaccataagcttttgtaaagcccttctgtaaagcagaataataccacactcatgcctgtgcccagtactgtggctggaacatcatgggygcacaataaatatgtgttgagtgggtgaaagcacttgcatcttactgtggcaaacaggccaacaaaatgcagatcattagcaatggtttgagaactagagcaaaaaacatacattccattaatttggcttctcattcccccgaaaggccttcgtagacttgcgattttcactatacatttcctctcccagatctttaattaaaaatatgagctaagattcttctagcatcaattcctataagaccctgctgtttacaattatccatcaagacgggtgcattttcatccttaggaatatct

SEQ ID NO: 67430 - DNA, 601 bp, Human
agggtatgaacggacaacttagaataacagaaatttgcctcttcaaatagaaaggcgttcaacctcaccaatgaaatcaatcaagaaatgcaacttaaaagagcataacaccatttttttcacttagaatggaagaaattagaaaggttgaatgtctccatggtgggtggaataacagcacccccaaagatgttcacatcctattccccggaacctgtgggtatgttatattacataggaaggggaaattagaggcagagggaatgcaggttgctaatcagctgacctgaaggtagggagygcactctggattatccaggagcacctacctgacggaatcacaagggactttaaaaatggaaaagggaatagaggaagagacagtgtcagagtgatatcatgccaggtgtcacagacactccattggccatccctggctttgtagatggaaggggggccaggggccaaggagcagaatctctcttagagcctccagagaggaatgcagccctgcccactctttgcttttagcccagtgggacttgtgttggacttctgacctccagaactggaaaacagtaaatttgtgttgttttaatcc

SEQ ID NO: 67431 - DNA, 601 bp, Human
ctgaatgcaggtgtggagccccacctggaagagcctggccgggcaggcctggacctccggcagctgcctccagtccccttccaggggctctgctgctctgatcaacactgcaagtgctggcggcccagcaaccagggtgctcccttgccaagcattgatgcttttgtttcagttactttcccagcaccccttaaatgtcaggcatgataccatcgctgtttttacggataagaaaaccgaggctccgagtagggtgaacggccgcccaagtgaagggactgagtctgagccagagccccarcggccagagaagtcccaacagggctgggaacaaatcacagacgcgctttgtctcagcccagcacacgctcttgtgcacagacacaactcaggctgctcagccggaagcctcccgacgttctttccaaagcagaatggcaagaaaatggagtgggagggacgacatttgggagaaaggaagggccaacaggcacagaatcccttctctgaaccagccatattttgagggactggggacacaaaggtgaatgtgaggaggcctctgcccttaagaaattcgtaattcaattggaaaaagaga

SEQ ID NO: 67432 - DNA, 601 bp, Human
aggaagggccaggcccgcttccattccccattcttgaccccacaggctcagcagggtcaggaaaggcctccagactctagtcgctcctgatccctgcctggctgcactgcccttcagcatctccatgcctaggaggcttggcagcccagagcctggaggatcccacaccaaattcacacaatcgccatctgtgcacagttctcccccacccacacccagggcgggagcacagggactcagggctggtcttccacacagaacatatggatttaataaaaagtgctaatgaggtccaggcccrcccgactgcacaggaaaggctggaagacaggccccaagggctctgctgactgtgaagactgggaggcagcagagggggcatcgctagggaccctgccagaaagccacagccctgcccacagagagcgccctcagggtcctgggtctagggtccctgcaagagggaaaggcagctgccagcttggaaatgaattagaggagggtggctggactccagccctcccagcccaggtgctgtctcctcatggctgccagctctgcctggctggagaaacagggagagaaggagtgaggggaatct

SEQ ID NO: 67433 - DNA, 601 bp, Human
aagctggcaaactggcagtacatgctgggcccacagtcctcgtcgatgatgcactcctggggaagggcacagggagcagatgtgtcaatggagagcagagcagcaggcccacagtgcccaggaagggccaggcccgcttccattccccattcttgaccccacaggctcagcagggtcaggaaaggcctccagactctagtcgctcctgatccctgcctggctgcactgcccttcagcatctccatgcctaggaggcttggcagcccagagcctggaggatcccacaccaaattcacacaatcgccatctgtgcacagttctcccccacccacacccagggcgggagcacagggactcagggctggtcttccacacagaacatatggatttaataaaaagtgctaatgaggtccaggcccgcccgactgcacaggaaaggctggaagacaggccccaagggctctgctgactgtgaagactgggaggcagcagagggggcatcgctagggaccctgccagaaagccacagccctgcccacagagagcgccctcagggtcctgggtctagggtccctgcaagagggaaaggcagctgccagct

SEQ ID NO: 67434 - DNA, 601 bp, Human
ctctggttgtcacagatggtcccattgctgcccctggtggccattttggtgcagtgaccccagacacacagctggtctccacagcactcactgtcccgggtgcagagctgcagacaggtggaaagagcctagagccagcggcttagggactgggggcctgctgagagcccagcctgaagataccacagataggccaacctgcatcctcccattgtagagacaggcagaccaggctgagatttcagtgaaagtcagtgggacagaggtgggagcttggctggcgagacatgggggtcagaaygctggaaaaatggcaccgggaggactcatggatctgagtctttctccacagcttaagattttgcaaagaacagcagggggtctttgtggtccccacagacttgtgctgttccctttttccttaggtccctaggtccaggcccaaagaggcaaggcccaatgatgagccgattaaactaaggcccaagccagcccaagatgaggatggcctgtgggtgccagggtcctgcagccacacagggcatggcagttagagagcaaagtgaggtccccacggctgtgcccagtgacggtaccgagt

SEQ ID NO: 67435 - DNA, 601 bp, Human
aaaagcagccctttaggaagatcacggaggcggcaggtacagggaggactagtgggctggggatgcagagctggggaggcggcaaatgagaatttttcaaaaccctagtgggggcggagagagcctgagcagacctcacctgggagaggcaggacggaagatgggagtggaagcgggtgattcacaggtaaaggaacctgggaaataaggagtggtgggagggagggggctgctagtcccaccccattccagactgggcttttgcatcctgaagtcatttaacttttctgagcatcaacasgggaaaaaaaagaggtggtcttcccactccgggcagaggctgtgggagtgcagcacacactgatgagcatttgggagcctatccaagaggtgggacgcgaaaccatgtggttggcatggacgtggctccaggaggtccagtgtggtggagcttgggacagggtttttcctgcatctgaggggaggccactcacctctctggaaggcacagcacagccccggctggcagtccctctggttgtcacagatggtcccattgctgcccctggtggccattttggtgcagtgaccccagacacac

SEQ ID NO: 67436 - DNA, 601 bp, Human
aggagggcaagtaagttggagctgcatgaggcctcacaagacagcctaaggagtctgaacatcgtgggagacaacaggagctgctgcaggtcccaggggagcaacacccaaaaagcagccctttaggaagatcacggaggcggcaggtacagggaggactagtgggctggggatgcagagctggggaggcggcaaatgagaatttttcaaaaccctagtgggggcggagagagcctgagcagacctcacctgggagaggcaggacggaagatgggagtggaagcgggtgattcacaggtaraggaacctgggaaataaggagtggtgggagggagggggctgctagtcccaccccattccagactgggcttttgcatcctgaagtcatttaacttttctgagcatcaacacgggaaaaaaaagaggtggtcttcccactccgggcagaggctgtgggagtgcagcacacactgatgagcatttgggagcctatccaagaggtgggacgcgaaaccatgtggttggcatggacgtggctccaggaggtccagtgtggtggagcttgggacagggtttttcctgcatctgaggggaggccact

SEQ ID NO: 67437 - DNA, 601 bp, Human
aagcaccagactgtgaagcctggagaacagcctgggggagctgaacaaatgcacaacacctcatgctgtcaagccagaggggaaacttactgggaagaagatgtaggaagaagcctggtcagcccacgcctaaagcacacacctggggaaataaattagctatttctattgcacatctacccacagcctggtccagatctaaatctcttcccctcccagcagtgcagcggcggcagccgcaggctcccccagcgccatctcttcagtcaggctcctctccaggtcctccagctcctggcgyacctcctccatgaagctgccaacttcatactcatcggggacctctctgggcagcaggatctccccatcttggtcacggctccccacgaaggtcggcttgcacacatacaccaggctgtggctggggagagatgggacaaagccaggctctaaacgtgggagcctgcccaggccgaaagctaaggcgccctgactctgtggggctcccagcctcaccttcatgccccctcctctcctgtctcttcaacagagacacttcacttcccgtcaacatctatcttaaaatgatggctgagggagg

SEQ ID NO: 67438 - DNA, 601 bp, Human; identical to SEQ ID NO: 67368

SEQ ID NO: 67439 - DNA, 601 bp, Human; identical to SEQ ID NO: 67369

SEQ ID NO: 67440 - DNA, 601 bp, Human; identical to SEQ ID NO: 67370

SEQ ID NO: 67441 - DNA, 601 bp, Human; identical to SEQ ID NO: 67371

SEQ ID NO: 67442 - DNA, 601 bp, Human; identical to SEQ ID NO: 67372

SEQ ID NO: 67443 - DNA, 601 bp, Human; identical to SEQ ID NO: 67373

SEQ ID NO: 67444 - DNA, 601 bp, Human; identical to SEQ ID NO: 67374

SEQ ID NO: 67445 - DNA, 601 bp, Human; identical to SEQ ID NO: 67375

SEQ ID NO: 67446 - DNA, 601 bp, Human; identical to SEQ ID NO: 67376

SEQ ID NO: 67447 - DNA, 601 bp, Human; identical to SEQ ID NO: 67377

SEQ ID NO: 67448 - DNA, 601 bp, Human; identical to SEQ ID NO: 67378

SEQ ID NO: 67449 - DNA, 601 bp, Human; identical to SEQ ID NO: 67379

SEQ ID NO: 67450 - DNA, 601 bp, Human; identical to SEQ ID NO: 67380

SEQ ID NO: 67451 - DNA, 601 bp, Human; identical to SEQ ID NO: 67381

SEQ ID NO: 67452 - DNA, 601 bp, Human; identical to SEQ ID NO: 67382

SEQ ID NO: 67453 - DNA, 601 bp, Human; identical to SEQ ID NO: 67383

SEQ ID NO: 67454 - DNA, 601 bp, Human; identical to SEQ ID NO: 67384

SEQ ID NO: 67455 - DNA, 601 bp, Human; identical to SEQ ID NO: 67385

SEQ ID NO: 67456 - DNA, 601 bp, Human; identical to SEQ ID NO: 67386

SEQ ID NO: 67457 - DNA, 601 bp, Human; identical to SEQ ID NO: 67387

SEQ ID NO: 67458 - DNA, 601 bp, Human; identical to SEQ ID NO: 67388

SEQ ID NO: 67459 - DNA, 601 bp, Human; identical to SEQ ID NO: 67389

SEQ ID NO: 67460 - DNA, 601 bp, Human; identical to SEQ ID NO: 67390

SEQ ID NO: 67461 - DNA, 601 bp, Human; identical to SEQ ID NO: 67391

SEQ ID NO: 67462 - DNA, 601 bp, Human; identical to SEQ ID NO: 67392

SEQ ID NO: 67463 - DNA, 601 bp, Human; identical to SEQ ID NO: 67393

SEQ ID NO: 67464 - DNA, 601 bp, Human; identical to SEQ ID NO: 67394

SEQ ID NO: 67465 - DNA, 601 bp, Human; identical to SEQ ID NO: 67395

SEQ ID NO: 67466 - DNA, 601 bp, Human; identical to SEQ ID NO: 67396

SEQ ID NO: 67467 - DNA, 601 bp, Human; identical to SEQ ID NO: 67397

SEQ ID NO: 67468 - DNA, 601 bp, Human; identical to SEQ ID NO: 67398

SEQ ID NO: 67469 - DNA, 601 bp, Human; identical to SEQ ID NO: 67399

SEQ ID NO: 67470 - DNA, 601 bp, Human; identical to SEQ ID NO: 67400

SEQ ID NO: 67471 - DNA, 601 bp, Human; identical to SEQ ID NO: 67401

SEQ ID NO: 67472 - DNA, 601 bp, Human; identical to SEQ ID NO: 67402

SEQ ID NO: 67473 - DNA, 601 bp, Human; identical to SEQ ID NO: 67403

SEQ ID NO: 67474 - DNA, 601 bp, Human; identical to SEQ ID NO: 67404

SEQ ID NO: 67475 - DNA, 601 bp, Human; identical to SEQ ID NO: 67405

SEQ ID NO: 67476 - DNA, 601 bp, Human; identical to SEQ ID NO: 67406

SEQ ID NO: 67477 - DNA, 601 bp, Human; identical to SEQ ID NO: 67407

SEQ ID NO: 67478 - DNA, 601 bp, Human; identical to SEQ ID NO: 67408

SEQ ID NO: 67479 - DNA, 601 bp, Human; identical to SEQ ID NO: 67409

SEQ ID NO: 67480 - DNA, 601 bp, Human; identical to SEQ ID NO: 67410

SEQ ID NO: 67481 - DNA, 601 bp, Human; identical to SEQ ID NO: 67411

SEQ ID NO: 67482 - DNA, 601 bp, Human; identical to SEQ ID NO: 67412

SEQ ID NO: 67483 - DNA, 601 bp, Human; identical to SEQ ID NO: 67413

SEQ ID NO: 67484 - DNA, 601 bp, Human; identical to SEQ ID NO: 67414

SEQ ID NO: 67485 - DNA, 601 bp, Human; identical to SEQ ID NO: 67415

SEQ ID NO: 67486 - DNA, 601 bp, Human; identical to SEQ ID NO: 67416

SEQ ID NO: 67487 - DNA, 601 bp, Human; identical to SEQ ID NO: 67417

SEQ ID NO: 67488 - DNA, 601 bp, Human; identical to SEQ ID NO: 67418

SEQ ID NO: 67489 - DNA, 601 bp, Human; identical to SEQ ID NO: 67419

SEQ ID NO: 67490 - DNA, 601 bp, Human; identical to SEQ ID NO: 67420

SEQ ID NO: 67491 - DNA, 601 bp, Human; identical to SEQ ID NO: 67421

SEQ ID NO: 67492 - DNA, 601 bp, Human; identical to SEQ ID NO: 67422

SEQ ID NO: 67493 - DNA, 601 bp, Human; identical to SEQ ID NO: 67423

SEQ ID NO: 67494 - DNA, 601 bp, Human; identical to SEQ ID NO: 67424

SEQ ID NO: 67495 - DNA, 601 bp, Human; identical to SEQ ID NO: 67425

SEQ ID NO: 67496 - DNA, 601 bp, Human; identical to SEQ ID NO: 67426

SEQ ID NO: 67497 - DNA, 601 bp, Human; identical to SEQ ID NO: 67427

SEQ ID NO: 67498 - DNA, 601 bp, Human; identical to SEQ ID NO: 67428

SEQ ID NO: 67499 - DNA, 601 bp, Human; identical to SEQ ID NO: 67429

SEQ ID NO: 67500 - DNA, 601 bp, Human; identical to SEQ ID NO: 67430

SEQ ID NO: 67501 - DNA, 601 bp, Human; identical to SEQ ID NO: 67431

SEQ ID NO: 67502 - DNA, 601 bp, Human; identical to SEQ ID NO: 67432

SEQ ID NO: 67503 - DNA, 601 bp, Human; identical to SEQ ID NO: 67433

SEQ ID NO: 67504 - DNA, 601 bp, Human; identical to SEQ ID NO: 67434

SEQ ID NO: 67505 - DNA, 601 bp, Human; identical to SEQ ID NO: 67435

SEQ ID NO: 67506 - DNA, 601 bp, Human; identical to SEQ ID NO: 67436

SEQ ID NO: 67507 - DNA, 601 bp, Human; identical to SEQ ID NO: 67437

SEQ ID NO: 67508 - DNA, 601 bp, Human; identical to SEQ ID NO: 67368

SEQ ID NO: 67509 - DNA, 601 bp, Human; identical to SEQ ID NO: 67369

SEQ ID NO: 67510 - DNA, 601 bp, Human; identical to SEQ ID NO: 67370

SEQ ID NO: 67511 - DNA, 601 bp, Human; identical to SEQ ID NO: 67371

SEQ ID NO: 67512 - DNA, 601 bp, Human; identical to SEQ ID NO: 67372

SEQ ID NO: 67513 - DNA, 601 bp, Human; identical to SEQ ID NO: 67373

SEQ ID NO: 67514 - DNA, 601 bp, Human; identical to SEQ ID NO: 67374

SEQ ID NO: 67515 - DNA, 601 bp, Human; identical to SEQ ID NO: 67375

SEQ ID NO: 67516 - DNA, 601 bp, Human; identical to SEQ ID NO: 67376

SEQ ID NO: 67517 - DNA, 601 bp, Human; identical to SEQ ID NO: 67377

SEQ ID NO: 67518 - DNA, 601 bp, Human; identical to SEQ ID NO: 67378

SEQ ID NO: 67519 - DNA, 601 bp, Human; identical to SEQ ID NO: 67379

SEQ ID NO: 67520 - DNA, 601 bp, Human; identical to SEQ ID NO: 67380

SEQ ID NO: 67521 - DNA, 601 bp, Human; identical to SEQ ID NO: 67381

SEQ ID NO: 67522 - DNA, 601 bp, Human; identical to SEQ ID NO: 67382

SEQ ID NO: 67523 - DNA, 601 bp, Human; identical to SEQ ID NO: 67383

SEQ ID NO: 67524 - DNA, 601 bp, Human; identical to SEQ ID NO: 67384

SEQ ID NO: 67525 - DNA, 601 bp, Human; identical to SEQ ID NO: 67385

SEQ ID NO: 67526 - DNA, 601 bp, Human; identical to SEQ ID NO: 67386

SEQ ID NO: 67527 - DNA, 601 bp, Human; identical to SEQ ID NO: 67387

SEQ ID NO: 67528 - DNA, 601 bp, Human; identical to SEQ ID NO: 67388

SEQ ID NO: 67529 - DNA, 601 bp, Human; identical to SEQ ID NO: 67389

SEQ ID NO: 67530 - DNA, 601 bp, Human; identical to SEQ ID NO: 67390

SEQ ID NO: 67531 - DNA, 601 bp, Human; identical to SEQ ID NO: 67391

SEQ ID NO: 67532 - DNA, 601 bp, Human; identical to SEQ ID NO: 67392

SEQ ID NO: 67533 - DNA, 601 bp, Human; identical to SEQ ID NO: 67393

SEQ ID NO: 67534 - DNA, 601 bp, Human; identical to SEQ ID NO: 67394

SEQ ID NO: 67535 - DNA, 601 bp, Human; identical to SEQ ID NO: 67395

SEQ ID NO: 67536 - DNA, 601 bp, Human; identical to SEQ ID NO: 67396

SEQ ID NO: 67537 - DNA, 601 bp, Human; identical to SEQ ID NO: 67397

SEQ ID NO: 67538 - DNA, 601 bp, Human; identical to SEQ ID NO: 67398

SEQ ID NO: 67539 - DNA, 601 bp, Human; identical to SEQ ID NO: 67399

SEQ ID NO: 67540 - DNA, 601 bp, Human; identical to SEQ ID NO: 67400

SEQ ID NO: 67541 - DNA, 601 bp, Human; identical to SEQ ID NO: 67401

SEQ ID NO: 67542 - DNA, 601 bp, Human; identical to SEQ ID NO: 67402

SEQ ID NO: 67543 - DNA, 601 bp, Human; identical to SEQ ID NO: 67403

SEQ ID NO: 67544 - DNA, 601 bp, Human; identical to SEQ ID NO: 67404

SEQ ID NO: 67545 - DNA, 601 bp, Human; identical to SEQ ID NO: 67405

SEQ ID NO: 67546 - DNA, 601 bp, Human; identical to SEQ ID NO: 67406

SEQ ID NO: 67547 - DNA, 601 bp, Human; identical to SEQ ID NO: 67407

SEQ ID NO: 67548 - DNA, 601 bp, Human; identical to SEQ ID NO: 67408

SEQ ID NO: 67549 - DNA, 601 bp, Human; identical to SEQ ID NO: 67409

SEQ ID NO: 67550 - DNA, 601 bp, Human; identical to SEQ ID NO: 67410

SEQ ID NO: 67551 - DNA, 601 bp, Human; identical to SEQ ID NO: 67411

SEQ ID NO: 67552 - DNA, 601 bp, Human; identical to SEQ ID NO: 67412

SEQ ID NO: 67553 - DNA, 601 bp, Human; identical to SEQ ID NO: 67413

SEQ ID NO: 67554 - DNA, 601 bp, Human; identical to SEQ ID NO: 67414

SEQ ID NO: 67555 - DNA, 601 bp, Human; identical to SEQ ID NO: 67415

SEQ ID NO: 67556 - DNA, 601 bp, Human; identical to SEQ ID NO: 67416

SEQ ID NO: 67557 - DNA, 601 bp, Human; identical to SEQ ID NO: 67417

SEQ ID NO: 67558 - DNA, 601 bp, Human; identical to SEQ ID NO: 67418

SEQ ID NO: 67559 - DNA, 601 bp, Human; identical to SEQ ID NO: 67419

SEQ ID NO: 67560 - DNA, 601 bp, Human; identical to SEQ ID NO: 67420

SEQ ID NO: 67561 - DNA, 601 bp, Human; identical to SEQ ID NO: 67421

SEQ ID NO: 67562 - DNA, 601 bp, Human; identical to SEQ ID NO: 67422

SEQ ID NO: 67563 - DNA, 601 bp, Human; identical to SEQ ID NO: 67423

SEQ ID NO: 67564 - DNA, 601 bp, Human; identical to SEQ ID NO: 67424

SEQ ID NO: 67565 - DNA, 601 bp, Human; identical to SEQ ID NO: 67425

SEQ ID NO: 67566 - DNA, 601 bp, Human; identical to SEQ ID NO: 67426

SEQ ID NO: 67567 - DNA, 601 bp, Human; identical to SEQ ID NO: 67427

SEQ ID NO: 67568 - DNA, 601 bp, Human; identical to SEQ ID NO: 67428

SEQ ID NO: 67569 - DNA, 601 bp, Human; identical to SEQ ID NO: 67429

SEQ ID NO: 67570 - DNA, 601 bp, Human; identical to SEQ ID NO: 67430

SEQ ID NO: 67571 - DNA, 601 bp, Human; identical to SEQ ID NO: 67431

SEQ ID NO: 67572 - DNA, 601 bp, Human; identical to SEQ ID NO: 67432

SEQ ID NO: 67573 - DNA, 601 bp, Human; identical to SEQ ID NO: 67433

SEQ ID NO: 67574 - DNA, 601 bp, Human; identical to SEQ ID NO: 67434

SEQ ID NO: 67575 - DNA, 601 bp, Human; identical to SEQ ID NO: 67435

SEQ ID NO: 67576 - DNA, 601 bp, Human; identical to SEQ ID NO: 67436

SEQ ID NO: 67577 - DNA, 601 bp, Human; identical to SEQ ID NO: 67437

SEQ ID NO: 67578 - DNA, 601 bp, Human
ggtagactcttcaagatttcctggaagactcctaggcggagaactagcaacatcttgatgccactgctgcagaagtggtaaggggaagtcttgggaggagataacttccagaaggaagacaaaggggcaggggttttggagctagattaatggctgaagatacgaagaaccagaacgcatatctttaagatgtatgagggcccttttccccaaaagaggcagactgcgaattaaacgcaatataaatgaggttatcacagtccaggtagtcgtttctgaagccctagtcctcagttcccamagaaaccacgtgcgcactaccacctaaaactgccaatgaaaatgaaggtcctgcgcagtaaaatatttatacaactgctggggccactaggcttcagcgggtgtggaggcggggagagaggaggagtaaaggctgtttacaaacttgacgtacacacgcagtcctatccctacggtcctggaattgggggttactatcttggaatctaggggcactccaggctctgggctcagacggctggcttctgcctacccgagccttaacctttcaaggaccagaaggattccagagctcttgccc

SEQ ID NO: 67579 - DNA, 601 bp, Human
aggttttttgtttttgtttttaaattagatttagggcattaccccctactcacagattcagaatttctagggatggatctagaatgtttttgttttttgttttaaaagctctccacatgattcatgagcccctggtttaagaaaagggcagctcaggtgtggtcagactaagagacagagtagctagttgccagagaagcagtgatttaataaatttattctctgcctgtgttcaatacacaactctggtgttctctgagcacaaatcagagagcatatcacaacatgtgaagcctatcasagacatgagtcctgggaaagagccagggagctcagctggtgacgatttgccacctttgattggtaaatggggaaaccaagacacagaaggaggaagtgattgggcccaaattccccttcaatggtacagaagcagctgcacagcattgagtctaacctgactttagtctcgtgcctttttataaaagaaccctgaggttctcttcaggagaacaggatcagtctctggtctatggttaagcacatggatcagaaagacccggttgaaatcccagcgctgccacttacgagctgtgagatc

SEQ ID NO: 67580 - DNA, 601 bp, Human
ttaggccttgtttggagataccagaaagaccctgagatgctatttaatttggagaagcaattttaaaaataaagaatagaaagaaagataaagttttagagacagggaagtccaagaatttttttttaagtattttcacgaacatcctaagacgcaggaccaaattgaggaattatttcataggataacctatcatcaggcagaaagtaaccaggcttctgaggcagtgaagtgttgctacaagactgcagatgaagaaacacagacagaagctttccagggtgcccagaatgacatatcsttgacaatggccaaacatgtcagcgcaaaacctcaaagaatctggccaggatggaaggagactagcagtgggcacataggatttgactggttgattggtacctcacagcataacgtacaggtaccttgctacagttccttaagtcacagaacatgagcaaacctgaagtttctaggaaacattcaacaaacacatatatgttttcgtggcttccatttataagacatttctgtaaccctacatggtgaaacaaacaaaaaacacccaaatgaacagaagatgccaaaaaaaaatacatgc

SEQ ID NO: 67581 - DNA, 601 bp, Human
ttctaaactgttctgagaagctgcatctgaattcaaagaaggggtgcagaagtagctggaagagagagaccagagtggcacagcccagcagcaacctttggaagagctgatcaaaactgctgggctcctggttcattacaagggatgaaggaacggcatgccatattggtcaggagcaagcaaacactaggaggaaaactaaaagtactggcattgtgatttggaaggtggtaattaaaggccccaaccttaataacgactggaaccaaaatagacttttattttattttttttaactaasgcatcttcattgtcttcgagcctgacatttttaagattcactcttctttgtgtttttaacaggatttgacaatgacatttcctccagcccaggaaatcaaatgtccattaacttgcataattaatattttaaaatgaaccttgaagatttttttgaatcacagtactaattaagactttctctttctgccccctctctcttttccacacagactcctgcacagagaaaatgggtcacggaataagacagagaaacatgggtcatcattgtggactagctgtgagatcttgggcaaactac

SEQ ID NO: 67582 - DNA, 601 bp, Human
gaaagtcaagtccacagcaatgccaacagcaagtgacagataatgactactgccttaaacccaactttagcagtgactctcaaatttagctaaacatctgaatcacttggagcactattaaaaccactgattcttgcttcatcacatttgcctgggagaggggttagttttgttttgttttgttttaaagaatctgcatttgtatgaggctcccagagtacttctaaaggtcacttttggttaccaaccactgctcttgattgggggttgggagggaagatgaaccactgaatctgagtgrattgctattgctaggcagccccttttctctctggcaagagggactactcccacctcaacctactttcactccctgtgcaaaggctacctggttccagaggtgtccttgacctgttggtccattcctctgatacctgctggtgaatcgtgccatattctaaactgttctgagaagctgcatctgaattcaaagaaggggtgcagaagtagctggaagagagagaccagagtggcacagcccagcagcaacctttggaagagctgatcaaaactgctgggctcctggttcattacaagggat

SEQ ID NO: 67583 - DNA, 601 bp, Human
ccataaagttttcattgcagtagactccttctatgcttccctttttaacataagttatctcagaatccttttttgaaaattaggcatacctcaagattcagaaatgaccaagacatattccatctgcgtgtgaaagtgtcacagtcattgtgtcttgccctgctcctactcccatgatctggtaactaaagggttacactgagctcagcaggagacctctctcccaaggctagggaaggttcggatgggttggtgttgaatatataggatatcactcctgggaggaagcatcttaacatcytgcaacttcagtttccttatctgcacagaattagattgttggcctagacaagactgctaaggactcctccagttccagtatcctatcatcctatgagaagaggagacatggaaagcactgatgtagaaagtcaagtccacagcaatgccaacagcaagtgacagataatgactactgccttaaacccaactttagcagtgactctcaaatttagctaaacatctgaatcacttggagcactattaaaaccactgattcttgcttcatcacatttgcctgggagaggggttagttttgttt

SEQ ID NO: 67584 - DNA, 601 bp, Human
ccccataatgtattgatctatcttcctcccaaaggtcacttaggctgtttccagtcttttgctataataaacaacactgtactggatctcgttcataaacacctttacacaattgtctgattatttccttaggcacagcattgatgggtcacagagtagacagttcttaaatgccttaagaaacaaaaattacctggccttgctgagatgggaaggtgagggagaagtttgagttagagaaaaacacttgccttccaggcccaggcaaacaaaacagccttcttccctgcctttctctcasccacctaccaggaagcactgataagaaccactaaatcctcttgtgcaaaattcagggtcaaatagagagtgtccgtgaaacagaacttgggatctcatctggaaacaagcaatgggaaggatccgcaggaagtggcttataaaagcaagccactctccaaagggctcccataggccttttgcttgtgcccctggtgtgtggggctagcaggcagtgagcacagtgaattttactgaggacccagtatgtaaaggacactgcagtcacaagggcatgccatagggagagaagacaccccac

SEQ ID NO: 67585 - DNA, 601 bp, Human
aaggcaatttagctgggttgaatgagagattcaactttaaccagccacagatgtcccaaagaagtagacacaaggcaggatttttatctgtctggttattgagactgcctcattccaagaaaataaaggaccgataatctccacttctaaggtcctaagatcctaagagaccaaaatgtggcttggctattggtctccagtgacaagttcaataggtctagcaaaataaatccatgccactatccctgtttcattttatctgtattttctgattatgaaactatcaaagaaacatgcaaakgagtcacaaaatagaagaatataaaagttcaaaagtaaagactgcctatgttcctagtaaccataaataatcactgttaatattttcatgcctttacttcagatattctgtttacacacatgtacccaaatagagtttatcattaaaaaaaaaataatatcctaccaaacatattagtttatcacctgcttgttcactgaatatatattctgtgtttggtaacataaattcaggccatcatttttaacagctgcataggaatccattatatgcctgccccataatgtattgatctatctt

SEQ ID NO: 67586 - DNA, 601 bp, Human
aaagttgtaaagtgcctggaacagaggctaccacataatacacactcagcaaatgtcaactcttattagtatcatctagggaatggaaattagatggtagtcaaagaagatgctccaaaaatgaagttaaaaaggggtttgtaggccaggcatgatggctcagtcctgtaatcccagggagattctgtctctacagtttttgttgtttaattagccatgtgtggtggcatatgtctttagttttggctacttgggaggctgaggtgtaaggatcccatgagccctggaattgaaggctatrgtaagctatgatcgcgccactgcacttcagcctgggcaacagagtgagattctgtctcaaaaaaccaaataaaccaaaaaaggagtttctatatagcagtttccatttgtgttttctatgcaatttggcccatagtatagcacattggaaatagattgggttaaggctcagactctcttcttcctggctgtgtgacattttggacaagtttctcaacctctttgagctaattttctcaactgtaaaataggggtaataatacctaccctacaatgctgaccaatgtattacatatgataa

SEQ ID NO: 67587 - DNA, 601 bp, Human
tggtatcttgagtttgttttaatatactcagcataaagaaaaataagcaaatgtagaaaaatcttagtcattattaagattcatggtgtttacagtggttcattttattattgtctctagctttatgtatgcttgaagatgttcataataaaatggtttttaaaaacaaaatgataatttttaaaaaaatttaatgaataagtgggaacaaatgaaagaaggtacaattcctgtattagaagtttcttttttactacctcttaatgactttattggagtactgcactattaacactaaagtttttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaagagaaaaaaatgtataaacaccgatgaagaacaaaaaggggaaaatgaaaggaaatcaggctcaaaccataaatcccaaatggcaataactaactttaaaaattcataatcagtcttgag

SEQ ID NO: 67588 - DNA, 601 bp, Human
atggtatcttgagtttgttttaatatactcagcataaagaaaaataagcaaatgtagaaaaatcttagtcattattaagattcatggtgtttacagtggttcattttattattgtctctagctttatgtatgcttgaagatgttcataataaaatggtttttaaaaacaaaatgataatttttaaaaaaatttaatgaataagtgggaacaaatgaaagaaggtacaattcctgtattagaagtttcttttttactacctcttaatgactttattggagtactgcactattaacactaaartttttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaagagaaaaaaatgtataaacaccgatgaagaacaaaaaggggaaaatgaaaggaaatcaggctcaaaccataaatcccaaatggcaataactaactttaaaaattcataatcagtcttga

SEQ ID NO: 67589 - DNA, 601 bp, Human
atatttagagatggtatcttgagtttgttttaatatactcagcataaagaaaaataagcaaatgtagaaaaatcttagtcattattaagattcatggtgtttacagtggttcattttattattgtctctagctttatgtatgcttgaagatgttcataataaaatggtttttaaaaacaaaatgataatttttaaaaaaatttaatgaataagtgggaacaaatgaaagaaggtacaattcctgtattagaagtttcttttttactacctcttaatgactttattggagtactgcactatyaacactaaagtttttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaagagaaaaaaatgtataaacaccgatgaagaacaaaaaggggaaaatgaaaggaaatcaggctcaaaccataaatcccaaatggcaataactaactttaaaaattcataa

SEQ ID NO: 67590 - DNA, 601 bp, Human
aataatattatagttacttaggaaaagatccccacttttcaaagatttatcatgaaatatttagagatggtatcttgagtttgttttaatatactcagcataaagaaaaataagcaaatgtagaaaaatcttagtcattattaagattcatggtgtttacagtggttcattttattattgtctctagctttatgtatgcttgaagatgttcataataaaatggtttttaaaaacaaaatgataatttttaaaaaaatttaatgaataagtgggaacaaatgaaagaaggtacaattcctgyattagaagtttcttttttactacctcttaatgactttattggagtactgcactattaacactaaagtttttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaagagaaaaaaatgtataaacaccgatgaagaacaaaaaggggaaaatgaaagga

SEQ ID NO: 67591 - DNA, 601 bp, Human
gcatgggtcacacacaccctatgcatgacggcactgtaaattgaggatcttcctattgataggaacatcacaatgacagccatcaaggcacttcagacaaggagtcaaaaaacctcccaaagatactgcctttcccttcaattaaatcactctgagaagtggcttaatggcccaggggctttgctctgggtacctgctctggccttgcagactggccttgcttttctaatccttgcaactgcagcctgacctgatgatgataaagatgaagcaaagactaggagcaatggaagggaaaaargggctatatgcagcaaatctcaaactagaacgaaaatagcaattttaacaacagcgatgacgacaacaaagtgaaaagttgcgtaagagacaacgatgagttgcaatgtgtggactttgtttagatcacaatctaactgatgattgtaaaaaggcattttggggacaatgagaaaaattttaatataggtactgtgtaggcaatatgaaggaattgttaattttgctgaaacattatttataatattacttaatattacgtatcaaatattaataatattatagttacttaggaaaagat

SEQ ID NO: 67592 - DNA, 601 bp, Human
aaattacctaacaagaatgcatgggtcacacacaccctatgcatgacggcactgtaaattgaggatcttcctattgataggaacatcacaatgacagccatcaaggcacttcagacaaggagtcaaaaaacctcccaaagatactgcctttcccttcaattaaatcactctgagaagtggcttaatggcccaggggctttgctctgggtacctgctctggccttgcagactggccttgcttttctaatccttgcaactgcagcctgacctgatgatgataaagatgaagcaaagactaggrgcaatggaagggaaaaaggggctatatgcagcaaatctcaaactagaacgaaaatagcaattttaacaacagcgatgacgacaacaaagtgaaaagttgcgtaagagacaacgatgagttgcaatgtgtggactttgtttagatcacaatctaactgatgattgtaaaaaggcattttggggacaatgagaaaaattttaatataggtactgtgtaggcaatatgaaggaattgttaattttgctgaaacattatttataatattacttaatattacgtatcaaatattaataatattat

SEQ ID NO: 67593 - DNA, 601 bp, Human
ttttgggaggtcacagcagatgaaccatttgaggccaggagtttgagacaagcctggctaacatggcaaaaccctgtctctactaaaaatatgcaaattagctgggtgtggtggtgcacacctgtaatctcagctacttgggaggctgaggcacaagaatagcttgaacctggaaggtggaggttgcagtgggtcaagatcgcgccactgcactccagcctgggcaacagagcaagactctcaaaacaacaacaacaacaaaggttttggggaatacgcatatttcatatgtcaatgagtyctaatctcaggtacaaacctaacttgccaccttacaatcctaattgcaaactggcccttctgggcttcaaaacacaggtgagggagatcctttaaggatagaaaaggtagtttaatatttcagtccatgatggaatgcagatatgacagtggtctcctaagatcgtaatactaaatttttaactgtaccttttctatgtttagatacacagatacttaacatcacgttataattgcctacagtattcagtacagtcacatactgtacaggtctgtagcctaggaacaataggctatgtac

SEQ ID NO: 67594 - DNA, 601 bp, Human
gaatgggtttctgaagcaaagtgtcaggaatccctaaaatatgattagcaagaaacagggaaaggtcctgagatggcacagaaggtgtaaagcaggcagctcttctggctgtctttggatccagaagcttaattaaaaagttttaggggccaagtgtggtggctcatgcctgtaatcccagcattttgggaggtcacagcagatgaaccatttgaggccaggagtttgagacaagcctggctaacatggcaaaaccctgtctctactaaaaatatgcaaattagctgggtgtggtggtgcwcacctgtaatctcagctacttgggaggctgaggcacaagaatagcttgaacctggaaggtggaggttgcagtgggtcaagatcgcgccactgcactccagcctgggcaacagagcaagactctcaaaacaacaacaacaacaaaggttttggggaatacgcatatttcatatgtcaatgagttctaatctcaggtacaaacctaacttgccaccttacaatcctaattgcaaactggcccttctgggcttcaaaacacaggtgagggagatcctttaaggatagaaaaggtagtttaata

SEQ ID NO: 67595 - DNA, 601 bp, Human
gctgaaagacttgaacagacgcttcaccaaaaaagatacatggatagcaaatatgcacatgaagaaatactcaatatcattagactttaggtaaatgcaaatgaaaactacaatgaaattccactaaacacctattagaatagctaaacttcaaaaaacaaaagcagaacaacaaaatgttgacaataccaagtgctggaaaggatgcagaggaactggaactttcataccctgcaggtggagctacaaaatggcataaccactttgaaaaatatattggcagtttctaatagagtgaaayatacattaaccacacaagccagtaatcttatgcctaggtatttatccaaatgaagtggaaacttatgttcacacaaaaatctgtatgcaaatgtttatagtggctttatttgtaatggtcaaaaactgtcgctcaagtgggtaatggttaaagaaatggtgatatatccattcagtggaatacagctcaccaataaaaaaggatgaaattactgatacaggcaacaatgtggatgaacctcaaacacactgtgcttagtgattatttatatattctgcaaaaggcaaaactatagagaca

SEQ ID NO: 67596 - DNA, 601 bp, Human
cggacctgctaaaacagataatagtttctgaaaaaccacttctattttctctaatctgacttgttacaatgaaataacatgaaatgtaagaattaggaaactggcttgaaagaaaaaaaagtatacaatcaaagataccgctggaaaagcatttaaattgtccacaaagcacagaatggaagctttcaggatttatggagttatatcttctatccctcttcagcagcagggcatgtggtcataaggactgaatctcatactattaataccaaactcttctacctctgtctctgtctcagtctcattgtccctctggctctctctttctctcctgtctgcatgcacatacacacatgcaacatacatgcaaaacaacacagttgcattcttacctatgcagaggctcccctggacctgttttcacccctgagctaagacaacacattcccatcaaaaagtacactggttggacatggagagttgtgtttctggatacagatgagcaataaaaataacaactgccttttctcttggcctagaccatggctttgaataataaatcctaaatacacctctcctattccattttttgggcaagctc

SEQ ID NO: 67597 - DNA, 601 bp, Human
ttcggacctgctaaaacagataatagtttctgaaaaaccacttctattttctctaatctgacttgttacaatgaaataacatgaaatgtaagaattaggaaactggcttgaaagaaaaaaaagtatacaatcaaagataccgctggaaaagcatttaaattgtccacaaagcacagaatggaagctttcaggatttatggagttatatcttctatccctcttcagcagcagggcatgtggtcataaggactgaatctcatactattaataccaaactcttctacctctgtctctgtctcagtctcattgtccctctggctctctctttctctcctgtctgcatgcacatacacacatgcaacatacatgcaaaacaacacagttgcattcttacctatgcagaggctcccctggacctgttttcacccctgagctaagacaacacattcccatcaaaaagtacactggttggacatggagagttgtgtttctggatacagatgagcaataaaaataacaactgccttttctcttggcctagaccatggctttgaataataaatcctaaatacacctctcctattccattttttgggcaagc

SEQ ID NO: 67598 - DNA, 601 bp, Human
attatattaaggggagtacagtctacacatctccattactcactgggaaaattttatttcggacctgctaaaacagataatagtttctgaaaaaccacttctattttctctaatctgacttgttacaatgaaataacatgaaatgtaagaattaggaaactggcttgaaagaaaaaaaagtatacaatcaaagataccgctggaaaagcatttaaattgtccacaaagcacagaatggaagctttcaggatttatggagttatatcttctatccctcttcagcagcagggcatgtggtcayaaggactgaatctcatactattaataccaaactcttctacctctgtctctgtctcagtctcattgtccctctggctctctctttctctcctgtctgcatgcacatacacacatgcaacatacatgcaaaacaacacagttgcattcttacctatgcagaggctcccctggacctgttttcacccctgagctaagacaacacattcccatcaaaaagtacactggttggacatggagagttgtgtttctggatacagatgagcaataaaaataacaactgccttttctcttggcctagacc

SEQ ID NO: 67599 - DNA, 601 bp, Human
acaacacaaaaggagtggacttttgctgatgttaaattatattaaggggagtacagtctacacatctccattactcactgggaaaattttatttcggacctgctaaaacagataatagtttctgaaaaaccacttctattttctctaatctgacttgttacaatgaaataacatgaaatgtaagaattaggaaactggcttgaaagaaaaaaaagtatacaatcaaagataccgctggaaaagcatttaaattgtccacaaagcacagaatggaagctttcaggatttatggagttatatmttctatccctcttcagcagcagggcatgtggtcataaggactgaatctcatactattaataccaaactcttctacctctgtctctgtctcagtctcattgtccctctggctctctctttctctcctgtctgcatgcacatacacacatgcaacatacatgcaaaacaacacagttgcattcttacctatgcagaggctcccctggacctgttttcacccctgagctaagacaacacattcccatcaaaaagtacactggttggacatggagagttgtgtttctggatacagatgagcaat

SEQ ID NO: 67600 - DNA, 601 bp, Human
cttttgttacagcctggaaagaacacaggactgggaagtaagaggcctgtgttcaattttgccattcattctagctccaagattaggagtcccttcgaagttctgggccttgatcctcttatccataaagagaaggcctggaatagaagttctctctaaagtttcctccagtattaaaaatttatgaattcttatattttataagataaaagtgaataatgattaaaaatgaagtcctaagtttccaaaggggcaaaacccaacagagattccccctgagccactgtcactgtcagaaagkgtatggatgaaacagtcagcagggtggcagggtagaataagacagaataactccaaaagagagagaacaacacaaaaggagtggacttttgctgatgttaaattatattaaggggagtacagtctacacatctccattactcactgggaaaattttatttcggacctgctaaaacagataatagtttctgaaaaaccacttctattttctctaatctgacttgttacaatgaaataacatgaaatgtaagaattaggaaactggcttgaaagaaaaaaaagtatacaatcaaagataccg

SEQ ID NO: 67601 - DNA, 601 bp, Human
tgagctcaggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagtagggaaggtgaaatgacttagtctacataaagtgttggaacagggcctggtgggtaggaagtcctctggaggcacgggctgtgctgactctcattacttagaatgagcagcaggttaaggctgctggaacgaagtggctcccaggcctgcsgctgggatctgcctgctatctgacatttcactgcagctcgtgggtggccctgaagctgaatgtggtgcctgtggtgggtctaggtatcattctcatatcagagattaaagcgcagttgggctggagctctttaaaaaggcatctaagcaactcgtagggagtgtatctcccacattcttttgatacacaggtctcctagtttacaggcactgaggactggtttataaggcctgcagctgaaacccttttgcatcacaatgtccatgttccatgaccacggaagtgagtgaccacaggggc

SEQ ID NO: 67602 - DNA, 601 bp, Human
gtgacactagccacatctcaagggcctcctggtgaccgtataggatggtgcattctaggcaggaagtgtttgcagagtgtataccagagacagcgtattgcgggagataagagtgtgagctcaggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagtagggaaggtgaaatgacttagtctacataaagtgtyggaacagggcctggtgggtaggaagtcctctggaggcacgggctgtgctgactctcattacttagaatgagcagcaggttaaggctgctggaacgaagtggctcccaggcctgccgctgggatctgcctgctatctgacatttcactgcagctcgtgggtggccctgaagctgaatgtggtgcctgtggtgggtctaggtatcattctcatatcagagattaaagcgcagttgggctggagctctttaaaaaggcatctaagcaactcgtagggagtgtatctcccacattcttttgata

SEQ ID NO: 67603 - DNA, 601 bp, Human
tgtgccacggcttggcatctcccaagcttgcactctccagtagaaataaaatgcaagccacacgtgaaagttaagaatttctagtagccacgtttttttaacgtcaaaaggaacagatgaaattaattttaataatagagtctattgaaccccattatgcaaaatattatttcaacatgtgacactagccacatctcaagggcctcctggtgaccgtataggatggtgcattctaggcaggaagtgtttgcagagtgtataccagagacagcgtattgcgggagataagagtgtgagctcrggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagtagggaaggtgaaatgacttagtctacataaagtgttggaacagggcctggtgggtaggaagtcctctggaggcacgggctgtgctgactctcattacttagaatgagcagcaggttaaggctgctggaacgaagtggctcccaggcctgccgctggga

SEQ ID NO: 67604 - DNA, 601 bp, Human
catggctgcctctcaggctgctttgtgccacggcttggcatctcccaagcttgcactctccagtagaaataaaatgcaagccacacgtgaaagttaagaatttctagtagccacgtttttttaacgtcaaaaggaacagatgaaattaattttaataatagagtctattgaaccccattatgcaaaatattatttcaacatgtgacactagccacatctcaagggcctcctggtgaccgtataggatggtgcattctaggcaggaagtgtttgcagagtgtataccagagacagcgtattrcgggagataagagtgtgagctcaggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagtagggaaggtgaaatgacttagtctacataaagtgttggaacagggcctggtgggtaggaagtcctctggaggcacgggctgtgctgactctcattacttagaatgagcagcaggttaaggctgctggaacgaagt

SEQ ID NO: 67605 - DNA, 601 bp, Human
tatcctgcaaagtaccctttaggaaatgttggtttcgattcactccatctcttagcagtagcgggagagtgacctttctgcctgtcagggtgccaactgcccacagacaccctgtcctggctgcagtgcacttgccatggctgcctctcaggctgctttgtgccacggcttggcatctcccaagcttgcactctccagtagaaataaaatgcaagccacacgtgaaagttaagaatttctagtagccacgtttttttaacgtcaaaaggaacagatgaaattaattttaataatagagtcyattgaaccccattatgcaaaatattatttcaacatgtgacactagccacatctcaagggcctcctggtgaccgtataggatggtgcattctaggcaggaagtgtttgcagagtgtataccagagacagcgtattgcgggagataagagtgtgagctcaggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagt

SEQ ID NO: 67606 - DNA, 601 bp, Human
agagaagggcgtgcgagtggaaggcaacaactgagaagcttcttggcttttaaggggcggtggtgggcagtggaaggtgtctgagggtcccctcaataccttctaagggggtgggtgcctccagctacctggggagttaaatttgctgacttgggcatgagagctgggtacactacccccaaaagcccttctgtgtccttttcattctccattctgtagctccttcaactaagtgtgataacaacaatgactataggctataatcatactggccaacgtttgttgagttgcttttctctgygtcaggcactctcctaagcacttcatatggattaacttgattattcctcaaagcaacccgatatggtaggaactattaccttcatttcagaaatgaggaaactgagggacacttgaaataacttgagaaaatatttaaagtatctatttgaagtagtataagacgctgaacatcccagggcctgtgttttactaagagactatttagttttgctattaatatcctgcaaagtaccctttaggaaatgttggtttcgattcactccatctcttagcagtagcgggagagtgacctttctgc

SEQ ID NO: 67607 - DNA, 601 bp, Human
tgtgctgagtcgcatgattgccaaacttacgggatctttgccaagttaagaggcaagtgatggggacagcaccatcactagaactataacaagacgcaggtgggatgtgtggatgggcttccctctcagggagagaagggcgtgcgagtggaaggcaacaactgagaagcttcttggcttttaaggggcggtggtgggcagtggaaggtgtctgagggtcccctcaataccttctaagggggtgggtgcctccagctacctggggagttaaatttgctgacttgggcatgagagctgggtrcactacccccaaaagcccttctgtgtccttttcattctccattctgtagctccttcaactaagtgtgataacaacaatgactataggctataatcatactggccaacgtttgttgagttgcttttctctgtgtcaggcactctcctaagcacttcatatggattaacttgattattcctcaaagcaacccgatatggtaggaactattaccttcatttcagaaatgaggaaactgagggacacttgaaataacttgagaaaatatttaaagtatctatttgaagtagtataagacgctga

SEQ ID NO: 67608 - DNA, 601 bp, Human
ttaaaaaaattcactcgtggaacatcgattttgtgccaagtactgggctagataagttgaaataaacaacagcaatgacaaaacaagaataaaacgtgggtccaatcttttaaaaaaaggattacaaaaatttaagatagtatccttattttaaaaaacctcacagcaaaaaactttaacatctgctgatttattggtaaaaatgttttaaatgagcttcacttcacgttgcaatacaataaaatgcacagtatgttactaaataactgggattatttcagcaaataccagccaggcctcrttattcagtggttactcactgaagtgtttcctaccaaatggggttgggccgaggagatctgaatgttaacattaacagttggaaagttaattattgctctctattttgtaaggtttatcaaaatttaactgagtttcctcaaggcgctgggctaccttgtgacttcacagagcacaggaccaaagggaggattcaggagcaaggcgagacccctttctgctccacccaagcttgacagagagaaggaagtctgcacaggaatcatctgtggtgttccacttggattctggagccaggcca

SEQ ID NO: 67609 - DNA, 601 bp, Human
agaatttcttataaattataagttacatttttaaaaaaattcactcgtggaacatcgattttgtgccaagtactgggctagataagttgaaataaacaacagcaatgacaaaacaagaataaaacgtgggtccaatcttttaaaaaaaggattacaaaaatttaagatagtatccttattttaaaaaacctcacagcaaaaaactttaacatctgctgatttattggtaaaaatgttttaaatgagcttcacttcacgttgcaatacaataaaatgcacagtatgttactaaataactggrattatttcagcaaataccagccaggcctcattattcagtggttactcactgaagtgtttcctaccaaatggggttgggccgaggagatctgaatgttaacattaacagttggaaagttaattattgctctctattttgtaaggtttatcaaaatttaactgagtttcctcaaggcgctgggctaccttgtgacttcacagagcacaggaccaaagggaggattcaggagcaaggcgagacccctttctgctccacccaagcttgacagagagaaggaagtctgcacaggaatcatctgtg

SEQ ID NO: 67610 - DNA, 601 bp, Human
ttatttgttactgttaaatattctactgtatggatataccacataatgtttatccattcatcattggtggacatttgggtggacattcaacccaactgaataagaacattgctgctatgaacattcatgtgcaaggttttgggtgaatatatttttgttcttcttgtgtatatacatagccgcagagttgctaggtcatacagtaactctatgtataacattttgaagaactgccaaattgttttccaaagtggttacaccattttcttgcttcttcttgaagttcaaataagacacttcraaacaggacatcattttttcatgtttctttttctttgagggttcctcaaaaattaatcatgtttacttaattaaatagcttatgaagaacctggcccagctcaaatcctaaaatagcatattgatgcctccaagtagtaaacgcatgtttgcattagaagaaaagtgtaatacttagcaatctgaatcctcatatatgcatctaaataaatttagacgtgtttaaaaaagctctaactggcaactgtatgtttcctatcgccacatcataggtattacagttctaacattttattacaag

SEQ ID NO: 67611 - DNA, 601 bp, Human
atgttttcaaggttcgtctatgttgtagcatgcatcagtattccattatttgttactgttaaatattctactgtatggatataccacataatgtttatccattcatcattggtggacatttgggtggacattcaacccaactgaataagaacattgctgctatgaacattcatgtgcaaggttttgggtgaatatatttttgttcttcttgtgtatatacatagccgcagagttgctaggtcatacagtaactctatgtataacattttgaagaactgccaaattgttttccaaagtggtyacaccattttcttgcttcttcttgaagttcaaataagacacttcaaaacaggacatcattttttcatgtttctttttctttgagggttcctcaaaaattaatcatgtttacttaattaaatagcttatgaagaacctggcccagctcaaatcctaaaatagcatattgatgcctccaagtagtaaacgcatgtttgcattagaagaaaagtgtaatacttagcaatctgaatcctcatatatgcatctaaataaatttagacgtgtttaaaaaagctctaactggcaactgtatgtttcc

SEQ ID NO: 67612 - DNA, 601 bp, Human
tatgaatttgcctattctgacatgtcatgtaagtagtcatacaatatgtggccttctgtgactggcttctttcacttagtacaatgttttcaaggttcgtctatgttgtagcatgcatcagtattccattatttgttactgttaaatattctactgtatggatataccacataatgtttatccattcatcattggtggacatttgggtggacattcaacccaactgaataagaacattgctgctatgaacattcatgtgcaaggttttgggtgaatatatttttgttcttcttgtgtatayacatagccgcagagttgctaggtcatacagtaactctatgtataacattttgaagaactgccaaattgttttccaaagtggttacaccattttcttgcttcttcttgaagttcaaataagacacttcaaaacaggacatcattttttcatgtttctttttctttgagggttcctcaaaaattaatcatgtttacttaattaaatagcttatgaagaacctggcccagctcaaatcctaaaatagcatattgatgcctccaagtagtaaacgcatgtttgcattagaagaaaagtgtaata

SEQ ID NO: 67613 - DNA, 601 bp, Human
gtatgaagttcagtggttttcaggatattcatagagttccacaatcatggccaccatctaactttagaatattttcataatcccaaggagaaatccgatacctcttagcagccattccattctcccctttcctcagcccctggcaatcactaacctatattgttctatttatgaatttgcctattctgacatgtcatgtaagtagtcatacaatatgtggccttctgtgactggcttctttcacttagtacaatgttttcaaggttcgtctatgttgtagcatgcatcagtattccattayttgttactgttaaatattctactgtatggatataccacataatgtttatccattcatcattggtggacatttgggtggacattcaacccaactgaataagaacattgctgctatgaacattcatgtgcaaggttttgggtgaatatatttttgttcttcttgtgtatatacatagccgcagagttgctaggtcatacagtaactctatgtataacattttgaagaactgccaaattgttttccaaagtggttacaccattttcttgcttcttcttgaagttcaaataagacacttcaaaa

SEQ ID NO: 67614 - DNA, 601 bp, Human
ctctgttgcttctgaatagagttgtaataacagaatagttttcaccaacggagtacacactgttaggataaacagaaagtgatccacatttctcttttgtgagcttttagtataatgctaaaggaggaatagaggctagtgtttcaggaatttgcaaagtcactttgcttacagtttaatcagaacgggctacctaataaaatttcactgtcctggaaagcactgaaaaaatggtctgtgtattcttgctcttctttttttcctcctacgtagttttacatttatgattaatttttaatawtagtttggtaagattatttatataccatacaattttcaaagtatgaagttcagtggttttcaggatattcatagagttccacaatcatggccaccatctaactttagaatattttcataatcccaaggagaaatccgatacctcttagcagccattccattctcccctttcctcagcccctggcaatcactaacctatattgttctatttatgaatttgcctattctgacatgtcatgtaagtagtcatacaatatgtggccttctgtgactggcttctttcacttagtacaatgttttc

SEQ ID NO: 67615 - DNA, 601 bp, Human
taaggggaaaaacaaatgtactatcagaatcatcagaggggaaaaacaaatgtactatcagaatcaccagagaggacttgggcacaagaaaacctgcagatgaatcaaggccataaatggaaacaaagtatacttataaataaaatcaaagaaatgaaggcattaatcagaaaaaggctacaatttctaccagcaaacaactcatgtaattgtaatatttctggaggatatttcacccacaagtaatctgtgtatcgaagaaataattcagcatactttaggtggcatgaaaatgtaaaasccaaattatttcttcaggatcaaaagcaatatcttctaaaacagaatggtcctcagtcttttatcaatttgacctttttctcctaatgagttagaatgatatttattcacctaactggtccaactaatttctatcacattaaccattttagcaagcaactttgaatttctcattaaaaatagcattaaaaatagacactatatcttatatacccactcaactctgttgcttctgaatagagttgtaataacagaatagttttcaccaacggagtacacactgttaggataaacagaaagt

SEQ ID NO: 67616 - DNA, 601 bp, Human
ttttttttttttttttgaccactaaggggaaaaacaaatgtactatcagaatcatcagaggggaaaaacaaatgtactatcagaatcaccagagaggacttgggcacaagaaaacctgcagatgaatcaaggccataaatggaaacaaagtatacttataaataaaatcaaagaaatgaaggcattaatcagaaaaaggctacaatttctaccagcaaacaactcatgtaattgtaatatttctggaggatatttcacccacaagtaatctgtgtatcgaagaaataattcagcatacttyaggtggcatgaaaatgtaaaacccaaattatttcttcaggatcaaaagcaatatcttctaaaacagaatggtcctcagtcttttatcaatttgacctttttctcctaatgagttagaatgatatttattcacctaactggtccaactaatttctatcacattaaccattttagcaagcaactttgaatttctcattaaaaatagcattaaaaatagacactatatcttatatacccactcaactctgttgcttctgaatagagttgtaataacagaatagttttcaccaacggagtacac

SEQ ID NO: 67617 - DNA, 601 bp, Human
tgaattcggctcttttatgtatgttatcttacttactcctttcaaagtgagaaaattacctgtatttttccaatgaggaaaataagtctcaaagaaattagcaacttattcaaagtcacattgcaggaagtggaggtacaaggaatcagtcgtagatttgctcaattcccgaaattgtgctctttcgattaggtgagctttctcaacagctacggtttgaaatgagctcatgatttggtgaacagcttccaaagtaaatatgaattgagaaaaagacagtgcctggtggatattttcacgragatttttgctttttacaacaggtgtatggaagctatgttgaaaattaaatttttttaatacattaagaaagtatatcacttatactgtgaaaaataaatagtccttgcttaatgtcttctgtaaatattacaatttgatttattatagtaagtaaagtgttagacattttagaagatttaaagtctctattagttttctatttctcatttgttgatttctgctctaatctcgatttcttttcttctgcttgctttagttttaacttgctcttttctttccgttgccttaaagtagaagg

SEQ ID NO: 67618 - DNA, 601 bp, Human
aacagaaactttctggctgatggcaatcagattggtactatgtgtggttttagacatccactggggatcttggaacatataccccaagggtaagggaggactactatagtaaaatctgaacaaactgtcaaacaagttttatgcagtccagttatagataatatcgctagccaaaaacctggtacataagatgtaacattagattcttcttctagtttttctttcaagaacactcatatatgtataccaatgccaataagtattgcatgtctaccaactggcatttgtatacatatatgarctttcaatatatgcataccaggaccaaatcaattgttaaatcatcaaatgaatgtagactagatattaaacaagcacctactatgtaccaggcattgaattcggctcttttatgtatgttatcttacttactcctttcaaagtgagaaaattacctgtatttttccaatgaggaaaataagtctcaaagaaattagcaacttattcaaagtcacattgcaggaagtggaggtacaaggaatcagtcgtagatttgctcaattcccgaaattgtgctctttcgattaggtgagctttctca

SEQ ID NO: 67619 - DNA, 601 bp, Human
aaaattcccaacttaataagcaaagaaaaaaaaacgttgcatgctgaggttgttaaggtctatgataagaacaaatcttccctctgtgaaattgtgaagaatgaaaagaagctggtgctagttttgctttcgcacctcaaactgcaaaagttacggatacagtgcgcaatcagtttatttaagatggaaaggcattaaatttgtggttggaagacaggaacagaaactttctggctgatggcaatcagattggtactatgtgtggttttagacatccactggggatcttggaacatatacmccaagggtaagggaggactactatagtaaaatctgaacaaactgtcaaacaagttttatgcagtccagttatagataatatcgctagccaaaaacctggtacataagatgtaacattagattcttcttctagtttttctttcaagaacactcatatatgtataccaatgccaataagtattgcatgtctaccaactggcatttgtatacatatatgagctttcaatatatgcataccaggaccaaatcaattgttaaatcatcaaatgaatgtagactagatattaaacaagcacctact

SEQ ID NO: 67620 - DNA, 601 bp, Human
gttgtaccgatcccaattagatatgccatttcggatacagatagaagaaaaaagaaaaaaactttattacctgttcattatgaatcacaattaagttcacaataacaatattaattaaatttccaatacttgggtctttatagatagaggctacctgcaaccgagataaatttttcaaagttaattgtgaactccgtgtaagcaataagcaagtcacgtcttacgttgggctccacctcttttttacgtttcttgcaacatatgcattttgtggttgtgaatttttcattcactcaacaayactttttgtaaagtctcttcataaaattcatagatcacagttttagataacagtgaattcaaacaaatttaaattcctctgaaattgcattgccacgtgacttaacagttctctgtaccagaacactggatattaattttccatcaagctctttcctctcatctgaagtcctggattgccaacttatagaatctcacattgggtgcatgttagccgacactgctattctttaatgtttgccacccattgtgtccttgacaacctcgttaacctggtggggtttttatttttgcagtatta

SEQ ID NO: 67621 - DNA, 601 bp, Human
catggcaacgccaggtccatctgaacagcagctgcccttgcctgttatataaggcatgtattttcaggtctgcctaacacatttattcctcacttggtatctataggttcgtggttctcaaccaaggtgattctgccctccccacggggggcagtggcaatgtctggagacattgctggttgtcacacctgaggggagggagtactactaatacgtagtgagcagaggccagggatgctgttaaacatcttgcaatgcacagaaggaattgtccagcccaaaatgtcaacagtgcctaagstgagaaaccctccactagcagctgactattaggaatgcatgaccacatcccatcaacttgacctgagactgaaagatctgaggaataagaaatccatataccttgttaagagaacagcagtatcatgatggattccacctggactgttcttcgaatgctgccactggcaaaagttttttaatgttgtctgagcattaaaagatatggaaggcccatcctaaatacagagaagaattatggttaatctgttgtaccgatcccaattagatatgccatttcggatacagatagaagaaaaaa

SEQ ID NO: 67622 - DNA, 601 bp, Human
attgttgatttaagaattataaactactacattaagaagttttcttctgtggtcagggcggtcacagagcagtaagaaatctctccaaccaggattttcccaataccctggggtaaatgattccagtttcgtaaagactctttgagaacattcctgagaaggtgcaagatacctttgttttactttcatttaagaggacgtgctcatgaccacaattgagatggcaggaggtgggaggcacaattaagccagcacgcgtctttgttgctacagtgttttaacattttgagatagtagctaycatagaaaacttgggaggtttcacatttttaaaaaattcatttttctggcttttgcaaaatcacaaaagctggcaacactgaactcatatactacatggcaacgccaggtccatctgaacagcagctgcccttgcctgttatataaggcatgtattttcaggtctgcctaacacatttattcctcacttggtatctataggttcgtggttctcaaccaaggtgattctgccctccccacggggggcagtggcaatgtctggagacattgctggttgtcacacctgaggggagggagtact

SEQ ID NO: 67623 - DNA, 601 bp, Human
aaattgatctattaatatcctttcagaaaattatttcgaaatagatagtataagtaatttaatcatcctagaaagaaaataatgcagatcaaaactcagaataatttctagtcaatttgcagtgttttgccccatgttctaaccgtgctctatctctaaaaaacaaaagggaaaggccatttcataacggccacttagtgaccataattaggaaatgattccttctttctatctttgttcattctctttcctgaaaaaagggatactactgttcccagtgctaaatatcagaattagagcwgtgtataactagaatcgggaatggtctggatttgtaaaaatcttgggggccacagtaatggtgggggaccctcctagacaaaggtgttaaatcaggaaagttctctaggctaatatatcctctgcttcagtagaaggaatggaaagaccccatttctccagttcccagtaggaagggagaatattagaccttgtgtattaaacttgagcagttaaactgaagatacacacaagctatgactaaagagagtgcactgcatttactcaacttttggaagtcaaagtcatttcacctaattag

SEQ ID NO: 67624 - DNA, 601 bp, Human
tttaaagtttatgcctcttaatacttgccaatagagacagaaaaactcgatcttagttgaacttagaaatagttcttaaaacatgagactcctatgcttaagaatctattttcttaaaagaacgaatgccttggtttccagttccctgatgcataatcaatgcaatacctgcatcaacaaacttaaaacaagcaaggcattcaaatcttagtggtttctttatagtggtgtttatttcccatccccagatgaggtttattccccactcccacaattacttgataaagtcaagtttattacmtcatgtaaataagctgaaaatttattttcattcaaatgttactcacatttgctcactgcaggagttaaataataataaatgcttattggacgcttacgaacgataataaccacaacttttcagcattcacaatgcaccagaaaatgtgctaaatgctttagatgccttatttcatttaatcacttattttacccaatgaatagtacaggttgaacatccctaatctcaaaaccccaaatccaaaatcctccaagacccaaaactttttgagtgctaacctgacaccagtggaaaattcca

SEQ ID NO: 67625 - DNA, 601 bp, Human
tacagaaataagtgagtcagacagaagcacatagacttgcatcatataaaagttggaataaaagcctatggagtctattccattaatttatcacattttccctttttctttaaagtttatgcctcttaatacttgccaatagagacagaaaaactcgatcttagttgaacttagaaatagttcttaaaacatgagactcctatgcttaagaatctattttcttaaaagaacgaatgccttggtttccagttccctgatgcataatcaatgcaatacctgcatcaacaaacttaaaacaagyaaggcattcaaatcttagtggtttctttatagtggtgtttatttcccatccccagatgaggtttattccccactcccacaattacttgataaagtcaagtttattacctcatgtaaataagctgaaaatttattttcattcaaatgttactcacatttgctcactgcaggagttaaataataataaatgcttattggacgcttacgaacgataataaccacaacttttcagcattcacaatgcaccagaaaatgtgctaaatgctttagatgccttatttcatttaatcacttattttac

SEQ ID NO: 67626 - DNA, 601 bp, Human
ccaggcacaaaagggttcttaaattaatccaggttccgcctgtgagaaggctatgaaggattgccaacgtccttatgggcctggaagggaatgcagcagcatgaacacatatttgccattcttggcttagccagcaggagtggaaaaaaaataggaagtatttcctaaatccagaaacaccaattctgtgacccacatgccattctcagctcaggcaattatctactgggtgacaacctcagaagggtcaccttccctctctctggatgactatccccaatgcatgtaattaatttagcaytgagagagaaattcccttcactagttcatcttgattacagaaataagtgagtcagacagaagcacatagacttgcatcatataaaagttggaataaaagcctatggagtctattccattaatttatcacattttccctttttctttaaagtttatgcctcttaatacttgccaatagagacagaaaaactcgatcttagttgaacttagaaatagttcttaaaacatgagactcctatgcttaagaatctattttcttaaaagaacgaatgccttggtttccagttccctgatgcataat

SEQ ID NO: 67627 - DNA, 601 bp, Human
tagtaaatgtttgctgaagggatgcgtgagcgaatcaatgactcatagaaagaaaacaccttacaccatctggttaaaaagaacaacagcaaccctctggttctttccgttttcagcaaacacctctcccggaaaattcacacccgttgagttctgattgataaagcctcctcttccccgtggttgcagaaatatacacccagtgactctgggacaatcacttaacctttcatacttctgagcgagaagagcaataaatctgtgacacaggggcattgtataatgtaattggatctttgarcagcctagcaggaagcttaaaaaacaaaacaagaaaagaaaggaaatgggaaaaaagagaaaagggagagggaagagggggagaggaagagtgacgcagagagagaatgtcctcaactcaacaatgtgggagctgctgtaatttccactcatccacggaatctgctttgggatcatctcactaccccaccccttttcaggcccaaattactaaattagaagtgcataaatacctgtggccttcattaagaaatcacattcatagtccctctcccaatgtctgaacaaatctcaaaacttt

SEQ ID NO: 67628 - DNA, 601 bp, Human
cagttactttttaacatgtgctttattctttacatccaagattaaatccagatgctgaagttacatttttgctgtttactttgtagaaccacatgcaatgaatacaacatagccagtaggaaatatacacctgttacaacgttgatcacacttcacagcaattatctgtttatgtttgactatctttcccaatagactgtaagctttctaagggcaaagatagtgtctttttcatcaaagcacagggccctgtccatgacaacaggtgattagtaaatgtttgctgaagggatgcgtgagmgaatcaatgactcatagaaagaaaacaccttacaccatctggttaaaaagaacaacagcaaccctctggttctttccgttttcagcaaacacctctcccggaaaattcacacccgttgagttctgattgataaagcctcctcttccccgtggttgcagaaatatacacccagtgactctgggacaatcacttaacctttcatacttctgagcgagaagagcaataaatctgtgacacaggggcattgtataatgtaattggatctttgagcagcctagcaggaagcttaaaaaacaaaac

SEQ ID NO: 67629 - DNA, 601 bp, Human
atcatacttcataaaattgtttatcttgttatcttaacttaaaattatagcaggagcatgttcccagatgtagatcattttcaattgctataaaagggagaccctataatttgtttaacctttcttttgcttggcatttcaatgactcctaatttttcctatcatgaataacacaaaaacaaatattgccatgaatcaagtttactcaaaattttgttattatttccatggaatactattgtacttctcaattcaccaggcaatctctgaagacactcccagcaaaagaaacacacatacrccaccccaaagagacagaatgggccaccccatagaaacacagctctgctcatctgcaaccggataactgctagatgttatcactggcccaaacatccacaacacatgcagcaaaactatcacacagccaccccagctgaggccccaccagaaatgatttcaagccccaggtggtcacaggatgctaccttgacaagctaaaacacagaaacatgtttgtctcatgaattagctcttccgaatctagaagagtccctataatttaggtcacctggacaagtcgaagggcattaaaggcaac

SEQ ID NO: 67630 - DNA, 601 bp, Human
aagctttacaactgcaccatactgacatatcctacaacttgctttcttcctcctctaaacactctgttttttagatctattccatttgctatatttagctctatttcagggcacaattttaaaagattttttatctttcctaattattaaaataaaccacacttatagtagaaaagttgcacaagtattaaaagtttatttttttaaatagaaaaagtttcaaactaccaagtcttttctgtagctttttctccccttttagagttgagatcatacttcataaaattgtttatcttgttaycttaacttaaaattatagcaggagcatgttcccagatgtagatcattttcaattgctataaaagggagaccctataatttgtttaacctttcttttgcttggcatttcaatgactcctaatttttcctatcatgaataacacaaaaacaaatattgccatgaatcaagtttactcaaaattttgttattatttccatggaatactattgtacttctcaattcaccaggcaatctctgaagacactcccagcaaaagaaacacacatacaccaccccaaagagacagaatgggccacccca

SEQ ID NO: 67631 - DNA, 601 bp, Human
atgtactatatttctacatttccttgattctaaactgttccatcaacttaccaatagctttccagtgccatccccaaaagagaagaaaaagaaacacaatctcgcattaaatgttcccataggcacactgtaattttagaaatgtttaaatgagagaaagtcttaagttgacagaatgtcttaatattgaagcaataatgataggtatattctctggtatcagcattatgctataatctaagtttcacaatttttaattgtctaacttctaaacatctgtcctctaaaaaatattatgcawgctaaaacagactgcattgtcttatattctaaacatcggtgtctgatcatacacccaaaatcttgcacatttctgccctaagacagaaggacagaacagggcattacttgcctttccaggctcgcactccgtcccatcggcccagggtgtgtgctgagtccggcagcctttgtgtactccattgacgttattgcaccagagccgtctgcactgcatctgctcaattcaatgaaatggcaattgagtgacaagtgatttatttggcagtatcaaacaaagcaaagcttgctttcaactaat

SEQ ID NO: 67632 - DNA, 601 bp, Human
atcattcagagattgtatccttggtaagttacagatagaatgccaatttccatgtgtattttttttttaaatcaagatttatatctaaaactttttgttaccaaatttttgggctgatgatggtatcactaacatgtcaccaatttttctagatgcacactaggtacagaaggttaagttaatcatactcctaggtgcatgagacactgttaccattgggccacaaaagtagcagattttgtttatctattaacaaatcagtaggaacaattataaccagctcacgagaacttggatttggatatatcctgaatgacattatagctccttaaagggaacaacaccggttggcaaaagcctggtatcatagtagtacctgcaatagatgtactatatttctacatttccttgattctaaactgttccatcaacttaccaatagctttccagtgccatccccaaaagagaagaaaaagaaacacaatctcgcattaaatgttcccataggcacactgtaattttagaaatgtttaaatgagagaaagtcttaagttgacagaatgtcttaatattgaagcaataatgataggtatattctctg

SEQ ID NO: 67633 - DNA, 601 bp, Human
agattcaacatgtcttgcaaagattcactctttggccaaagagatatatttccctttaaaccaatgaaagctctagaagctattacgcttgtatccgtataaactttgtgttaggttgctattgaggaaagctgtattctcaattgatgaggtcccagccatagagaaatgagaacatgagctgactctgttgccaatttaagtcaaatacaaaagtatcttcattataagtttttattttcgcattggactttatatttttaaactttcatatcctcaggatcctttaacactgaaaaamccactagtcttcctctttgaccagcagaaactataggagctcagtgagcttcagttagggccactccagtaggccctgctgccccttcagacaaagcagtagaggaaatgagggtggggaggggctgcaccaaatgatctgagtgactgtggacaagttactcattgtgagacaagaaactgagaagtttcttgtctataagatcagggaacagggaattaagttccatcatctcttaggacttcttccacagaaacattctgggtgctaccaattctataaggtaaagcggaggaaaag

SEQ ID NO: 67634 - DNA, 601 bp, Human
gtagcagttgtttgggtctttgtgtttagaaggactctgaggccacatcttgattttgtaagaatgagtgtcatattcaatttttaatggctgccatggattctttgaccaaaatatgattttgtggccaccaatccactaagttacatgtcttgcaaagattcaacatgtcttgcaaagattcactctttggccaaagagatatatttccctttaaaccaatgaaagctctagaagctattacgcttgtatccgtataaactttgtgttaggttgctattgaggaaagctgtattctcarttgatgaggtcccagccatagagaaatgagaacatgagctgactctgttgccaatttaagtcaaatacaaaagtatcttcattataagtttttattttcgcattggactttatatttttaaactttcatatcctcaggatcctttaacactgaaaaacccactagtcttcctctttgaccagcagaaactataggagctcagtgagcttcagttagggccactccagtaggccctgctgccccttcagacaaagcagtagaggaaatgagggtggggaggggctgcaccaaatgatctga

SEQ ID NO: 67635 - DNA, 601 bp, Human
tggaggttgattttgtccaaatgaaacttgaaacaaaagagtttcaaacctcagactcacaaataagtttaaaaggaaaatgctaatggacttaagagagtggagaaaataaagagacattagtgagtcattcatcaaaataacattgtgtcagcagcccaagacagattactgctgcaggagcagaacagaaagaagaaaaagaaagaaaaaacattaacccagcagccaagggaggcagaatgtgctagcatatagagaaaaggcacatactggcaactctatgaaaaagaaacaaagsaaaacactcagagaatttctatgccaatatattcaccttctttggcatttctagaatgtgtaaatactcttcaggatatttatatatatccacatctttaataaaagctgctagacatggccacttttctaaaacaactaaaaatggatctatcattttctctgcacagttcttctccaaaagcatcctgagcctgccttgggaatgccttgaaggctcctgctcttgctacaagcacacccacttgcttgtgtttagcaggagcagggtctgctgaaagctctcccgaagctccccatc

SEQ ID NO: 67636 - DNA, 601 bp, Human
ttttttttttttttttttgagacagagtcttcctctctcacccaggctggagtgcagtggtgcaatcatggctcactgcagcctcaacgtcccaggctcaagtgatcctcccacctcagcctcccaagtagctgggaccacaggtgtatgccaccatgctcagctaaatttttttatcttttatagagacagttaggggtgggggtcttagtatgttgcccaggctaatctcaaactcctagactcaagcaatctgccctccttggcctcccaaagtgctgggattacaggcatgagccamcacacctggcctactaattagattttttaatgctttttttttttcatactaagtcttcaaatcctgggatgtattttatacctaagcacatctcagttcatgtcgacattttaacatagccacacgtggctggtggccaccatattggacacagcaggtctagacagacaaaacttaacaaaatacaacaggtctcactgggactggtaactcttttacaaaataactctgtggccttgggtgagtccttaaagtctgtttccacaataaaaaaatggggacctactggccaaaattatt

SEQ ID NO: 67637 - DNA, 601 bp, Human
acataacattactcaataattttttttttttttttttttttttgagacagagtcttcctctctcacccaggctggagtgcagtggtgcaatcatggctcactgcagcctcaacgtcccaggctcaagtgatcctcccacctcagcctcccaagtagctgggaccacaggtgtatgccaccatgctcagctaaatttttttatcttttatagagacagttaggggtgggggtcttagtatgttgcccaggctaatctcaaactcctagactcaagcaatctgccctccttggcctcccaaastgctgggattacaggcatgagccaccacacctggcctactaattagattttttaatgctttttttttttcatactaagtcttcaaatcctgggatgtattttatacctaagcacatctcagttcatgtcgacattttaacatagccacacgtggctggtggccaccatattggacacagcaggtctagacagacaaaacttaacaaaatacaacaggtctcactgggactggtaactcttttacaaaataactctgtggccttgggtgagtccttaaagtctgtttccacaataaaaaaa

SEQ ID NO: 67638 - DNA, 601 bp, Human
gtctgaaggccagggggtggggcagtatgcagggaaggtggaaaaagaagaggtaggtgaaggtctcagtgggaatagcaggccccacccccacacaaggcttggtaaacaattatttaaacagtgcaattaagctttctccagtctgcctggcctcctcccttgtaattatcctcttacagtatctgagggcacgtccctttccctgggctgtttggctgaggcttaagatgttctgcatctgaaccctgggtgactcaggacccatgaaatgcgcactgaggcagtggggactacgtcrctctctggaaatcacttcatatttgtctttacagtggttgtgaacatttcttagaaaatatacatataaaaataaatgaacagatggacggctttgtctagagtacctctgtccagtagacacagaacatgaaccacatatataatttaagaatttctaaagtcacataaaaaactaataaaaaacttaaattaattttaatatatttagcccaatctatctaacacattgttatttctacatgtagtcaacataacattactcaataattttttttttttttttttttttttgagacag

SEQ ID NO: 67639 - DNA, 564 bp, Human
aacaaagtattattttaaaaaaggccaaacacttcttttgaatggaatatccttgagtcaaaaatgtttaaagtgcttataaagtggtcactgtttgcaatatccataccctcatgatagcatttactataaactaataactttgctcaatgtagccaccaaatagtttttaatatgtaaaaaattcatcatattagttgttacgatacaaggttttcttttaaagcttcaacaatacaagcaacaaggatgcatagctgagtktaaaaagcagtaccagccttcttttatattatatgatacttattttatattatgtggtacttatttcatataatatgtatttacatccacaatctgaaaagtctgaaatgacacacactgaattacttttcagtgattatttctcatggggagtaggcaggaagtaggaatagtgtgacaacttctaaaatattctatatgtttgtgtctgaattttttgaagcatgatctatatttatactaatatttaaaaaactaattcaaaatataggctatatagaaaatctaaggcttattcat

SEQ ID NO: 67640 - DNA, 601 bp, Human
tttttgatggactgtaacaattctacgtaccattttgtttcagccacaaggaagctcggagccaaattttgagcacaaaacaagtatagggcccaaaagcctgaaaatacatcttctagttccaaagctcagtctggttttggtactgttaagctatgttttggaggttctgattttaaattttactctattacacacgtcttataggctgggtgaccgtgtaattaattgcccaatcaagaacgttctgagagtgaaaatgggagctattaataattccttcagggcaacagatagaacragggactgtccttgtaaaccagaactatgatcatcttatctgtagggcatggatcaaaattgagattaaaaaaataaagcacttaaagacaaaatatgagggccccacctgtaacaccatatataccagttgagaccaaaatatcttgtgaccaaaattagaaagcgtatggtctctacagcttgttcatggagtagagcataatctcatgtacacggcaaggctacttatcttttttggcttttacgctttcagggggaaaaaaactcttaagaatatactataaagtctctggatgct

SEQ ID NO: 67641 - DNA, 601 bp, Human
gctgtaccagcccatctttaatgatctttccaaatggggcagtctatgaaactggattcttttacttattcattagttaatggctcttccacagtaaccaattctcaacatttcgaaacaacttcatccaaactgagtgcctcagaaaaagccttgctgtaattccttacagccaaatgagaaattcatttttttggatgaaatagacatatgtcttgaatatgtttttaaagtaagatttcataaccagttgctatggagagagcctaagggggaaatatctagttcataatccttttawccctcaaatctatgagtttattatttttaaattttaacctatctcctaatttaaaagtaaaatagaagcactggaaaaagaaaatgctgtgtctttcctaaggaactgacacgatttttgtttttgatggactgtaacaattctacgtaccattttgtttcagccacaaggaagctcggagccaaattttgagcacaaaacaagtatagggcccaaaagcctgaaaatacatcttctagttccaaagctcagtctggttttggtactgttaagctatgttttggaggttctgattttaaa

SEQ ID NO: 67642 - DNA, 601 bp, Human
tggaggtttttaagaaggggcctgatggccaattatgaagaatgctgaaaggctattcaaagattagatgggatggggtgggagctgtaccagcccatctttaatgatctttccaaatggggcagtctatgaaactggattcttttacttattcattagttaatggctcttccacagtaaccaattctcaacatttcgaaacaacttcatccaaactgagtgcctcagaaaaagccttgctgtaattccttacagccaaatgagaaattcatttttttggatgaaatagacatatgtcttraatatgtttttaaagtaagatttcataaccagttgctatggagagagcctaagggggaaatatctagttcataatccttttatccctcaaatctatgagtttattatttttaaattttaacctatctcctaatttaaaagtaaaatagaagcactggaaaaagaaaatgctgtgtctttcctaaggaactgacacgatttttgtttttgatggactgtaacaattctacgtaccattttgtttcagccacaaggaagctcggagccaaattttgagcacaaaacaagtatagggcccaaa

SEQ ID NO: 67643 - DNA, 601 bp, Human
agatttagggttggcacaagacatttctaaagatacaacaggcagccccagaaggtagtgtaattcctgtgcctggaggtttttaagaaggggcctgatggccaattatgaagaatgctgaaaggctattcaaagattagatgggatggggtgggagctgtaccagcccatctttaatgatctttccaaatggggcagtctatgaaactggattcttttacttattcattagttaatggctcttccacagtaaccaattctcaacatttcgaaacaacttcatccaaactgagtgcctcaraaaaagccttgctgtaattccttacagccaaatgagaaattcatttttttggatgaaatagacatatgtcttgaatatgtttttaaagtaagatttcataaccagttgctatggagagagcctaagggggaaatatctagttcataatccttttatccctcaaatctatgagtttattatttttaaattttaacctatctcctaatttaaaagtaaaatagaagcactggaaaaagaaaatgctgtgtctttcctaaggaactgacacgatttttgtttttgatggactgtaacaattct

SEQ ID NO: 67644 - DNA, 601 bp, Human
cagagggtttgaatcccagctatgcctcttaataatgatgcaatattaggcgagttgcttaatcttgccaagcctccgtttgcttatctgtaaaagggagatgatactaatatctatttcataaagctgtagtgagggttaactagattaatacattcaaagcacttgcacaaagtgtggctcacagtaagtgattaataaaagtttagctattacaagatttggcaaactaccatcctgtgggccaaacccagcccgccattgatttttgcatggtttgtgagctaagaataagttttamattttaaagtaattgaaaaaaatttttacaaagaagaagattttgggacacatgtgaactatgggaaattcaaatttcagtgtccataaataaagatttattggaacacagccacacccacattgtctgtttgtttcttcgtatatcagtaaggttgagtaattgtgatggagaccacataaacctcaaagcctaaagtatttactatttggccctgatggaaaaggtttcctgatccctggactattcttgtgtcactgtcctacgttccaaattctgtcactgactttgctgagaggg

SEQ ID NO: 67645 - DNA, 601 bp, Human
agagatgcagaatgggtttcctagatccaagcccttttctcagtaccaaggcaccccagtctcatgcataaaatatcacagatgacccatgaataacagatcaggactgtatacctgctcaggtaaaacttgtttcaaatgtgctacaaggaagacccccttcaatttttcctccagttgaaattatctttctggaatctttttagatgtcccagctgactatggtggatcaatcatttatttattgcctgaaagtaactcatacttctttccctttgaacataaagttttttaaattgattttttttgttctcttatatgacacgtcttagctgattcttgaaatttatcaaatgcagcagttcttcggactgcaaatagttattatttataggtggcttcccttcagatggtaacagtttccacctttgcttgctttgaccactataacatggcaagtagtattttgggatttatttttataaaaaacattttttataaacacacaaaaaatactgtatgtgagaggcaatactccttatggttagaaacatggactctggaaacagagggtttgaatcccagctatgcctcttaataa

SEQ ID NO: 67646 - DNA, 601 bp, Human
ctagggatgcaaaatggcacataacacagtcgtgtctacgtctgtctgtttctgcattaagcacaattaagcccatatactgtatatctgcactattcattcaaactgggaaatctccttcctatcttgtccaaggctagggaagatgaggtgcttttataccaagtgacaggacgtttagagaagtactttgcccaaaggtcacacagctaacaaaggagcagagtcaggactggaatccaagtctcccagactcttctctgtgcacgtctgctacattatccatatgctgtgtttcagrgtctttttttttcttttcttttttggtgccatttagagatgcagaatgggtttcctagatccaagcccttttctcagtaccaaggcaccccagtctcatgcataaaatatcacagatgacccatgaataacagatcaggactgtatacctgctcaggtaaaacttgtttcaaatgtgctacaaggaagacccccttcaatttttcctccagttgaaattatctttctggaatctttttagatgtcccagctgactatggtggatcaatcatttatttattgcctgaaagtaactcatact

SEQ ID NO: 67647 - DNA, 601 bp, Human
ctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgcaaaatggcacataacacagtcgtgtctacgtctgtctgtttctgcattaagcacaattaagcccatatactgtatatctgcactattcattcaaactgggaaatctccttcmtatcttgtccaaggctagggaagatgaggtgcttttataccaagtgacaggacgtttagagaagtactttgcccaaaggtcacacagctaacaaaggagcagagtcaggactggaatccaagtctcccagactcttctctgtgcacgtctgctacattatccatatgctgtgtttcagggtctttttttttcttttcttttttggtgccatttagagatgcagaatgggtttcctagatccaagcccttttctcagtaccaaggcaccccagtctcatgcataaaatatcacagatgacc

SEQ ID NO: 67648 - DNA, 601 bp, Human
ctcctgcagcgtgcccaggtcccacaaaggccctcctagagaagctcgtcctgatactgttataaacgtacttgctcgatcaaagatttgcagcataaagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgyaaaatggcacataacacagtcgtgtctacgtctgtctgtttctgcattaagcacaattaagcccatatactgtatatctgcactattcattcaaactgggaaatctccttcctatcttgtccaaggctagggaagatgaggtgcttttataccaagtgacaggacgtttagagaagtactttgcccaaaggtcacacagctaacaaaggagcagagtcaggactggaatccaagtctcccagactcttctctgtgcacgtctgctacattatccatatgctgtgtttcagggtctttttt

SEQ ID NO: 67649 - DNA, 601 bp, Human
ccctatcctcactgtgtggccctagactaagttctcagtcttcctgagcttcaatttttccccttctttacaataagtgcacatagtagatgccataaaatgttacctactatgatacttcatgtcaacactgcccaatctaatctgatccaattctgcagttggcttgagcacccactctgagcaccgaggcaggactcagtgctcctgcagcgtgcccaggtcccacaaaggccctcctagagaagctcgtcctgatactgttataaacgtacttgctcgatcaaagatttgcagcatraagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgcaaaatggcacataacacagtcgtgtctacgtctgtctgtttctgcattaagcacaattaagcccatatactgtatatctgcactattcattcaaac

SEQ ID NO: 67650 - DNA, 601 bp, Human
ctggccctatcctcactgtgtggccctagactaagttctcagtcttcctgagcttcaatttttccccttctttacaataagtgcacatagtagatgccataaaatgttacctactatgatacttcatgtcaacactgcccaatctaatctgatccaattctgcagttggcttgagcacccactctgagcaccgaggcaggactcagtgctcctgcagcgtgcccaggtcccacaaaggccctcctagagaagctcgtcctgatactgttataaacgtacttgctcgatcaaagatttgcarcataaagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgcaaaatggcacataacacagtcgtgtctacgtctgtctgtttctgcattaagcacaattaagcccatatactgtatatctgcactattcattc

SEQ ID NO: 67651 - DNA, 601 bp, Human
agaatgagaggtagaaagagctctagagttggatcttggttccaatctggccctatcctcactgtgtggccctagactaagttctcagtcttcctgagcttcaatttttccccttctttacaataagtgcacatagtagatgccataaaatgttacctactatgatacttcatgtcaacactgcccaatctaatctgatccaattctgcagttggcttgagcacccactctgagcaccgaggcaggactcagtgctcctgcagcgtgcccaggtcccacaaaggccctcctagagaagctygtcctgatactgttataaacgtacttgctcgatcaaagatttgcagcataaagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgcaaaatggcacataacacagtcgtgtctacgtctgtctgtttctgca

SEQ ID NO: 67652 - DNA, 601 bp, Human
actataaaaaatgggtttttggctgctttgtttcaaacaggagttttggggaatgagaaatatatccctgctcacgaaatatagaatgagaggtagaaagagctctagagttggatcttggttccaatctggccctatcctcactgtgtggccctagactaagttctcagtcttcctgagcttcaatttttccccttctttacaataagtgcacatagtagatgccataaaatgttacctactatgatacttcatgtcaacactgcccaatctaatctgatccaattctgcagttggcttkagcacccactctgagcaccgaggcaggactcagtgctcctgcagcgtgcccaggtcccacaaaggccctcctagagaagctcgtcctgatactgttataaacgtacttgctcgatcaaagatttgcagcataaagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcacc

SEQ ID NO: 67653 - DNA, 601 bp, Human
taggctgttgtgagaataaatgttagaatgtatagcttaaaatatgagatgcgaagcctgaatctgaatctattaggccactttttgttccttttcttcccaacattcatggtgcttcaatgtttaaaatgtagaaggtgaaaggtacccaagagtagtttggaatgctccctatcttccttttgtaccttgacatattcacaggagaccatcataaacttgttccctcacacctccattcattctgtccctctactccctctctccagacaaccattgtttttgcttttttgtttcacamataaaatggaataatgggaatgtgttcatattttgactaacttaagaggagaagcaggaaagagcatactggtttcattagcttttgtgtgacgagtgtatggcatacgccttgcaaagcatcacagtgcaaatttaatctccgcatgcaaccctgtgcatgtatattccagatgtgatccagagagtaaattatacaacacatctaccagcagtcagcagcatgccaaattcatcatggaaacaggaagatcacagaatcgtaggacgttggggctcactcacccagggctgaaacagc

SEQ ID NO: 67654 - DNA, 601 bp, Human
cagctcttcttcctgacatatttctcaccctcagctattcaatctaaaaaatttgctgtcaggaagcatttgggaagcatttgcttaagcattgagtttatagcaaaggagtgtgggtgtaaattgttacaataaatttttaaggagaggttttgtgcaagacccccacagagactgaaaatgtcaagaaaaatccagggcaacggctcccaaactttggcactacacgcatcagaaaaaagtgatattgatgctgttgctgatcccggggccacactttgagaaccactgccctggcaayagtgcacagatactagcagttgctattctatctaggaagccacaaatcacaggttggcagcgggaaaacacagtgaagaaaacaccatcaaggacttacccggcaaaggccctggacacagatatcatttgtgtcctggccacaaggagttccatctatcactctgtctcgaagctgatagtaggctgtgttccctgccactctgcagaacaacttgcaccggtccttcatcagaactagagaggagaaacaatacaacttgacttttgtgcctggcctcagtgccggccggccaacggt

SEQ ID NO: 67655 - DNA, 601 bp, Human
taatatttttgcatattacatgtgcttaacaattttcaaactttgaccatattccttctcatggttcttaggagcagattcttaccataatgtactgtattaaatgttcctgccactgttttgcatgaagaattatcgccaccacaaaccccacatttatctctccgggcttttgagtttaaaacatgatcgcatccagcttgcttttaaaaagaaaagatttgaaataaatgtaagcattatagagattataaaatggcaaataatgtgtttcttttaatcgtgtgcactaaaaatgacragaaagtcaagtcctttaaaacttggaaaggttgaaaactgaaattatatactgccttgctatttaaaatgtggtccttggaccagcagccatgggcacctttgatgtggtcaggaatgcagaatttcaggacccacccagatctactggatcagagttggcattttaataggattcctcaggtgcttcatctacagataaaagtttgaaaagcactagtctgtaagtaagcacagtaattttttaaaaaattgcttaggaatgaaaaaaaaagggaataggtaagaactgtatctaatt

SEQ ID NO: 67656 - DNA, 601 bp, Human
gctcgacattaatatttttgcatattacatgtgcttaacaattttcaaactttgaccatattccttctcatggttcttaggagcagattcttaccataatgtactgtattaaatgttcctgccactgttttgcatgaagaattatcgccaccacaaaccccacatttatctctccgggcttttgagtttaaaacatgatcgcatccagcttgcttttaaaaagaaaagatttgaaataaatgtaagcattatagagattataaaatggcaaataatgtgtttcttttaatcgtgtgcactraaaatgacaagaaagtcaagtcctttaaaacttggaaaggttgaaaactgaaattatatactgccttgctatttaaaatgtggtccttggaccagcagccatgggcacctttgatgtggtcaggaatgcagaatttcaggacccacccagatctactggatcagagttggcattttaataggattcctcaggtgcttcatctacagataaaagtttgaaaagcactagtctgtaagtaagcacagtaattttttaaaaaattgcttaggaatgaaaaaaaaagggaataggtaagaactg

SEQ ID NO: 67657 - DNA, 601 bp, Human
catctcacctaagtagttgtcatcgtctgtttcccctgagaaactgtgctgccgcacatcaatattggtagcaccagctggaattcggaccacagtattgtaacctgaaaagaatttagcagaaattcagtactccacagaatggttcactttctctaagtatggaataaaaagtggacaacaaaggaatagaatataattctcatataattctattaggtgccttctagtcgatggataatccaccacaacgagactgatttttatgctcgacattaatatttttgcatattacatgtgsttaacaattttcaaactttgaccatattccttctcatggttcttaggagcagattcttaccataatgtactgtattaaatgttcctgccactgttttgcatgaagaattatcgccaccacaaaccccacatttatctctccgggcttttgagtttaaaacatgatcgcatccagcttgcttttaaaaagaaaagatttgaaataaatgtaagcattatagagattataaaatggcaaataatgtgtttcttttaatcgtgtgcactaaaaatgacaagaaagtcaagtcctttaaaactt

SEQ ID NO: 67658 - DNA, 601 bp, Human
catggcacacgtttacctatgtaacaaacccgcacatcttgaacatgtactccagaactttaagttaaaaaataaaaaaataataaaataagatgggactgggctgagcaaactgttgaaaatcaacacagggtcatcggcatgttgtggtttaaatataaggaatagatatgaattaatcatgcacctcagttcagtgagaagaggataaaaaatctgtatagtattgctattctagtaatgacttgagaaaaatacgtgtcaccatagaaacttttgcaacgaacaggcataatgaaayactgaataagtctaccagtggtctgctactggttagagctgataacataaaaattaagtcaagtaatgcttctaataaaatatttgcaagtcagttccccacaggacagctttttgaaaagactcaatgagagcaaggattttatgctaaacttagaggataagtactttcaaaatttgacttggggcctttctattttttaagatccagagtaaatcccttgatatcaaatagtgcagctacacaacttttcaatcaatactctgagggcgtatgtatgagggagaaatacaatggtga

SEQ ID NO: 67659 - DNA, 601 bp, Human
tggggcttgtgggatgcaggatgtgtgggcaagggagagcatcaggaaaaatagctaatgcatgctgggcttaatacctaggtgaggggttgacaggtacagcaaatcaccatggcacacgtttacctatgtaacaaacccgcacatcttgaacatgtactccagaactttaagttaaaaaataaaaaaataataaaataagatgggactgggctgagcaaactgttgaaaatcaacacagggtcatcggcatgttgtggtttaaatataaggaatagatatgaattaatcatgcacctcrgttcagtgagaagaggataaaaaatctgtatagtattgctattctagtaatgacttgagaaaaatacgtgtcaccatagaaacttttgcaacgaacaggcataatgaaatactgaataagtctaccagtggtctgctactggttagagctgataacataaaaattaagtcaagtaatgcttctaataaaatatttgcaagtcagttccccacaggacagctttttgaaaagactcaatgagagcaaggattttatgctaaacttagaggataagtactttcaaaatttgacttggggcct

SEQ ID NO: 67660 - DNA, 601 bp, Human
ggaggttgaagatgcagtgagctgtgatcacaccactgcactccagcctcggtgacagagtgagaccctgtcccaaaaatacagggaagggaacaacacacaatggggcttgtgggatgcaggatgtgtgggcaagggagagcatcaggaaaaatagctaatgcatgctgggcttaatacctaggtgaggggttgacaggtacagcaaatcaccatggcacacgtttacctatgtaacaaacccgcacatcttgaacatgtactccagaactttaagttaaaaaataaaaaaataataaawtaagatgggactgggctgagcaaactgttgaaaatcaacacagggtcatcggcatgttgtggtttaaatataaggaatagatatgaattaatcatgcacctcagttcagtgagaagaggataaaaaatctgtatagtattgctattctagtaatgacttgagaaaaatacgtgtcaccatagaaacttttgcaacgaacaggcataatgaaatactgaataagtctaccagtggtctgctactggttagagctgataacataaaaattaagtcaagtaatgcttctaataaaatatttgc

SEQ ID NO: 67661 - DNA, 601 bp, Human
atagtcccagctactcaggctgaggtgggaggatcacctgagcctgggaggttgaagatgcagtgagctgtgatcacaccactgcactccagcctcggtgacagagtgagaccctgtcccaaaaatacagggaagggaacaacacacaatggggcttgtgggatgcaggatgtgtgggcaagggagagcatcaggaaaaatagctaatgcatgctgggcttaatacctaggtgaggggttgacaggtacagcaaatcaccatggcacacgtttacctatgtaacaaacccgcacatcttgmacatgtactccagaactttaagttaaaaaataaaaaaataataaaataagatgggactgggctgagcaaactgttgaaaatcaacacagggtcatcggcatgttgtggtttaaatataaggaatagatatgaattaatcatgcacctcagttcagtgagaagaggataaaaaatctgtatagtattgctattctagtaatgacttgagaaaaatacgtgtcaccatagaaacttttgcaacgaacaggcataatgaaatactgaataagtctaccagtggtctgctactggttagagctg

SEQ ID NO: 67662 - DNA, 478 bp, Human
actttgggaggccaaggcaggaagatcgcttgaggccaggagttcaagcccagcctgggcaacatagtgagacatcatctctataaataagaaataaaaataaataaaaaacaactagctgtgcatagtggtgagtgcctatagtcccagctactcaggctgaggtgggaggatcacytgagcctgggaggttgaagatgcagtgagctgtgatcacaccactgcactccagcctcggtgacagagtgagaccctgtcccaaaaatacagggaagggaacaacacacaatggggcttgtgggatgcaggatgtgtgggcaagggagagcatcaggaaaaatagctaatgcatgctgggcttaatacctaggtgaggggttgacaggtacagcaaatcaccatggcacacgtttacctatgtaacaaacccgcacatcttgaacatgtactccagaactttaagttaaaaaataaaaaa

SEQ ID NO: 67663 - DNA, 601 bp, Human
atcatatgtaggcttcatatcagtagctgaagatgtaaagaccctgccctaactttaaaacactagtggtcgtataataaatatgtaactagtcttgtcatctcagttgatgacaactccatccttcccattgctcaggttttgaccttggagttttgagattcctttgtacctttagtcttgtgtacttttaactcctttgtacctttaactcacacactatgttcaatccatcagcaagtcatattggttccaacttcaaaagatatccagaatctaactacatactgccactttcacygctcccattggggccaagccaccagcatctccctcctggattactgcaatgatttcctaatcaatggcaccgcttctgtcctgtacacacttcccccaccatctcttctcaatgtaccagccagagtgctcctttaaaaacataaatgcagtaagacgtcattcctcagctcaaaacctccagtggctcctgatgtctctgagtccaagccaaagttcttaaaatggttatatggtcgtgtatgacctagtcttgtttaaccttacctaggagtgtcctctgtgctcacttggcaacagc

SEQ ID NO: 67664 - DNA, 601 bp, Human
tagtcattaaagacagcattgacaacggctgttcaacaattcagcaatcatctgctttgtaccaatcatatgtaggcttcatatcagtagctgaagatgtaaagaccctgccctaactttaaaacactagtggtcgtataataaatatgtaactagtcttgtcatctcagttgatgacaactccatccttcccattgctcaggttttgaccttggagttttgagattcctttgtacctttagtcttgtgtacttttaactcctttgtacctttaactcacacactatgttcaatccatcarcaagtcatattggttccaacttcaaaagatatccagaatctaactacatactgccactttcaccgctcccattggggccaagccaccagcatctccctcctggattactgcaatgatttcctaatcaatggcaccgcttctgtcctgtacacacttcccccaccatctcttctcaatgtaccagccagagtgctcctttaaaaacataaatgcagtaagacgtcattcctcagctcaaaacctccagtggctcctgatgtctctgagtccaagccaaagttcttaaaatggttatatggt

SEQ ID NO: 67665 - DNA, 601 bp, Human
tgcatgcaatgctgtttcatttaattaggaagtagtaaggacactgcagccacatgctcaaatttataaccaagtgtacaaagaaaaatacttgccccattctgcagctgtgcaaggagaaatggattccccccccaaaataatttgtaaacagtcctccaagaactttgttaattgtcttataaaattgtcactcatttggatgtttggggtagtgaaaagctgatgtagtgattgagtaattaattccaagtaaggctttacggcccttgaaagaagaggtgaatgtacattttcaagstaaccccattctccattaagtgcacagtaggtagtcattaaagacagcattgacaacggctgttcaacaattcagcaatcatctgctttgtaccaatcatatgtaggcttcatatcagtagctgaagatgtaaagaccctgccctaactttaaaacactagtggtcgtataataaatatgtaactagtcttgtcatctcagttgatgacaactccatccttcccattgctcaggttttgaccttggagttttgagattcctttgtacctttagtcttgtgtacttttaactcctttgtac

SEQ ID NO: 67666 - DNA, 601 bp, Human
attgtttttccaagaaagggaagaatagcagagaatccttctctctttcgaagagaagaaaggagcaactcaacatggccttcaggtctcaggaaattaatttataaagcaggctgcatgcaatgctgtttcatttaattaggaagtagtaaggacactgcagccacatgctcaaatttataaccaagtgtacaaagaaaaatacttgccccattctgcagctgtgcaaggagaaatggattccccccccaaaataatttgtaaacagtcctccaagaactttgttaattgtcttataaarttgtcactcatttggatgtttggggtagtgaaaagctgatgtagtgattgagtaattaattccaagtaaggctttacggcccttgaaagaagaggtgaatgtacattttcaagctaaccccattctccattaagtgcacagtaggtagtcattaaagacagcattgacaacggctgttcaacaattcagcaatcatctgctttgtaccaatcatatgtaggcttcatatcagtagctgaagatgtaaagaccctgccctaactttaaaacactagtggtcgtataataaatatgtaacta

SEQ ID NO: 67667 - DNA, 601 bp, Human
tcaacgcgagactcagtgtgggttgtaaaaccttctcagtgcatgtgctgcatcttccatcaagccaagagtaaatatttacatatgccagacttgatgacaacatcaaattcttcctaacttgttgagtaaccaccgtgaggttcaaaggctctgaggtctcgactttcacactcagtggactgtgacttgcaatgtaggcttgcacacttttcatttgcttctagagagacttccttatgccaacaggtgactttcccattctattccgttaaagtgtcataactggctcagattgccygtgccagatgacaaatcttccttaattttgttttcattctttacaaggagattaagaaacctccactgaataataaaaggttatcaggaggccctccctgaattcaggtgcttgatgtgcattgattaagttgacttgaattgaggccactacttggagggagattgtttttccaagaaagggaagaatagcagagaatccttctctctttcgaagagaagaaaggagcaactcaacatggccttcaggtctcaggaaattaatttataaagcaggctgcatgcaatgctgtttcattta

SEQ ID NO: 67668 - DNA, 601 bp, Human
ggagacaaataagtatcacagaaatggctactttttcttctaaagagatacgaacatggtggccctgggtacaacttggctttagctcaacaggaggaaggggtccatgtgaaaggatgacctttgacaggaaggcttcctgctttggtactttgtgaaacaaatagtttcctgaaaacaagagcctaatgcccaacctcccactaatgcgattaagggagctaatttcctgggttggtttccctcccattgcacccatcagagctgggttgctacaaaaggccctctctcctggaaattsctccctcctagaatacacagaaaagtatggcttggctgacactgaaaaaaaacataagggataaggatgaatattgcttagcaatggaacagctgtgactggactcaacgcgagactcagtgtgggttgtaaaaccttctcagtgcatgtgctgcatcttccatcaagccaagagtaaatatttacatatgccagacttgatgacaacatcaaattcttcctaacttgttgagtaaccaccgtgaggttcaaaggctctgaggtctcgactttcacactcagtggactgtgacttgcaat

SEQ ID NO: 67669 - DNA, 601 bp, Human
gaggagcacaaatgatatcggattcctcttacgatctgccgtgataaatggtttggccccagacatccttaaaatcatcagatgaaaaaaaaaaatcctattttatcttgcactgcatcgattcccatcttcccattgccacaattaatcaagagctaagtgtactggagacaaataagtatcacagaaatggctactttttcttctaaagagatacgaacatggtggccctgggtacaacttggctttagctcaacaggaggaaggggtccatgtgaaaggatgacctttgacaggaagscttcctgctttggtactttgtgaaacaaatagtttcctgaaaacaagagcctaatgcccaacctcccactaatgcgattaagggagctaatttcctgggttggtttccctcccattgcacccatcagagctgggttgctacaaaaggccctctctcctggaaattcctccctcctagaatacacagaaaagtatggcttggctgacactgaaaaaaaacataagggataaggatgaatattgcttagcaatggaacagctgtgactggactcaacgcgagactcagtgtgggttgtaaaa

SEQ ID NO: 67670 - DNA, 601 bp, Human
ataaaaggaggataagggttgaaaaattacctattgggtacaatgctcattatttgggtaatgggtactctaaaagctcagacttcaccactacccaatatatgcacgtaagaaacctgtagtcctaccccttaaatatataagatgataaaatacaaatttacttttataagcccaggaaagatcccaacccatagtaggtgctcaatcgatgatgctgaaagaataagtgattgatggagtctgacactcatgacaaggaggatagagtgcttccagccaaatgactctttctcagtcwgtgtaaacctctgacaacctcgtcttgcctgcagctcctgcagcgcgagacccatcagccatgaaagaggcaggagtttcaatgggtcactgaagccaaggttgtttccgtggcaccttgggcatcctgaggctgctccctaatgcgggtcattcaaatggtgacagtatgatgtgctgtcaacaaaatcacccagttctttcaaatgaagttgcatgctagctacccagctgatgtcttgataaaaaggaggaaataaaaagtcagatgccggttctgtaaatcaagtgataatccagt

SEQ ID NO: 67671 - DNA, 601 bp, Human
tctcttgtatacaaatagaaactaagtatgtttgtgttgtagatttttcttaaatgtaaattgctcattttgttagtctgcatgagcccttgagcaaagcagccatttaaaaatccacttttttgactaatagacattggagagtaccaaaggtgggaggataaaaggaggataagggttgaaaaattacctattgggtacaatgctcattatttgggtaatgggtactctaaaagctcagacttcaccactacccaatatatgcacgtaagaaacctgtagtcctaccccttaaatatayaagatgataaaatacaaatttacttttataagcccaggaaagatcccaacccatagtaggtgctcaatcgatgatgctgaaagaataagtgattgatggagtctgacactcatgacaaggaggatagagtgcttccagccaaatgactctttctcagtctgtgtaaacctctgacaacctcgtcttgcctgcagctcctgcagcgcgagacccatcagccatgaaagaggcaggagtttcaatgggtcactgaagccaaggttgtttccgtggcaccttgggcatcctgaggctgctccc

SEQ ID NO: 67672 - DNA, 601 bp, Human
ccaggtggctcctaatcatggaaatccatttccagagtctacaaactactaaaattttccaagaagggggtcaacaaacgtttgttaaatgagtaaatgagttcatgcattcgttctcttgtatacaaatagaaactaagtatgtttgtgttgtagatttttcttaaatgtaaattgctcattttgttagtctgcatgagcccttgagcaaagcagccatttaaaaatccacttttttgactaatagacattggagagtaccaaaggtgggaggataaaaggaggataagggttgaaaaaytacctattgggtacaatgctcattatttgggtaatgggtactctaaaagctcagacttcaccactacccaatatatgcacgtaagaaacctgtagtcctaccccttaaatatataagatgataaaatacaaatttacttttataagcccaggaaagatcccaacccatagtaggtgctcaatcgatgatgctgaaagaataagtgattgatggagtctgacactcatgacaaggaggatagagtgcttccagccaaatgactctttctcagtctgtgtaaacctctgacaacctcgtctt

SEQ ID NO: 67673 - DNA, 601 bp, Human
tctttcaccactcaggagagaagcaatgtgtacacagaagaggttccaaggatttaggttaagtaaatattatatccttatgtggatactaaagagggcagagatgaagctctgaatatttgtggttcagcagcagcaggatccttaattttcatagacatgggaacctcacagagttcatgcaattggacaccttactgacgcagggctattcattccaggattaggaattaactgcattgaattctgttcctaatccagcacttcatttaccagaattctcacccacataaacaacatytggccccaagagaagaataaggtgccttcatctgaaatgactgagaagaatgtggtgacactgggaaatgtcaagattagcttttaaaaggataaaataccctccaacttcttggctcaaaatcctttggaagtcaccactacctacaagatagtacaacctccttagcatagcctccctgtaactttacaaatcttaatcttcacctatcttcctagtctgaccattcactcccaccaataaacctaaatttcaagtcctgtatatttccaggtcagccatatatccttctacatggtg

SEQ ID NO: 67674 - DNA, 601 bp, Human
ctagtatacagcaatgtgactatagttaactttagtgtattgcacacttgaaatttgcttaaagggtagatgataagtgttgaaataaacaaagagagtgggaaagagaaagaagaaagaaaggaaaagagagacaaagaaagaaaaggaaagaggaaggaaggagggaagaaaagaaaaaagaaaacaaaaggaaatggtaactatatgggtgatagatacattaattaggttggttttggtgattatttcacactgtataggagtataaaaacataaagttgaacaccttaaatatatscaatttttatttgtcaagtatcccttgatgaagctgaaaaaagaaacaggaaagaaaattgacaaggaggatgagacaacagctgcttcagaagaaattatttatttattaaaaggtcaagagagcttattgggaaagttaataaatctctagaaagcttttctaaaattgactccctttcagatttcactgttaaatccagactttcagtcaagaatatactactttgctattatgtgacttgatatgaaaaatatatgcaaaaatatttatcaattgccttattcttttcaaaacctt

SEQ ID NO: 67675 - DNA, 601 bp, Human
tggggacttttgaggcagacaggcatggcttcaagtcccaagtttgctacttgccagctgtgtggctttgggaatcattttccatccatctccatttctttatctctaaagtggagataaaagcacctactcccttgtggtatctgtgaaaaataaaatgtaacctaggtgtcctaataaaccttgatcttgttatacaagacccacagttatagaattatagatggaaacaaaagtgtttatatgatttgaaaatatgcattagtgaacggaacacttacaaaattggttcctagacaartctatatatactagaattagtcaagcctgttgaatctttgttaagtcttttttgtttgacagatgttgaaatctgaaaatccatggttaatatgatgctcaaagatctccttatcagtgtagctcactgtggtagccagcctcaaatatggccccaacgagccttgtggcatggtattcacactatgtgtcatcccctcccacattcaataggaatgactgcaatcactaggacaatgcagaaacaacagaacctgacttctaaggcaaggccaaaggcactttggctctgccttgctct

SEQ ID NO: 67676 - DNA, 601 bp, Human
tccaccatctgtgcgatcataggagcatacttagcactgtaggcaggagttctgctgtatctatagttataatcagagactcaaccagtcccgttctgattcaatcagtggagaaaaaacaggtaaggggctccaagcaaggtagggaacagggatggggcaaaaaaactcatgggaattatttcttttcacaaaggaagagaagctacccagaatagaatccatgagtaacactcatcgttataactgaattaagaataaaaataactctctcctaggatttaagcacaggatctaggtrcagatttagatttccgtcactccactaactcgttgtgtgagcttgtgcaatttgtttaacgactctcagcctctattttccttatttgtaaagtggtaagaataataatatataaatcataatgttgtttgaagaattagtagggtattaattatattaacaggataatagataatgggataatataagaacaatcctattagtaaaagaatattaataggataatatataactgttagaaaaaatagttcttagtaaatggttgactctattaccataaccattacagagtactgggga

SEQ ID NO: 67677 - DNA, 601 bp, Human
tttcaaaataacagctcaaacattatctccaccctcaaattggtgctccatgggtaaacttaaaaagagggttcttaaagaattatttattttttagatcacattctattattcgcaatgctatgtataaatccaccatctgtgcgatcataggagcatacttagcactgtaggcaggagttctgctgtatctatagttataatcagagactcaaccagtcccgttctgattcaatcagtggagaaaaaacaggtaaggggctccaagcaaggtagggaacagggatggggcaaaaaaacycatgggaattatttcttttcacaaaggaagagaagctacccagaatagaatccatgagtaacactcatcgttataactgaattaagaataaaaataactctctcctaggatttaagcacaggatctaggtacagatttagatttccgtcactccactaactcgttgtgtgagcttgtgcaatttgtttaacgactctcagcctctattttccttatttgtaaagtggtaagaataataatatataaatcataatgttgtttgaagaattagtagggtattaattatattaacaggataat

SEQ ID NO: 67678 - DNA, 601 bp, Human
ggagaacaccacataagccagcatcatcacaaattaaatagtggctcactttggaatctgctcaaagtgaaaaatagtttttcaaaataacagctcaaacattatctccaccctcaaattggtgctccatgggtaaacttaaaaagagggttcttaaagaattatttattttttagatcacattctattattcgcaatgctatgtataaatccaccatctgtgcgatcataggagcatacttagcactgtaggcaggagttctgctgtatctatagttataatcagagactcaaccagtcycgttctgattcaatcagtggagaaaaaacaggtaaggggctccaagcaaggtagggaacagggatggggcaaaaaaactcatgggaattatttcttttcacaaaggaagagaagctacccagaatagaatccatgagtaacactcatcgttataactgaattaagaataaaaataactctctcctaggatttaagcacaggatctaggtacagatttagatttccgtcactccactaactcgttgtgtgagcttgtgcaatttgtttaacgactctcagcctctattttccttatttgta

SEQ ID NO: 67679 - DNA, 601 bp, Human
gtgttgttactaagtagaaactgagaaaaaaaaagtgtaagcctgtgtgtttttattgcaggggaagttgtgggattaaataattttaagaacgactgaattcaaaaggttttatatattacagaacttttcaaggccttcaaaatgttgatcagcattattaacctccacagggggaaggagattcttggtaagtcttgtcagacatactggtgtgccatgaatcatcattcaaaatgagtgatccacaaccatgcgtttggaaaagctatttcagagtttgaccaatcagtaacaatcytctcttcagtctttcagttttggacacagctacttgacaataattactataaatcatggttatattgactgtcagtttgatagatgcaagatagaacaccttatttaggcttggtttgtgtcggtgtatttttcagtgaacgattttattttcccaacaatctatacaggccagtaagctacgcatttaaaagctgacaaataggcatgatcttctggttaattttaggaatgagcatgcacctgtctaatgaggccttggaaactaatcctaaactcctggtttttctttgcattttaa

SEQ ID NO: 67680 - DNA, 601 bp, Human
tgagactacttccatgtgtacctgtccagggtagaactcagggtaaaaaagagttctggcctcatgcttatcttggaatttctcatgaatgccccaaagtaggtcagagttgaccatctggcaagtaaagtgggctatggagattttccaatagagtgacaccatatttgggggattttgttctaacccggaacatgttcaatgagaaattgtaaaacaatgctttatctcatcctgtcacagtgtagtggggcaaactctcacttccttcaggaagtgtggcaaaaatgtggcccaattyaacagaagcatctggaactttcatctgccctttgattcttggctaccttctctttgccttcgtcaccatttccttgtggaaaggttattttccatcctggatgaagaaggaaggtgtcctgcctccacaagaaaacatgccagcagcttagcatggcagagtggctcaagtgcccctgacagtaacatcatccccagaatctgagcagagaatcttgaagagtctatggaaagggcatagcgcagccttagaaaagttctcaaaatgctaccccctgctttgtagtctctccctggatgg

SEQ ID NO: 67681 - DNA, 601 bp, Human
gaatgacagccagaggtgttacctttgtgatgattttaccccgatagtcaatctgaaattcaagctaccaaaaggaaaaaatttttttcaagtgtattaaaacctgtgtacattattatctgtaaataaaggctcttaaattccttgctatattttatacaattcaattatacactttaaaattagatttgaatctataaatctctgtcacctttgtatccatactacctgtaatgagattatggggggacacagtaggtattcagtgtgtgctggccaatcgtctggttcttttaatacmctaggaatatgatcagcagtgcttaaatttaaaaagaaaataaataatattcttaaactaaatagaatattctaaataaatgaccttaaaatgtattttgttgattagatttagaaatccaaaaagggtgatttccttgtactcttcattggatttcactcttgactgttcactcatcactgcttagaaattgtgtggtttgttggttaccaatgtcctgagactacttccatgtgtacctgtccagggtagaactcagggtaaaaaagagttctggcctcatgcttatcttggaatttc

SEQ ID NO: 67682 - DNA, 601 bp, Human
caacatgccacctatgcaaaaataatggggcaaaaccaacatttctgttaaaaatatatgccttatctatagtcaactggtattcatagaagagttgagttcttttttctttcttaactcgaataccatgaagcccaaagccacagtcagttgctaaaatctaattttaagccaacatatccatgtgtttttcatggctgccaatgtacatagaagtcacagaatgacagccagaggtgttacctttgtgatgattttaccccgatagtcaatctgaaattcaagctaccaaaaggaaaamatttttttcaagtgtattaaaacctgtgtacattattatctgtaaataaaggctcttaaattccttgctatattttatacaattcaattatacactttaaaattagatttgaatctataaatctctgtcacctttgtatccatactacctgtaatgagattatggggggacacagtaggtattcagtgtgtgctggccaatcgtctggttcttttaataccctaggaatatgatcagcagtgcttaaatttaaaaagaaaataaataatattcttaaactaaatagaatattctaaataa

SEQ ID NO: 67683 - DNA, 601 bp, Human
ttgggatggctgctgcaaaaaccatcatcaaccttctcagtcttcccatccagcctgctatatttggcacagtagatgtccaatgtgcggtaacccaagccacactgggcactacattcactcctgctggcaacatgccacctatgcaaaaataatggggcaaaaccaacatttctgttaaaaatatatgccttatctatagtcaactggtattcatagaagagttgagttcttttttctttcttaactcgaataccatgaagcccaaagccacagtcagttgctaaaatctaattttaarccaacatatccatgtgtttttcatggctgccaatgtacatagaagtcacagaatgacagccagaggtgttacctttgtgatgattttaccccgatagtcaatctgaaattcaagctaccaaaaggaaaaaatttttttcaagtgtattaaaacctgtgtacattattatctgtaaataaaggctcttaaattccttgctatattttatacaattcaattatacactttaaaattagatttgaatctataaatctctgtcacctttgtatccatactacctgtaatgagattatgggggga

SEQ ID NO: 67684 - DNA, 601 bp, Human
ttaagaaacaacacacaagctggccaactctagttattttggtggagatcttttcatgttatcagtttgcttaccaggtttataattaaactcaaaattagctcattggcatataaaaataaaaccggaaatggcttgtagagtatgcaaaagaaatcagttgagttgttccacttcttccaaatttccacacgtcatgcccatgtcagacattacaaatcaaccatgctactctattctggaaagcttgaatggggtcaggcattacaaatcaatcacggtcatctcttccgcacagccyaaatggggcttacacacctgcaaggagccaccatcaactaatcagacagcatccaagaagactctttgagtgagagccaacttacttcagtccaggcagaatagcgccagccacccgtgttacattcccctgagcatttttcacggttgcttggtttgggatggctgctgcaaaaaccatcatcaaccttctcagtcttcccatccagcctgctatatttggcacagtagatgtccaatgtgcggtaacccaagccacactgggcactacattcactcctgctggcaacatgccacctat

SEQ ID NO: 67685 - DNA, 601 bp, Human
tggtttctggggttatttattgatgagtaggaacaggtgtgtccctttcccacagcaatcactctcccatagcaatttgtaaatatactaagcctcatttttttccttttgttcgttcatttattcattcattctatatttatagtctctgggccagttttgagcacaaaataaactaaacacagctccatgctataaaatttgaaaaacaacattcataattttatagcataggagttaagcatggggaattataaatcacatcaacctaagttttaacacttatataaccagtcacaaratctctctgaacctcaattttctcatctgtaaaatgagaattagtgtctactgcaaagggttgtgaaaactaaatgaaacaaatacaagtaaagctcttggcacaatgttcatttaataaatgccaaatgtaatcatcattttatccatacttactgtagaaaatttgaaaactgtagaaaaacataaatgaaaaaattataatgacccaaaatctcgctacccaaggataaccattatcaatattttattattttctttccagtctttttaagcaactttggattatagtgaatttaca

SEQ ID NO: 67686 - DNA, 601 bp, Human
aggaaagaatgtagcagttaagaatcttatcgttcaaaatacctgtccccagggacccgcctgccaggatgcacattccggctgctgacaagtctgcatagatgttggcttggtctcagggtcacacattctatcatttaatcgatcttcaccaaactgacaccagacctggcggtgcttatgcccttttccacaggtgaccaagcactgtaatgaaaagcggagctagtcagggtcatttctgatcaatgtgttgtggtttctggggttatttattgatgagtaggaacaggtgtgtccytttcccacagcaatcactctcccatagcaatttgtaaatatactaagcctcatttttttccttttgttcgttcatttattcattcattctatatttatagtctctgggccagttttgagcacaaaataaactaaacacagctccatgctataaaatttgaaaaacaacattcataattttatagcataggagttaagcatggggaattataaatcacatcaacctaagttttaacacttatataaccagtcacaagatctctctgaacctcaattttctcatctgtaaaatgagaattag

SEQ ID NO: 67687 - DNA, 601 bp, Human
aagaatagctcaagttaagactgtggaacctacagactagaggacttggaaaagattatttccaagcatgagggttttgcaacctttgatctaattaattatgtttgaagagtctggcttatttatgagaggtgagctttgtaattgtgacattgggagccaaaatatcttttccaaatctcattccagaccttcctgccagagactctggtgctggatcaccttctgtaacagacccacagaggcacgctagaagataacatcagccagacatgaaatctgttgtgaatttgttcaaacrctcgtctgctcaagctaaagggcaaagataggcacgtgggtctgtaaaagggtaatcagctccaggagggcaggcagcaatccttggaaggggggcaaaatggttgcagagttacatgtgcttgatccagtgccatggaggtgtcctgcatgccacccggcacagcggttaaatctccaccactggaatgctcctttgcaagtcctctccagataagaaggaaagaatgtagcagttaagaatcttatcgttcaaaatacctgtccccagggacccgcctgccaggatgcacattccggc

SEQ ID NO: 67688 - DNA, 601 bp, Human
gacagagtgagactctgtctcaaaaaaaaaaaaaaaaaaaaaaaaagttaaactcagaattacggtatgattcagcaactccaatcctagatacacatccaaaagaagtgaagccaggtactgaaataaatgcctgaaataaatattcatagcagcactattcacaatagccaaaggtagaaacaaccgaaatggccattgagggataaatggataaacaaattttggtatagccatacaatggaatattctttggccaagtactgatacatgctacaatatagatgaatctagaaaacaytgcggtatgtgaaagaagttaggcacaaaaggccacaaattgcatgattccatttctatgaaatgtccagaataggtaaatccataaacacaatgcagactggtggttgccagggactgagggaagagtggggtggggaacaaatgcttagttcagtggtccccagacttttgggcacccaggaccagtttcatggaagacatcttccacagatggggtgggtgggggtggttttgggatgaaactgttccacctcagatcattagacattagattctcataaggagttcacaacctaga

SEQ ID NO: 67689 - DNA, 601 bp, Human
acaaagctgggggaatcatacctcacaatttcaaaacatactacagtgatcaaaatagtctactggcataagaatagatgtatagactactgacataaaatctagagtccagaaataaacccatatatctatggacaagtgactttcaacaagagtgccaagaccactcaatggagagagaacagcctcttcagcaagtggtgttgagacaactggatacctacatgcaaaaccatgatgttggaatcctgccttatgctatatacaataattaacccaaaatggatcagtggcccaaacrtaagagctaaaactagaaaactcttttaaaaaatggcagaaaaacttcatgacattggattcggcaatgacttccttgacatcataaacaagggcaacagaaaatagacaaattggactacatcataatttaaaaccttgtgcattaaaggacactatcaacaaagtaaaaaggcaacacaggggatgggggaaatatttgccaatcatatctctgataaggaattgacatctagaacctacaactcaagaacaacgagaaaaacagatcaaaaaatgagaaaaggaacattattgaatt

SEQ ID NO: 67690 - DNA, 601 bp, Human
actaaaaactataaaactttgctcaagaaattaaagaagacctaaataaataaaaagatattacatgtctatggattaaaagatttagtattgctaaggtgacaatattccccaaattaacccacagattcagtgaaatcccaatcaaaatcctaatagcatttttgcagaaatgaaaaagcggattctcaaattcatatggaatgacaagagaccccaaatagccaaaatgatattgaaaaagaacaaagctgggggaatcatacctcacaatttcaaaacatactacagtgatcaaaayagtctactggcataagaatagatgtatagactactgacataaaatctagagtccagaaataaacccatatatctatggacaagtgactttcaacaagagtgccaagaccactcaatggagagagaacagcctcttcagcaagtggtgttgagacaactggatacctacatgcaaaaccatgatgttggaatcctgccttatgctatatacaataattaacccaaaatggatcagtggcccaaacgtaagagctaaaactagaaaactcttttaaaaaatggcagaaaaacttcatgacat

SEQ ID NO: 67691 - DNA, 601 bp, Human
ttactacagctaataaacaaatttagcaacattgaaggatacaagataaacagaaaagcctattgtgtttctatacatcagcaatgaacaatcccaaaagtaaatttaaaaaaaaaaattcaatttacagcaacatccaaaagaatgaaatacctaggaacaagcttaaacaaggaggtaaaggctttctacactaaaaactataaaactttgctcaagaaattaaagaagacctaaataaataaaaagatattacatgtctatggattaaaagatttagtattgctaaggtgacaatatkccccaaattaacccacagattcagtgaaatcccaatcaaaatcctaatagcatttttgcagaaatgaaaaagcggattctcaaattcatatggaatgacaagagaccccaaatagccaaaatgatattgaaaaagaacaaagctgggggaatcatacctcacaatttcaaaacatactacagtgatcaaaatagtctactggcataagaatagatgtatagactactgacataaaatctagagtccagaaataaacccatatatctatggacaagtgactttcaacaagagtgccaagac

SEQ ID NO: 67692 - DNA, 601 bp, Human
ttgcccaaagataacatcagaatcccagaatgtcaaatgtagatataaaaggtgtattcaattggccaatgcctggacttcatataacacccctcaatcatgcagacgaagtccctgttatgaactgaggtcatctgcgtacaggtaatattccaagatatgcaaacaggaacaaaagtacacacctgctcatattcactctcagcctcagtggttaaaaattatcctgtgacttaatacatattcatcaaatgcctgagtgtgctgtacacagtgcaaaagtgctgaggcttggtgtcamatatgactgagacatctttgccttagaaaatctatgtgtggaatgtgaaattttgttacgtggctccagactttgcctattcctctgtttttggtccaaagaaagccaccgggaactttttacaaagtgaaggaattattcacatactgcaatggtgggagccatcccatagtcaaatggatataatagaataacttaaagggaaatatattttgaatctgaaagggagcagccaagtcctcagttcatgattgctttagatgccatagctaacattttccaggcattcatcatttggaa

SEQ ID NO: 67693 - DNA, 601 bp, Human
caatgtttcccccattccccctaattccaaataatccactggcttacagagctccagtccaaggccttccattgcccacagggtgtcacagaacattcttcctttgccactggtctaggcagggtagcacaggcactctcgtcagccacagagccattctcatctcggcagctgacgtatctcatccgggtacctttcccacaagtggctgagcactgggtgttggagtaaaatcatgcagttatattacgtggaatggctgcttactggacagtagcccactttctatagccatgtctgrgaatgttagcccccatcctgccctccccatttctcccagtctatttcttactggggtccaagacccaaatcgccactgggttcttggtgcactgtatgtgcttctcctcgtttccggggcagctgggggaggatgacatgatggtaattcacagtcctagacgtgatgggggaaaaaaaaacaaagtcactttcaagtcaatgcactttcaaggtaatggtcatggtggataaaaatgtaaaggctaagaattctaaggcttcagatttctgtgtgaatctgggcaagtcacatgacatc

SEQ ID NO: 67694 - DNA, 601 bp, Human
acagccctgtaaagtagtattcttttccgtcttctttaagagcagagcacactgagactcatggacttaaaccacattgctcaaggccatgcaacaagtaaatgccaaggtctgggtttttacacagctctgtttcattgcacctctcaaatttctctctctatattatgatatttattgagatattaatctccattcttcttatgccctctcctcacctatactaatgtatttcttgaactctgggctttttgcagggcagaaaacaagaagctgcctaaagataaaagttctacttgtaaaaaaaacccatagatagtgcttggtgtacagcaggcaggttcacagcactggatgaggattcccacttcccattcttgtcaggggaaaccaagagccacttgatttttagggaccacaggatgcaggaggaatctagactcagagtaagagcctctcccctcactctcctgacatttttggtcctctacaaacctactgcatactaatatgactcagtgaagactgggatttctgatcagcccaacaggacagacactcaagcagactgtaaaccgatttatccattttttgaaatgtg

SEQ ID NO: 67695 - DNA, 601 bp, Human
cagtgagaaatctgtcagctcagtattcaaaatcacaaaatataaccctttacaacaaaagtcaaatcctatccttccttccagtgattttccaactcatttgaataatacccaaaatccttacattgatctactagaccctttatgatgtggccactgactacccctttgacccatctaccattcgccactcactgcactccagctatgctggccttactgatgcttcctgaacaagccaagaacacttccatctgagggacttcatacctactgcaccttttgctgtaccacttaaatwcccatgtgtgtcattccctcacttcattcaggtcctgctcaatgtcaggccttttttgaccaccctctctaaaagcacatcccatctttctctattccacttctcctcttgacctctttctaggacttatcagtacctcttgctatattacatacttccttatttgttcattgactggatcatccattggaataatctccatgaaggtaggggctttattattcattcttcactgctctttctctagcaagctttcacaaatatctggtgagtaggcagatggatcttagagaagatgaa

SEQ ID NO: 67696 - DNA, 601 bp, Human
caaggcctccctaatttgaaggacaatgataatgataataataaagacaactgtcgacatttattaagttctcactctgtggcaggcggggcgcaaagcactttatctgcatcatcttatttaattcttacagcaacccaagaaagcaggaattattgttatcctcattttacagataagaaaactgaggctcaaagaggagaagggacctgcagaaggtccccaaatttagaagtgtaagtcattggatcaaacctacgcatcttccctcagagattgtgctgataaccttaaggttagrgtacttctctcctaagcacaaatcttacctagtctagtatttccccctaatccaggacaatgacctactactacaaattacacagcaaccatgccactttgagactgcacccttctggaaaatagtagaggggaaagtgactttcattaagaattccctttcagaaaagtttctctgtcttcttaattcccctacaggtatgagctgcctgtggcctccaggatgaatcctgatggtatttacggtacctccaggaggccatgtgatcatatcacctagccatgatatcccctttctcca

SEQ ID NO: 67697 - DNA, 601 bp, Human
ttggcagctgttctgcacacaaccagcaaagacagtgggtgcaaatgctcagtggctaattagtattcatcagaaagtacgtctaatttactgaaacataaccgcagtgggaaacagacagcttccttctaattctttttagcccagaaacaattaaacagaattagcagtactagaaggaaactaatagtaaacaattaaaaagaagacccctgaataattagtaaacacctaactacgtccctacccaggatcctttaaaaccctccccctcctgcagttccatttaacatgtctggtrttgcacagcatatttttttttaattatttagtaaaaacttcaaaacattccaaagcatacttttcctttgatatcagatatttgtcaaggcctccctaatttgaaggacaatgataatgataataataaagacaactgtcgacatttattaagttctcactctgtggcaggcggggcgcaaagcactttatctgcatcatcttatttaattcttacagcaacccaagaaagcaggaattattgttatcctcattttacagataagaaaactgaggctcaaagaggagaagggacctgcag

SEQ ID NO: 67698 - DNA, 601 bp, Human
tttttttttttttttttgcaaaactcctaattgctaacacaccttgctcaagtgtatacagaaatctattataaaatgaagttcttactccagaaaccactgaaaaacttgattcccattccccagtgtttataaccctttgccgccttttctgccatggaaggcaggaagaccatgtacagtttgtgtaccatgcaatgcaatgcaaagatgacgtacatccttcatcttcctgggagcaggtcagacacgtcaagctagggctgaaaatcacattgtccagcttcagcctcacttaacktaggggaaaaaatatccaaacaaaaaacaggcacaatgaggaaaagaatggtattacccatcgccacaaaaagcttacctaatcctccctaattgggagctctgcccaagggcagaatcattcaatcttaaaggaatgcatcatccccaaatgtagtcctaaataagcacagcactaaaacactttctttaaatcctagcgctatcattagactacacatgtgtgagttttgaattttgtcaacaaggaaaaaccatgagacactcggtgattacttccttggatcaccttttactttct

SEQ ID NO: 67699 - DNA, 601 bp, Human
agtccctgtcctctttaaatgacaacattttcttaggtaaacatttatttgaacaaactttgaatctattagtaaaacgtacttgaaatttgtcatccacaatggacaaaataaaggagaatggcctttagagaagcaaagggagacagatatttgtttttttctacctgctcaaatcaacatccttttccttacatctggcagcccaatttcctttaagaaaacattcctcctcatggcagatgccatcttcatctatcaattaagacactctgccctattgtggtcagaggtgggcaaytggactttcctgggaatttgaatcctcagcagaataactcaagagtggcaaaggcttaaaagagattcattaagacagaaactctctaaagaaattatcccttagttacccctctatctagatcaagggttggcaagccacagcccaaagaccaaatgtgtgcggccacctgtttttagaaataaggttttattggaacagagccatgtgcacttatttacatattgtctatgcctgcttttgtgctgcaacacacagctgattagctgtgacagagactgtatggttcacacagctgaa

SEQ ID NO: 67700 - DNA, 601 bp, Human
tgtgtccctattaccttccatagtgctggtcacaggatttgctacctggtccagttaaagattctggaagaaacagctctagaaactccatggtattctctctccaatatgtctgatgggtgcaaggatgaacacctgatccatggtcaagcaatccactggccacccagggagtgactggatgcttcctaccgagaatccaactgaagtgctggtgatagctctcagcttgggccaagcagttgcactgcacattcttgagctatctgaatcctgagcctgcttgggtctttatactccyacagacagatgaagtattgtacataacctttctccaggtctaattttgccattatttgattaacagggattcttagttccatttctccatgttgcagactttcagtctggacttttgttaacaaagtccctgtcctctttaaatgacaacattttcttaggtaaacatttatttgaacaaactttgaatctattagtaaaacgtacttgaaatttgtcatccacaatggacaaaataaaggagaatggcctttagagaagcaaagggagacagatatttgtttttttctacctgctcaaa

SEQ ID NO: 67701 - DNA, 601 bp, Human
cttcttccgtatcaagatgtgaatacattttgttgctaattgaactggaccactgttaatttccctgcccatgctggtcaaattataagtgtttttaaatcagtatctacactttcattttatattgggtttacttttttaatgtagagctggataatagatttattagttcctcttgagaaaatatttaggtatttttcaagttataaaaatgttacctctatctttgatgattctggtatacttactctaaatctcaaaatattcatttcctattttttttttttttttgaggtggggytttgctctgtcacccaggctagaacacagtggtgcgatcacaggttactacggcctcaacctctcagctcaagcaatcttcccacctcagtctcctgcatagctggagaccgttggtgtacactaccacacctgggtaaatttttaaaatttttcgtagagacaaggtctcactatgttgccccaactggtctcgaactcttggcctcaagcaatcctcctgtcttagcctcccaaaatgctgggattacaggggtgagccaccatgcctggccttacttcctaccttcctacttttaag

SEQ ID NO: 67702 - DNA, 601 bp, Human
tcaaacattgcttcttgctggtcatcttcttccgtatcaagatgtgaatacattttgttgctaattgaactggaccactgttaatttccctgcccatgctggtcaaattataagtgtttttaaatcagtatctacactttcattttatattgggtttacttttttaatgtagagctggataatagatttattagttcctcttgagaaaatatttaggtatttttcaagttataaaaatgttacctctatctttgatgattctggtatacttactctaaatctcaaaatattcatttcctattttttttttttttttgaggtggggttttgctctgtcacccaggctagaacacagtggtgcgatcacaggttactacggcctcaacctctcagctcaagcaatcttcccacctcagtctcctgcatagctggagaccgttggtgtacactaccacacctgggtaaatttttaaaatttttcgtagagacaaggtctcactatgttgccccaactggtctcgaactcttggcctcaagcaatcctcctgtcttagcctcccaaaatgctgggattacaggggtgagccaccatgcctggcct

SEQ ID NO: 67703 - DNA, 601 bp, Human
acggatagttcactctcacctctccccagttgccataagcccactgaggacaagggccggattcacaggctctttgctcatcaggttttattctctccacacagtcgtttgcggtgtatccattttcatcctgacatacaacaacacgccgctgggatccgccagcacaggtactggaacactaaacacatcagtcgacaagttaatccccacctcaatctccatcttagggacacagaagcagctggttgaaaggttaagacaaatgtgctgaaaagcattctcaagtcatccacgaagracaaaaagcaatcaggaaaacccaagaacttccccactgtggggctgtttcatgtacacatcctatagacacacctggagggcagaaatgtgtcttctcttctggtgtgcctcaggccctctacaggggttccataaatgcctaatgtgacttccaaagcaggccacttactgtctttatcccctctgcatctctaagaggtacagaggtgttgatggacacgacagttaatttggaaattcttttcaaaacttcaagtgcctatttagaaccaatatttgattttcctttcaacgcgga

SEQ ID NO: 67704 - DNA, 601 bp, Human
cctcatatcatggtcataaatactaagaagttggtgctattactatccttatttacagatgaggatataaatatttggcaaagatactacattatttgccaaggtcacaaaacttttaagagccagagctgagaacaggacacggttttctcagcttccaatactcagttgtcccctatcagtcgtcacaggcaaccctgaaaaggtagcagctaaataattccatatttgagaaaacacagctaactactcacttctgcaataaaaatacatcatctttcataggaattataacacctaytcaatctggcttcattagtgacttggaatgttgggagacattatgccatgggaacagggcataacacaaacaccccaaaactatgaagaagagggcaagacttccatggaccgatttaacacatattttcaatcactttaaaagcatctattttttaatcatcagaggtgaacaaataacttaaaccagtatttatctgtattctcacctaattttcctcacctgtgtacccaaactgtctcttagtggtaataggaacactttaaaatagtccagaatttaagaagacaggtttcctag

SEQ ID NO: 67705 - DNA, 601 bp, Human
aggatgtggactaacatgcccatcaatctcatttgtctttttcccccccttggcactgggacctccaaagtgttatttctcgtgttttatttgataaatgttatagtcaagacagaacaactcaacaaactttaaatatgtgctctccctgtggattcaagaatagagagatatattcttagttaattaaacacaaaacaataagcatctaggccctatgtataataagggctcaaacccccacttagtcacagtattattaataattattcttaacattaattattactacattatagtrgcagttaattgattaaaggcgatgtgctacgcatttgatagatactacctcatatcatggtcataaatactaagaagttggtgctattactatccttatttacagatgaggatataaatatttggcaaagatactacattatttgccaaggtcacaaaacttttaagagccagagctgagaacaggacacggttttctcagcttccaatactcagttgtcccctatcagtcgtcacaggcaaccctgaaaaggtagcagctaaataattccatatttgagaaaacacagctaactactca

SEQ ID NO: 67706 - DNA, 601 bp, Human
attatctaatcaagaggagtgtaattatttgccccatcttatatatgaagcaattaaggtgaagggaggttaattaactcgatcaagtccaatctgttagcaagtaacaaagatcctttctttttttttgagacggagtcttgctctgtcatccaggctggaatgcagtggcacgatctcggctcactgcaacctccgcctcccaggttcaagtgattctcctgtctcagcttcccgagtagctgggactacaggcgtgtgccatcacactcggctaattttttgtatttttagtagagayggggtttcaccgtgttagccaggatggtctcgatctcctgagctcatgatcctcccacctcggcctcccaacaaagattctttgagaaataccaaaccaaaccaaaacaaaacaaaacaaaaatagacaaacaaaaactacccaataccaaacaaaggagacaatgacttaactggttctattttctggcaaattttaagaagctgtcaccaatccttggctgttctctgactccgtctccatagccctttatgacactaacctattttactgtatctctgaatgtgaggacaactatga

SEQ ID NO: 67707 - DNA, 601 bp, Human
tgcactgaggacttttgcatatattatctaatcaagaggagtgtaattatttgccccatcttatatatgaagcaattaaggtgaagggaggttaattaactcgatcaagtccaatctgttagcaagtaacaaagatcctttctttttttttgagacggagtcttgctctgtcatccaggctggaatgcagtggcacgatctcggctcactgcaacctccgcctcccaggttcaagtgattctcctgtctcagcttcccgagtagctgggactacaggcgtgtgccatcacactcggctaattttttgtatttttagtagagacggggtttcaccgtgttagccaggatggtctcgatctcctgagctcatgatcctcccacctcggcctcccaacaaagattctttgagaaataccaaaccaaaccaaaacaaaacaaaacaaaaatagacaaacaaaaactacccaataccaaacaaaggagacaatgacttaactggttctattttctggcaaattttaagaagctgtcaccaatccttggctgttctctgactccgtctccatagccctttatgacactaacctattttactgtatct

SEQ ID NO: 67708 - DNA, 601 bp, Human
tgctcttaaaatatctgtgggggagggtagtgatcctgtgtaaaaaaaaatttagcgtatttagaaagtgtttaaggaagagaataccatggaaattaatttataattctctaagacttatgtttttccccctgttttcccaaataattcttcctggagaggtaaatatagaataatcaatggaactgagatgatcaatggaattgagtctgggaagggaaatgcaggtttctttttttcaccaaaccacaagaatatgcaataaatagccttgtgtgtttcttcctaagggttaagagatttttttttttttgggtcaaagttaatgaactacgactttgtggacagctagtagactttctaaaacataactctggtactggtattgctgttggtctagtgaactgggtgaaaacacaatgagcttaagagggaatttcacgaaaaataatatataataggagatgagggaagttgggaatgtcagaagatgttcctgagattctaaggttatttctgatcttcaaaaatgttcatctggggaaggtgccattattgtagggaaaatgctcctactgaactgactagagatacaacagac

SEQ ID NO: 67709 - DNA, 601 bp, Human
cctaggttcacagaagcttcattttagggatgctggaagctatattaatagtgatttggggtttctctcctaaatactgctctttagtaacaagtgttgaagtaggcaatctccattttgaccttggagaaggctaattcacacagcagcagttgcttcttgacatcatctaatgcatgggagtactgggagagagaaagcaaccaggcagaaggattaattgctacccttggtccctaataaatctaagttgctttctgttgaaagcaacatgttagcacctccaacatactttttattkttgttagtttcaccgtcagttacaatgatgaagcaccatggaagtggctttatggctattaacacaattactgaggtatgcttacatttggaattactaagatattataccaaagcatccacagaaataaacacacaattaaaatcaaaactctacagtaagaatctgaaagactgccctctcactcatatatttaggaaaagtaatatattacaaagatattttaaagaaaatgcttttgatttaattttttaagatcacaattaaaagccttgcagaagtggccttgctcttagactg

SEQ ID NO: 67710 - DNA, 601 bp, Human
gagccgagatcgcaccactgcactccagcctgggcaacagagcaacactctgtctcaaaaaaaaaaaggaaccttatttcaaaaacaaacactaccaaaaaaagagtccaaaggcccattttaaaaaggatagaaaaggttgaatttctggaggatatttctcaccatcatgattcttaaatccgcaatgacttgagccagaaccaatggctgatctaagatggggacttaaaccctaggttcacagaagcttcattttagggatgctggaagctatattaatagtgatttggggtttctytcctaaatactgctctttagtaacaagtgttgaagtaggcaatctccattttgaccttggagaaggctaattcacacagcagcagttgcttcttgacatcatctaatgcatgggagtactgggagagagaaagcaaccaggcagaaggattaattgctacccttggtccctaataaatctaagttgctttctgttgaaagcaacatgttagcacctccaacatactttttattgttgttagtttcaccgtcagttacaatgatgaagcaccatggaagtggctttatggctattaacaca

SEQ ID NO: 67711 - DNA, 601 bp, Human
cagggaccctccttaccttggtcctttcacccatgaataccataataacctatactgcaaaaaggaggctcaggaggaggatgaggtatcaataggcctccgggtcatttttatgatttaggtattttttgaaaagggtaggctctcttgaaacttccaaggtagttgttgtagtattttattttcctttcataagaaatgctttctgaaatgtattgcagtgaacaaataacaaaattgacaaatgctgtaagccttttacagttatctgaacacacagaataaagtgtaatcaaatttrtgcacattaggtttgctttttcctgtacctagctgtctcttatgtgttcagaaccatttcttccaatcacctttttttgtcttctggctataatttatcattatctacaaattcaataaatggagcatgcatatttcatagttgagattcaataattcaggacaacagtactagaaaagaaaaaatacccaacaaaatattaagcctcatatatttttgtttataaatctaagcatcatttccaactcagaaatatgtttttaaagtatccctttaaaatacatacttgaagctgtctaa

SEQ ID NO: 67712 - DNA, 601 bp, Human
acctgtggactttttaaatccatgaaaatagaacctgtcaagctaccacaaaatagcatcagaaggcaggatcagtctttcataggcatacaatctctgtaaatactgaaaaaagattattaaaagcctgctaagttttgtctccagtgaaatagatgcaggcaagtattttgattgttctgaacacattagagatgagtgctacacagaactaaggtaaactttgtaaattcgtatgtcataacactttgttccacaaaaaactatcttattttttatactccatactgatacagccaartaatgtggctcttattttctaaagatgccagcaatatgtttaaacatgtcttcattgtagtaaaagtatcatatttataaaaaatacatatgcatttaatgtgatattccttatagtcaaaatcttgatatcatcctgttaatctggctaaaaatgtatctgtaaaatgaaagagaggaatattttgccattccctaaacaacagttgtttgaagcttttgtaattgctggttatgggaatttaccaataacaggaatgaatttggattttcttttgctggaatcaaatggacaatgtca

SEQ ID NO: 67713 - DNA, 601 bp, Human
gcacgtttaaaagcaaagataaaattgctaatttatacttactgaataaacatcagcagtatccatgaaggtacctaccctaatagcaagttgtatttttatttttatggtggtggcgaagctgccaggaaaaccaaagcatcagttctttaattacatttgtttagtattgatttaatactaaaatttctcttgctcccttagaacaaagagctctaacttgtacactgctgtatccttagcacctggaacagtccctggcctacaataggcacttagaaagtatttgttaaaaattgattttttttttttaaagaaacaacccagagtttttttattctgccccaacccccaacccctggcattaaaataaatcttcctcaactgccatcactaatcgccaggattccctcctagccaattatgcttggactcaacctctacctcccactccacattccaaagtttctatttctttccattccagaagggcaactccacaacaggagtgagggagaggacctggactcctcctcagagtccaataacactcctaaccctgctcccccaacctgtggactttttaaatccatgaaaatag

SEQ ID NO: 67714 - DNA, 601 bp, Human
ctgtgccatcagccaggcagcatctgtcatttaaaatgactggccagttgcacgtttaaaagcaaagataaaattgctaatttatacttactgaataaacatcagcagtatccatgaaggtacctaccctaatagcaagttgtatttttatttttatggtggtggcgaagctgccaggaaaaccaaagcatcagttctttaattacatttgtttagtattgatttaatactaaaatttctcttgctcccttagaacaaagagctctaacttgtacactgctgtatccttagcacctggaasagtccctggcctacaataggcacttagaaagtatttgttaaaaattgattttttttttttaaagaaacaacccagagtttttttattctgccccaacccccaacccctggcattaaaataaatcttcctcaactgccatcactaatcgccaggattccctcctagccaattatgcttggactcaacctctacctcccactccacattccaaagtttctatttctttccattccagaagggcaactccacaacaggagtgagggagaggacctggactcctcctcagagtccaataacact

SEQ ID NO: 67715 - DNA, 601 bp, Human
aattcattcactgtctgagatatttcagaagaaaatggcttagggagaatcatttgaactatttctcattttagtgcatagtcaacctgagagtgagcatagtagattaatcagtgcttctaaaaacagaccatctgtcagattataatttaattcaggatgttgccctaaacggggggaaaacactctatctggccactgaggaagagaactgatggcaattatcagtcaatttgcagtcaatgttgttgcataagtttaaatttcttggggccctcagtatagagtaaaaatgtaaatraataagaggtttttttctttttgacactgtagacattaagttttgcaaaattaaatgactacatttacagtcatggaggagagacattgcctcaactcggtttcttctgatgtgtctttgaaacagagccctgcaaagctaatctgctcaaccttcacctactgggttcaatgaatatgaaaagctgccttcctgaaacttttccttcaaagagggaatgatctcctggaattcaagcttctacaaggtggctacctggtgttttccacttttgccgtctcctaaaaagcatcaatcaag

SEQ ID NO: 67716 - DNA, 601 bp, Human
ctgagtccccaattgccaacatttcaccacatttgctccccccatctctctctctatatgctattattattttgtctttccctgaaaaatttgagagtaatttagagacataacatcccatcatctctaaaactcttttttcctcaaatcaaggacactcttttatgtaaataccgtacaactctctaagtcaggatatcatcattattaatacaacagcactaaataatcctatgcctttctttttaatgattcccttctaccagttagctctttacttccatatttctgggctaatgtrataaggagttcagcacctgagtagctgagctcattcattcatttcaacattgtttatagtatgcctagtttgagagaggcacccagtttgaactgtgggtttcattaggcagaaggaaattcaggtatggggcaattaaataaatgattggggaaacaggtttttcacttaaaatgtgttggctctgtctatatttcttcctctgtcctagctaagaaaaaggaagcaaacacagtctgctttttccctgttgtatttccctctgttcatcttaccaagttcccaagcgtaactgtttta

SEQ ID NO: 67717 - DNA, 601 bp, Human
aagttctcaaaactgaattgattcaaattgacttggtgaggtcagggcacacagagattctttgttgatgggagttgtaaagggcctgctgaacatccgctcaatgaagtcaggggctccagctaaaagggttaggaagcccccatctatagaaaacgtgccgtgtacaacgtgaaatcaattcccatgcacaacaatgaagatcccaattacaatgaacaaacacgttcttctgaacagaacttcctccctgacattatgtccatgaccctgcaccctgcggggggctcggatatgttaygtctgattcaaagacaaccaaaaagaaggaaataatgatttcaccaagaaaggacacataccaaggcaggaataggtaagtgggctaggtggggcttttattaatctcaaggaaaacaaacagcacacatttttgggaaaatgctttcattttcaaaggaatctggatgtggactggatagcagtcgattaagaaaaggcagagtctgcatatggccagatatttactggaatttactaggaagagatgcaataaaagtctagattcccctgggaaaagggaagcaaaaaaaatgcacca

SEQ ID NO: 67718 - DNA, 601 bp, Human
cccacccacatttatgctgtttttagtttattactcttgtcaaagttgccatgcagaatgtctgttggtcagttgggcacatctgcacacatttacaatatctgccacctcttttaaccctcaaccccgccccacaaaatgagtgatggtgcttgttgatttgcagattcacagtctggtgagacaagtttgagatctcatattttcagctcatccttgaaaacctttcttcgatttgactgaccttgatggctccctggaatctcacctacattttatgggaaattcaactctccagagmgaagagctttcagatagctgcgggacttgcaactgtgactttcagctttcgcttttgaatgaggctccaaatgtctcaatggtggcactatttccagatttggggtaagccaattctttgttgttggggttgtgctgtgcattgtagactattaagcagcattcctggcctctacccactagatgcccatagcacctgcatccccattgtaacaaccaaaactgtctccagacattgccaaatgtccaccgcaggctaaaatcacctcccaattgagaactattgaattatactaaggtt

SEQ ID NO: 67719 - DNA, 601 bp, Human
aaccgagggggtatgctattggcatccagtaggtagaggtcaaggatgctgataagcatctacaatgtcccaaacagtccctacaacaaaaaattatctggccccaaatatgaatagtgccaaggttgggaaacccttcttcatacctattcacaatccatggaacactttatgtactgctgtcttagtccctaatcagaaattatcaggtaaaatgctcactagaattaatcctacttccagaagagttctcaaaagagaaacctatatactcaactctgatgctcaagtctgaccaatycctagatactgctgacctattcatatattcatattctatcactgatatgggaagctctgtttgaaacataaacttaaaaaggaatctctatatatgaactatcagtgctatcagacaatgctaacattatgaacatgatgaggatataacccttgttttcttagaaatgcccacccacatttatgctgtttttagtttattactcttgtcaaagttgccatgcagaatgtctgttggtcagttgggcacatctgcacacatttacaatatctgccacctcttttaaccctcaaccccgcc

SEQ ID NO: 67720 - DNA, 601 bp, Human
ttctctgataggttttttaaaaacccagacaaagtggaaatgtctgactatgaaaacttggtgatctctacaatataaggatttcacttccctttgaggaggaagggaatgattttataacctcagacttctctgacttaacaaatagggacttagtatcaaatatgtctggtaaatgctgatgttctacctctctaatgcccataggaatatggaaagagaaattctgctgtgagaaattcatagaactacctggcagaaaaggaagggtgatattgcctcccagggaacatttggcaaygtctgaagatatttttcactgtcacaaccgagggggtatgctattggcatccagtaggtagaggtcaaggatgctgataagcatctacaatgtcccaaacagtccctacaacaaaaaattatctggccccaaatatgaatagtgccaaggttgggaaacccttcttcatacctattcacaatccatggaacactttatgtactgctgtcttagtccctaatcagaaattatcaggtaaaatgctcactagaattaatcctacttccagaagagttctcaaaagagaaacctatatactca

SEQ ID NO: 67721 - DNA, 601 bp, Human
ctgccattttgagtgtgtttgtgtggcatgggggttggggttgggaaatatatagcatttgccatctgctagaggagcaaagatttgcagagtggaaaagaggaggtgcgaggaggtagaactgcagaaacttgcttccccagaagttcatgtataggaaagccaagttaatgccacatatttggaaaaggtgatcccctatgtatagttttctctgataggttttttaaaaacccagacaaagtggaaatgtctgactatgaaaacttggtgatctctacaatataaggatttcacttcyctttgaggaggaagggaatgattttataacctcagacttctctgacttaacaaatagggacttagtatcaaatatgtctggtaaatgctgatgttctacctctctaatgcccataggaatatggaaagagaaattctgctgtgagaaattcatagaactacctggcagaaaaggaagggtgatattgcctcccagggaacatttggcaatgtctgaagatatttttcactgtcacaaccgagggggtatgctattggcatccagtaggtagaggtcaaggatgctgataagcatctacaa

SEQ ID NO: 67722 - DNA, 601 bp, Human
ctgtggtcttccatcaaataaagtttgaacattgcagggaaaatccaatgtttcattagagtgtaggtcccaccataaaatttctgaggttgatgacagtgtcttgggtttattttctttgcctttcctctaccaatagatttcttctccagtctcaaagctttggagtcactactagtgtttatggccattgttaatgacctttttaaaggaaaagaattgagattgattttccttctgggaccaagacatatcatctaaaatgttttctgaccctctgatctcagagttgtacctgccrttttgagtgtgtttgtgtggcatgggggttggggttgggaaatatatagcatttgccatctgctagaggagcaaagatttgcagagtggaaaagaggaggtgcgaggaggtagaactgcagaaacttgcttccccagaagttcatgtataggaaagccaagttaatgccacatatttggaaaaggtgatcccctatgtatagttttctctgataggttttttaaaaacccagacaaagtggaaatgtctgactatgaaaacttggtgatctctacaatataaggatttcacttccctttg

SEQ ID NO: 67723 - DNA, 601 bp, Human
gattataagaggattggcaataatgcacacaaaggacctggtcaaggccagggctcacatcagatgtttaataaatgagggcctttgttattattttccacttctagtcaaatccatttggccaattgcaaatgggcacctatatgtgccacatcaggaaatgtaagacaattaattgtccatcagttggtaactactgaagtggagaaggtcattcattcagagcagtgagctttttggtggtggtggtgtgtctttgtttaggggcaatttttctttttaaaaaaatttttaatttcayttaaaattttaatctatttatttatttatttagagaccaggttgtgagactggctaatttttgtatttttggtagagatgggatttcaccacgttgccaaggctggtctcgaactcctgggctcaagcaaaccacctgccttgggcttcccaaagtgagtcaccatgcctggccaagatttctcattttttagggattctttcctaggcaaaacatttgcatgtgctcaatttatagcctagaattaccggtaagattacagttaggcaaaagtcaaaattcaatttctaattttaaagg

SEQ ID NO: 67724 - DNA, 601 bp, Human
aatatcatataaaagaagccgacaagaggcagaagctaggaactcagaatactacactgccctgtaaatgcaagaaacattgacagtgcattcttagccactgatcccaccacataccctgcgtgtcatataatgttgtttcctctccctgaagatgtcatcttagagtgacatttttgtcagatgggtgcaaaaatgtatgtgtgtgtatatatatatgaaaaacagaatacaatgaaatgcaatactcaagaatgggttttatccaggccaggtattttctttcttttggctggaaacwtctaaaagcataaaactgaagattcactcttctgttccaaaacaatgtgtctcagtgatcctgatcaatttttttaataagttttctttcatttagaaaaagccttgctttctaagtataggatatccaggactctaaaaccaataccgagcccaagattttgtaaagtgaatttgatagaatgaaatcatagccaccctcctgcaaactctctacagccagtccccacgaagtctaactcttatggagagtactttttacccaaatatgaggatcaggccgtgtccagaaagaccaaat

SEQ ID NO: 67725 - DNA, 601 bp, Human
tgtctccactctccactagaaggtaagcgtaatgagttcaaaggtttttgtgtgttttttttcactcctatatccaaaatgcctagaatggtacctggtttataaaaaacactcaaacatttatggaatgtccaaatgaatgcatgaaacaagtgaataaataatatccaatagaacctagaaccacttatctcacaagaataaagattaagtaaacattctgcacaatgctcagtttattgttagaaccaaataaataacaattgctgtctcctgtctcttatatccattcagtccaaamctagccacatattcttgtggtttaatatttaactcatatctacagaactaaatgcacaggcgacatctaaagggaacattatctgagaatatcatataaaagaagccgacaagaggcagaagctaggaactcagaatactacactgccctgtaaatgcaagaaacattgacagtgcattcttagccactgatcccaccacataccctgcgtgtcatataatgttgtttcctctccctgaagatgtcatcttagagtgacatttttgtcagatgggtgcaaaaatgtatgtgtgtgtatat

SEQ ID NO: 67726 - DNA, 601 bp, Human
ctatgaatacggtgttaggacagtcagacctggtctgactggaaatatctttctttgttatttttggcaggatgcttaaccactgcaaacatctatattcaattctgtttaacagagatatgaagtgatgacgcctacacatctcaaacttaacatgttcaaaacagaagtcctgctcttcctccacaaatctgttcttcctgtaggcttccccattttaatcggtggcaactccatcctttcacttgtccagtccataaaacgggagtcattgtgacccctttctgactcttgcaccccrtagtcaactctcagctaatcctttggcactatctcaaaaattcttccaaatcctaccactccttaccacttcccttgtgaccactgtcatctgagcaatgctttctctcatctgagttactacaatggtcttaccacttccatgtgtgttcctcctgtaccctctgctaaatccagaagccagagtcaacctttaaaaacaaattcatgttcctgcttagtgcctccacccacgttttcactgccagtcccttcctatctcaaagtgaaaacaaaaactccgtccaataggctaaccctc

SEQ ID NO: 67727 - DNA, 601 bp, Human
tctatcgtggctatatccaggagtaccctggggaactgatgacaataatcaccaggcagtgttacccctcatgtgggtaacagggctctattagcctgttgattccttattcccaaacacattgcctgtttttgtaggacttcttttccctttcaaggtttaccgggtgattatttgtaacctgacatcagcagaataatgatgttcacatttttcaagaaagaggcgaagataatacaaggacccactctatgcctgccatgggattatttatgaaagccgtctggaagacagggagggyggtgggtgagaaatttgttccagaggtgagtgaagttgtgtctgagtaagtaattggtgggaaagctatgactggtaggaacagtgaccaaagtttcttggtactctcaaggtggactgtgattgaaggcctggactggagagttcaaggctacctggagatgtcagtctgctaggagatgacagtgctggggcagacccacttgacatgacttatgctactgtcaaaagcagtcaggggacagagctggaaagcttcagccaccttctgaaatgcttctgtagagaagtgatccatgta

SEQ ID NO: 67728 - DNA, 601 bp, Human
ttggagcacagtcgaaggctgctgtcaatatgagaaccaagtaggtggccctgcatatgcttagtaagggagatggcagggccaggcaaataaagggagacaacgaggggctcacatcttccactcccaccccaacgcccccaggaatatgggggacagggcgctccagttccccaaccttcgatctcacaatgtaacaacttcatattagaggggaaaataaattttaacattaaatatagcagtatatgaaatcagttatgcaagctatgaaacccaaattagggctctttttgttctscaagagtggaaatattttaccgttgtctttcccatcaagaaagaaacaaaaaccaaggaaatctgcaaatgtagcacctggtgaattctatcgtggctatatccaggagtaccctggggaactgatgacaataatcaccaggcagtgttacccctcatgtgggtaacagggctctattagcctgttgattccttattcccaaacacattgcctgtttttgtaggacttcttttccctttcaaggtttaccgggtgattatttgtaacctgacatcagcagaataatgatgttcacatttt

SEQ ID NO: 67729 - DNA, 601 bp, Human
aaggaagaaagcggatgtgggagtcacggtcatcccagccggatggggcattaggccatcctcccatccccactgccccccaacactccagcctttgcaacgctacaaaggtctaagaaaaggaaccaagattcacatgtcaactcttggagcacagtcgaaggctgctgtcaatatgagaaccaagtaggtggccctgcatatgcttagtaagggagatggcagggccaggcaaataaagggagacaacgaggggctcacatcttccactcccaccccaacgcccccaggaatatggggsacagggcgctccagttccccaaccttcgatctcacaatgtaacaacttcatattagaggggaaaataaattttaacattaaatatagcagtatatgaaatcagttatgcaagctatgaaacccaaattagggctctttttgttctccaagagtggaaatattttaccgttgtctttcccatcaagaaagaaacaaaaaccaaggaaatctgcaaatgtagcacctggtgaattctatcgtggctatatccaggagtaccctggggaactgatgacaataatcaccaggcagtgttacccc

SEQ ID NO: 67730 - DNA, 601 bp, Human
ttaggctttacatacagcatggctggtcactctggctcatgactttaatgccagaattttgggaggcagaggtgggaggatcacttgaacccaggagtttgagactggcctgggcaacatgacaagaccccatctctacaaaaaaaaaaaaaaaaaagaaaaattagctgggcatggtgatgcacagctgttgttccaactgcttgggcaactgagttaggagcattgattgagcctaggggtttggggttagtgagctatgactgtgctactgcactccagcctggttgacagggcaagccacacacacaccgcccccctccccacacacacaccccaaccactttaatccttaagctacactggaaaaatggcctggttaagacaaccagttgctcacctctacttacccatggcaacaacagaaagcaaggacctcaggaaatgtctcttaagacttttagagttgcctgattcctcagtctcccacgaagagagtagctacgcaatgttaatagctctgactttaatgccttttctcacaacacctttagtgcctgtgaagaaagacactataaaaagcaaacatacaatcccataa

SEQ ID NO: 67731 - DNA, 601 bp, Human
agcaggatattgggataaagaacactggtttctctcatttaattccaacagcagtctggtggctcaggagctattaggattttttttgtatcgataaggagactgagggtcaaagaggtgacgtcacttgcccagggtcatagcaccaggaagcaggagagttaggctttacatacagcatggctggtcactctggctcatgactttaatgccagaattttgggaggcagaggtgggaggatcacttgaacccaggagtttgagactggcctgggcaacatgacaagaccccatctctacaaaaaaaaaaaaaaaaaagaaaaattagctgggcatggtgatgcacagctgttgttccaactgcttgggcaactgagttaggagcattgattgagcctaggggtttggggttagtgagctatgactgtgctactgcactccagcctggttgacagggcaagacacacacacaccgcccccctccccacacacacaccccaaccactttaatccttaagctacactggaaaaatggcctggttaagacaaccagttgctcacctctacttacccatggcaacaacagaaagcaaggacctca

SEQ ID NO: 67732 - DNA, 601 bp, Human
agaactcctgaaaatcatactagctacctttcattgtgttcttattatgagcaggatattgggataaagaacactggtttctctcatttaattccaacagcagtctggtggctcaggagctattaggattttttttgtatcgataaggagactgagggtcaaagaggtgacgtcacttgcccagggtcatagcaccaggaagcaggagagttaggctttacatacagcatggctggtcactctggctcatgactttaatgccagaattttgggaggcagaggtgggaggatcacttgaacycaggagtttgagactggcctgggcaacatgacaagaccccatctctacaaaaaaaaaaaaaaaaaagaaaaattagctgggcatggtgatgcacagctgttgttccaactgcttgggcaactgagttaggagcattgattgagcctaggggtttggggttagtgagctatgactgtgctactgcactccagcctggttgacagggcaagacacacacacaccgcccccctccccacacacacaccccaaccactttaatccttaagctacactggaaaaatggcctggttaagacaacca

SEQ ID NO: 67733 - DNA, 601 bp, Human
atgaaaactatagccatcacagaggtgtactataaaccaatgccatgtttttgtaaaggccggaatgaaagaaccacctggaatccgactcatggtgctaatactgaactcatttggcacaagttatttagattcaaaaaggccaccccaagagcactctctttcagtttgagcagaactcctgaaaatcatactagctacctttcattgtgttcttattatgagcaggatattgggataaagaacactggtttctctcatttaattccaacagcagtctggtggctcaggagctattagrattttttttgtatcgataaggagactgagggtcaaagaggtgacgtcacttgcccagggtcatagcaccaggaagcaggagagttaggctttacatacagcatggctggtcactctggctcatgactttaatgccagaattttgggaggcagaggtgggaggatcacttgaacccaggagtttgagactggcctgggcaacatgacaagaccccatctctacaaaaaaaaaaaaaaaaaagaaaaattagctgggcatggtgatgcacagctgttgttccaactgcttgggcaactgagt

SEQ ID NO: 67734 - DNA, 601 bp, Human
gaggaaggagaatcgcttgaacctgggaggtggaggttgcagtgagtcaagatcctccactgcactccagcctggcgacggagtgagtgagactccatcttaaaaaaaaaaaaaaaaaaaatggaaaaagaaaaaaagaaaaggcaggggcttagaaaaagcactagaaggggactgaatgaggaccaggactgcctgagttatagcagatgcctgctatgcaaggactaatgcatgggccagggggacagccctagcacagtgtctgggcacagttctatgtatctaggtgattcccatycccaagtggtctggattgatgagattctgtatacatgaaatatgaaatgggggtgctgaccaactagtccatatttccaaccacaggactggctgatagcaggtgagaaataacaagcactgaaaggccaagataaatgtcatatacgagaacctattaccaagttgtcaaggctcttctgatctaaggatttttgacaacagatggctaaccattactcagataggtgttttgagacaggagactgaaggaattactattcaaggcctttcccttgtgagtctacagactatgaaaata

SEQ ID NO: 67735 - DNA, 601 bp, Human
gaagccagaaaacagccctggtgtgtctgcctgaatgagaagggctggagaactaaagagaatgggatccctggggttgctgaggctgccaaggacctggacatccaaaacaagatggatttctacacagagttgctaaagataccataaagaaccaagaaggaataagaaggggaaggtagaggtcagagatgtacacaggatctggccagaaagaggcttctgggtggggctggaagatgcaggggcttagaaaaagcaggggcggccgggtgcggtggctcacgcctgtaatcccagsactttgggaggccgaggcaggcggatcacaaggtcaagagatcaggaccattctagccaacatggtgaaaccccatctctactaaaaatacaaaaattagctgggcatggtggcatgcacctgtagttccagctactcaggaggctgaggaaggagaatcgcttgaacctgggaggtggaggttgcagtgagtcaagatcctccactgcactccagcctggcgacggagtgagtgagactccatcttaaaaaaaaaaaaaaaaaaaatggaaaaagaaaaaaagaaaaggcaggggctta

SEQ ID NO: 67736 - DNA, 601 bp, Human
gacaatgtaatctctgtttgttacttagcagcaccaaggtcagcatcccaagtgcctgggtattcaggcttttgtttctgttgggtggcttgaaggggatgttgaaatgtggtgttttgttcagagattgtgttaacacttttcactaattaaggtctaagagcttgaaatccttgcatttcaattcatctggtggaaaggaaactcaagacatgggccgtctgttcttaacctctatcgagggctctctctcaagaagtagcactggatatggtgcagacgaatatgggtttggtgtgctgtctctggttttagggatgccccacattggtcctttcacttatacagaggaacgtggtttcttagttattgagaagccagaaaacagccctggtgtgtctgcctgaatgagaagggctggagaactaaagagaatgggatccctggggttgctgaggctgccaaggacctggacatccaaaacaagatggatttctacacagagttgctaaagataccataaagaaccaagaaggaataagaaggggaaggtagaggtcagagatgtacacaggatctggccagaaagaggcttctgggt

SEQ ID NO: 67737 - DNA, 601 bp, Human
tgagcaagactcccagacaatgtaatctctgtttgttacttagcagcaccaaggtcagcatcccaagtgcctgggtattcaggcttttgtttctgttgggtggcttgaaggggatgttgaaatgtggtgttttgttcagagattgtgttaacacttttcactaattaaggtctaagagcttgaaatccttgcatttcaattcatctggtggaaaggaaactcaagacatgggccgtctgttcttaacctctatcgagggctctctctcaagaagtagcactggatatggtgcagacgaatwtgggtttggtgtgctgtctctggttttagggatgccccacattggtcctttcacttatacagaggaacgtggtttcttagttattgagaagccagaaaacagccctggtgtgtctgcctgaatgagaagggctggagaactaaagagaatgggatccctggggttgctgaggctgccaaggacctggacatccaaaacaagatggatttctacacagagttgctaaagataccataaagaaccaagaaggaataagaaggggaaggtagaggtcagagatgtacacaggatctggccaga

SEQ ID NO: 67738 - DNA, 601 bp, Human
atattgttaagatctaaaggcaattaggaaattctcaaggtatctaatctgatagcaaatactcttcttttaatgctttctaacttaccaatgaagaaaagcagctgctcgtggaaatgttcaaatctaacaggtttattaatgggcctactatgacctgatagaggggctatcattttgataatcaaataaacacaagtttcagctcttacattctgagggaaatttccatcagatcatttccagtcctttctcaggcactgacttttacatcaccatgtgtcactgagacataatcgtyaaatttagtgtgtcacctagtacgtgctatttattggttacacatctgatagttcttgctctagggaatatttaattcctcaaattcacagccaaaaagcctcctactttgccaataggactctgacttttttttcttgggaaacaacccaactttgtgtaacagaatgatcttcctcccaactttgagcaagactcccagacaatgtaatctctgtttgttacttagcagcaccaaggtcagcatcccaagtgcctgggtattcaggcttttgtttctgttgggtggcttgaaggggat

SEQ ID NO: 67739 - DNA, 601 bp, Human
tacagaagtcattaccactcagatcataagctgctggctcgggttttcaagacacattatttcccaatataatggtcttgctttttagagggaaatgaatttaagaatgaagaacaaaatgtgaaaacgcaatgaaaacagatttcaagtgtcatttccttctattcaatatttatttcccccactaactttgtgattttgttaaattaccaacatgcccttttatgcctaataaatagcaccatgtgaaacatgtaactcatgaaacatattaactcaaccactattaccaagcatgctcagttatccattcataaatgtaccagacatgtttttctagtaaacacaaaccactataaaaagttcaatagttgctcatagagaaatgtgaagtacgtatattaatacatttggctttaatttttttaactttaggaggtgaaaatattgctgttttcatttgagctctaatcttatgaatattatgatttggagtagtcattctgaaaatcttaatggagtatacaggatggaaggaagccatccaacttgaaatatctataccaaaacaaaaatattcatcattcaacctgtagtgttt

SEQ ID NO: 67740 - DNA, 601 bp, Human
aggcttaatagggaaggaaggtggcattgaaaaaaaaaatgtccacagcattacagcagcaatcctgtgtggcatttttggctcactcaagagtgtgggtaaatcctgagaattggagccaaaaataaagctcatgaacctgaaattaccatgaaattctgattttaagaagtcctactatgaaatagtgatatatttcttcaacaaaatgcctgtgattcactgactgggataaaggtgcatttccaaaatacaactatgttcaatttcttaattaaatgatttaagaataaaactcttsaaccattttccagaggataagctctcgttttcccagtccactgggaagaggtgaaaaaggcacgttagaaactgaaaggtaagctagcaggtaagtctgtgccaattttgggagggaggcattacctttcaactttgatctgcagattcactggactgttttaaatgtgaccttgtctgaccacatctgagaaacttgactttgatttcagattaggtttctcagaaaggtttaggaatcaaagtgcccatggagtcgggacaaaaatttgatatgacagcttcttgtaaaacaggcaag

SEQ ID NO: 67741 - DNA, 601 bp, Human
aaccgtgcatagaaacacaagtgaacacactggggtcagccacgtggccaaacgtaaggaagcagtcagtagaggagaagcattgctcacctgactccaagcgccagctttccatttggggcatcttcctcctcggcactttctgtgcccatgtggcttagccaggtgcttacagtaatcactttctaaatggcttccatcttttgccatgcagtaaacatttcgttgtttatgccctcgaccacaagagacagaacactgcaatataaagcaatggcaaggttgttgttgttttttaatyacacggagtttgagaaaaaacctgcgtcttgagatgttaagacaatgcctaacaagagttaccattcccctcttttacagcgccagtttggataatatctcaaggcttaatagggaaggaaggtggcattgaaaaaaaaaatgtccacagcattacagcagcaatcctgtgtggcatttttggctcactcaagagtgtgggtaaatcctgagaattggagccaaaaataaagctcatgaacctgaaattaccatgaaattctgattttaagaagtcctactatgaaatagtgatatattt

SEQ ID NO: 67742 - DNA, 601 bp, Human
attagagctacatgaataatatttcccattgattacactggaaaagaatgtactgtaacatgatagagttaccccataaatgatggacatgttcaaacattatcatcatcaataaacaacaaccaaaaagtcttttgactatttcaatttggggtcttaaatataaaagagcacgtttctggaacaatatatccaaatacaaatacagaaagaatattgtaaacaaatttgagtttggtataggactcaactatatgcagaatctcataatgttttaataacctaaagaaaaatgaaaacatttaaagacttttagaatgtataagactattcaggctactaaataaatgaaacctctttttgaagctattgtaattgaaaaaattacttatggttcaacgaaggcacggtactaagagccataagtatccaacatttaaaaaatcacttcctacaatgtttgataatttttcaaaagacaaattaagacacaggaaagttcaattatacgatatgtcattctggcttctgattttcatgatgcaaagccagctttgaaataccacattcaaaagtttctacatgacttaagtgctcacag

SEQ ID NO: 67743 - DNA, 601 bp, Human
tcacatcaaagctagctgaacagaagaaaatattttggatcaacatagctactattgtttgggttcaattgtattaattggattgaatgagtttgtgacccacaagaaaccagacttttaaagtcattatgtcctgggtgtaatgggaggattcctgaacacaagtgatgaccctatctatagagaatggccatttaatgctcattagagctacatgaataatatttcccattgattacactggaaaagaatgtactgtaacatgatagagttaccccataaatgatggacatgttcaaayattatcatcatcaataaacaacaaccaaaaagtcttttgactatttcaatttggggtcttaaatataaaagagcacgtttctggaacaatatatccaaatacaaatacagaaagaatattgtaaacaaatttgagtttggtataggactcaactatatgcagaatctcataatgttttaataacctaaagaaaaatgaaaacatttaaagacttttagaatgtataagactattcaggctactaaataaatgaaacctctttttgaagctattgtaattgaaaaaattacttatggttca

SEQ ID NO: 67744 - DNA, 601 bp, Human
atagggaacagatgtgaggatagcaaggggcgcacacgtgaaatgcctggcaggtacccctttgtggctctacttacttcttgccattcctctgccctccaagtgtagaggggacaccgtgggccttggcagtcgcgttccgactccggtctggtgtatgggttgcactcggtctctctggctattttgtgtgttccgatctgacagcccacatgcctctgctgtacgcctcggccacaggacacagagcactaagaagacagagaacgtaagtgggagcttcggctcatttattttttgsgggggcggggggtgtcgagggtcacagaggaggggaatgcactcctaatccaatgactttcatagctatcacatcgctttctaatttgcaatgaaagggatcctagatcatgtcttaaacctggaaactcactgcttatcttatccacgctggagagtgaggaaggtgctcaagtttggaggaatccctcaagttaatgtaattcttagaggattgaagaggttaataaaaatcattatgaatcatttagcacaacctggaaatagtgctgccatgagaaatgaaaacttgaaatgattt

SEQ ID NO: 67745 - DNA, 601 bp, Human
ttctgcacggaccatcaacggagcagtttcttcagataccatcctttttttttttttttaaatgttagaaatctttcactaattaatcaaggtttcacatgaatgcctatcttctacctgacagccaaagtcatagaaagaggaaaaatacagagtaggttctacctaaagtctgccctgcggctatttaaacagatacagaatgaccaaatctggagacacgtatttaaaatattccttctatctccccctccttctgtgaaagatatctgaatgcattcggcccacagcctgttaaagtttttttttttttttttgaggcggccagacttggaacactcaggaatacagacagacgtaggaattgcttaaaaacaagaagttctcccacccttgttggagcgaatgcgcgagtctgacagtgaaccttttgggaaagagccagcattgtaaccgtgctcggtgacttctctggctttatagggaacagatgtgaggatagcaaggggcgcacacgtgaaatgcctggcaggtacccctttgtggctctacttacttcttgccattcctctgccctccaagtgtagaggggacaccgtgg

SEQ ID NO: 67746 - DNA, 601 bp, Human
aaatgacacagattctgtgaacctcagttttttcacctgcaaaatgggatgatgataataataataatgctcaccttgtctggtggttaaaaagattaagggaagcaatgaacaaaaagtacccagcacagtgccaggggtacagtctaactgttctccaaaccataccctttctttatgttctgaaaaactcttcatggtggggaatttcctgccttatttttcattatctctgcacctcaagcagcatgcattttgttttttatgccaacatcagtggatattgttttgctttctaatyctttcccccccttttctacagtttaatcttctgttctggaaacagaggttacctcctataaaacctccctggccaaacttttccccatggacacaatgttttccttaaccaaacattaacttgaagccagggaaaaagcaaggcctgtccacttctgcacggaccatcaacggagcagtttcttcagataccatcctttttttttttttttaaatgttagaaatctttcactaattaatcaaggtttcacatgaatgcctatcttctacctgacagccaaagtcatagaaagaggaaaaa

SEQ ID NO: 67747 - DNA, 601 bp, Human
ccctcaaagttgtgcagtatacaacctgtgtggctgtacagaacatccctgatgaccatggccatggtgagggtgcagaaactgtgcttctctaggcagatgcttggattatttctcaaaaagaggatggtgccatatcctacggaccaagcatgcaatacaccttgccaacaaactggtgggttttaatagtccacataggggactattaaaaggggaagcaaaaggcaaagtgcatactcaagcaaacaagagttctgaggtggtggccagggaccgctaagaaagaaggggtatcctrtaatggggggctcctgcacatcccattcagtgggctgagaggctgccctgtggcacactctctgacctcaggtcaagacgtcactaggtgtgggagaaaagtggaaacgtgtgcctgcatcagtggatatcaggtaaaacggtggctgaaagaatggatgtgagaggcggtggcagcaagatcggaggtgagggctgtgatttaggggagcctgaagggttctgtcttatcaagtgaccacccagtttactgttgaacaagggcgcttttgatcataaaagtaggaagaattaataatta

SEQ ID NO: 67748 - DNA, 601 bp, Human
agaaggcccctttcccctgaacaaccaatgggcttcacaatgaacaggaagtccactgaggggctccaacatcatcaagactcgcctggtgacatggcttaaagtctgatagctaactagatcaagaatctcctttttagaaggggtaggtgttacaacccagtaaagggaatacactttgatagcaactctccagtaagaggcttggcaaatcattgagaggaaaataaaataattcactttaggtgtatttggcatcggattagtgaagataatgattcagagtgtaggtgccagcgtkcaagcttccgggcttcaaattccagccatattatttactaaatgcatgatcattgataaattaacctacctaagccgcaagttgcccctattaaatgaggataaaaatataaatactacatcagagagttatggaaagggctaaatgaagcacttcatgtgaaaatactcaacatagtgcctagtttgtagcttagtaaacaataagctttattatttttattatcttcagtattagggccattgtactatacaactctaggggacgctcctcacattgtataaaaatggcatccctcaa

SEQ ID NO: 67749 - DNA, 601 bp, Human
cagaagcctccatcggaaggccaccgtactaaaaagaagtctactttgggatggcctaaaatgtgctagtcaccatgtcgaatcatgtcatctcaccaaatcctcactgtgacccttgagcaaagtctgccatagaattcccatttggcagatgagctaagtgaagtctagaaattcagagtcaacttttcagagccacacactgaacagaattttgcctacaacatgttgtttctaggatgtaaacaaaatgagatgtggatgtgtggatagagcacttttctcttgtccaattattctrccctatatctgaaagtctgggctctactctcatggtatcaagaaggcccctttcccctgaacaaccaatgggcttcacaatgaacaggaagtccactgaggggctccaacatcatcaagactcgcctggtgacatggcttaaagtctgatagctaactagatcaagaatctcctttttagaaggggtaggtgttacaacccagtaaagggaatacactttgatagcaactctccagtaagaggcttggcaaatcattgagaggaaaataaaataattcactttaggtgtatttggcatcg

SEQ ID NO: 67750 - DNA, 601 bp, Human
agacatttttgctcccaaatagtatatatttgttaggaggtgcggtggggagaaggaggcagaaataatactatggagacactttgtaactttaaagtcattcattcattcaatcaatcagtattttacaatgagccaaggtctatgctggggccccgggaggcagcctccatggcttcgtaccctgcctctctccctgttaggacacccagggtggcagctattcccaacttgggttcccatgtgttagctcagctggctgactggtgacccctggggtttaacacctagggctacctgkgcagttgtgtaagcagttgtgtttgtaacagagcatgtaattgagtaagaagccaccagggagagaagaggaaacacaacggggcaattcccatgatgctgcaaaggtgggcccaggtagcagcagatgagcaggagaatgatggaggacatcagttcaccaggcaaggaggggaagaggacattcttaggaggggctcagcatgcacggtggctggaggtgagaaatggcatgggtggagaagcgggggagcagaatgaccacagcattttggggttttcagagcagattatttgtggt

SEQ ID NO: 67751 - DNA, 601 bp, Human
gtcatgagaagcagcaatgacaaatcagtttatctagcgttgctttaaatggcaacaacgaaaaaagcagtccttactttaaagctcattttaaagtcaggtatacagaatttagacatttttgctcccaaatagtatatatttgttaggaggtgcggtggggagaaggaggcagaaataatactatggagacactttgtaactttaaagtcattcattcattcaatcaatcagtattttacaatgagccaaggtctatgctggggccccgggaggcagcctccatggcttcgtaccctgyctctctccctgttaggacacccagggtggcagctattcccaacttgggttcccatgtgttagctcagctggctgactggtgacccctggggtttaacacctagggctacctgtgcagttgtgtaagcagttgtgtttgtaacagagcatgtaattgagtaagaagccaccagggagagaagaggaaacacaacggggcaattcccatgatgctgcaaaggtgggcccaggtagcagcagatgagcaggagaatgatggaggacatcagttcaccaggcaaggaggggaagaggacattct

SEQ ID NO: 67752 - DNA, 601 bp, Human
tagaaaaatctctaacacaagtaacaccaccagcctccttgcatttcatcacacactataattcagaaagaaaataatcacagtgctggactaaatcgggcagctcgcccattgttctgcaagctacatgtgccttaaaatatgctgaaattaacagggggaaaagaacttctccgaatttgagggtgaggaagacctaaagtaaaccctgaaggtggtattttattcagccaggtaggttggccacagagtgatggtctgaaaaggatcatttaatgcaatgggtagaaattttctttgmttaaagattataatcaagttgctttacactttcagatatatcttttggtgcaattccctaaccatggggggaagaaaaccacttgagagtcacaggctctaccttttaaggttgttgattttctccatggatgaaagaccttgtcttctctagtgctgggttaccattgttgcacagtgtatggacggcaactcacagaaccacagggttcctgggtttttatgtcatgagaagcagcaatgacaaatcagtttatctagcgttgctttaaatggcaacaacgaaaaaagcagtccttac

SEQ ID NO: 67753 - DNA, 601 bp, Human
tgttcctttaggaaggagaagggatatgctggcatttcctggtagccccttgtcacttgcaaactaaacttaaaatttctgctgcttgggagtaaacctcaatatctagaatatggagtcagtcctcatttttctggagcataaacataacttgaaaccactgtgaggtgagcatggaggagcagaatcatttcaaattagtgcaggaggccggctgagcccagttccctagctcatccctagctcagtggttttggggttctctattcccctagaaaaaaagtgtttttttcatcattawaaaggtgagatagagggccactgaatgttaaaaaagaaaagaaaagaaaaatttaatctgtgatgtgtagatatatgcaaatacttaaccacccatagaaaaagtaattccttagaaaattaggacttaggtgactctgagaagatcctaattattgcgcagctaaacctggactaaaccttccagtatcctctcttgttttcactaatccacaaggctttaatctgcatcaataagtaacagttcagagcagaaatacaatgaatcctaaatactttatgcttgttaagcgtttctctc

SEQ ID NO: 67754 - DNA, 601 bp, Human
caagctgtgggtaatcttagtgtctgacccagtgttgcatgcattgacatcagtccatactaacttaaacaaagttgtgcatttgagaggggcaaggaatgagactcttgacccctacaaaccaggagcaaaagtcgtcccctggctatttatgtgggggggggcccagtgggagacaggcatttgctgatggaactgagccccaaatatggtcaggctaaacacagaggcctccacatctctataaagaagctggcaagaacagatgctctcagctagctgatatcagcattgtgaaaaygttgactgctgctggtttcctcaaaccatttcagagagaaactcatactgtagactctgcatgccttggtgtatgtgcttggttccacatgagcacgtattacttttctaaattgaaaataacagcaaagcaaaacaataagactgtgggctccctgcatgagctgtacacttcaggccctgctagaaaatgcatgtgtcaatcaggactgacagagctcttctttgccagtctagctcgggcctccgccaattcaggtggagtagagctcagagaaaaacacacaaagaagcctccagg

SEQ ID NO: 67755 - DNA, 601 bp, Human
gacatagaaatgctctgtgtacatttcttccttctttggctgctgctgttcaaatgtttgaaggccaagttgacgccaggccaggaaagtgtaaggccagcccggggtgtttcatgcagatggctaacaaactctgtccaagctgtgggtaatcttagtgtctgacccagtgttgcatgcattgacatcagtccatactaacttaaacaaagttgtgcatttgagaggggcaaggaatgagactcttgacccctacaaaccaggagcaaaagtcgtcccctggctatttatgtgggggggrgcccagtgggagacaggcatttgctgatggaactgagccccaaatatggtcaggctaaacacagaggcctccacatctctataaagaagctggcaagaacagatgctctcagctagctgatatcagcattgtgaaaacgttgactgctgctggtttcctcaaaccatttcagagagaaactcatactgtagactctgcatgccttggtgtatgtgcttggttccacatgagcacgtattacttttctaaattgaaaataacagcaaagcaaaacaataagactgtgggctccctgcatga

SEQ ID NO: 67756 - DNA, 601 bp, Human
ggctcgagacatagaaatgctctgtgtacatttcttccttctttggctgctgctgttcaaatgtttgaaggccaagttgacgccaggccaggaaagtgtaaggccagcccggggtgtttcatgcagatggctaacaaactctgtccaagctgtgggtaatcttagtgtctgacccagtgttgcatgcattgacatcagtccatactaacttaaacaaagttgtgcatttgagaggggcaaggaatgagactcttgacccctacaaaccaggagcaaaagtcgtcccctggctatttatgtgggggggggcccagtgggagacaggcatttgctgatggaactgagccccaaatatggtcaggctaaacacagaggcctccacatctctataaagaagctggcaagaacagatgctctcagctagctgatatcagcattgtgaaaacgttgactgctgctggtttcctcaaaccatttcagagagaaactcatactgtagactctgcatgccttggtgtatgtgcttggttccacatgagcacgtattacttttctaaattgaaaataacagcaaagcaaaacaataagactgtgggctccc

SEQ ID NO: 67757 - DNA, 601 bp, Human
gattttggatttctggattagggatgctcaatctgtgtaaactcatttcatcttcacaactaccagttttgcagatgagaaaactgagacacaaaggttatgcaacttgcccaaggttgttcacctgggaagtggcagaaccagggttcagatccagactgtctggcttcagagcccatgttctaagcacgaagccactttggtaaacagaaagaagtccctttgatccctgttagcccatttcaagttgctaactccagggtttctcctggaagtagagttactaaggagagcgggttakgcaggacatgtttaagacggggttgagatccaagggctttcagatttgagtgctcagtcttctacttacgctcccccagttgccaactctccaggtggccgagacagggcagtccctcaggtaacaggggtgaacactggggggctgcgtgcctgggcagttgatggtggtttggtagctgtattcataattctccttcccggtgtaaatctcgctgcacgagacaagcctttgtttgtagccttttccacaggtcactgagcactgcaaagacagggattgagaggagaggttcgagca

SEQ ID NO: 67758 - DNA, 601 bp, Human
ataaaacacttatatgtgtaattttacacacacacacacacacacgtaattttttcatttaagcctcacagtacccctatgagatagtattaccattatcttatttttacaggtgggagattggggctcaaatttaaggaatttgttcaaggtcatagtggagccaggattcaaaccctaactgcttccaactcgttatacacttttgcctgatcacttttcatttctttctttctttcttttttttttttttttgagacagagttttgctcttgttgcctaggccggagtgcaatggcamaatcgcagctcacggcaatctccgcctcccaggttcaagcgattctcctgcctcagactcccgagtagctgggactacaggcacgcaccacctcgcccaacaaatttttgtattttattaaagcagtgtgtagagggaaatatatagtactaaatgcccacaagagaaagcaggaaagatctaaaattgacaccctgacatcacaattgaaagaactagagaagcaagaacaaacacattcaaaagctagcagaaggcaagaaataactaagatcagagcagaactgaaggagatagaga

SEQ ID NO: 67759 - DNA, 601 bp, Human
gcatcactccaacaccacaagacactgagcactgtaagacaaatgagagtcagcggtgtggctatggaatgtgggaggcataggcttctggtggtgtggagctcagagccctgatgtcatcatgtacagggtgtcacttcagaccctgtgtcgctgaatacaaaaagctgacatttactgagcacttactatgggccagtccctgtggtaagctttatatattcatgttcatgcatttatacaaacatatatatgtataaaacacttatatgtgtaattttacacacacacacacacacacgtaattttttcatttaagcctcacagtacccctatgagatagtattaccattatcttatttttacaggtgggagattggggctcaaatttaaggaatttgttcaaggtcatagtggagccaggattcaaaccctaactgcttccaactcgttatacacttttgcctgatcacttttcatttctttctttctttcttttttttttttttttgagacagagttttgctcttgttgcctaggccggagtgcaatggcacaatcgcagctcacggcaatctccgcctcccaggttcaagcgatt

SEQ ID NO: 67760 - DNA, 601 bp, Human
accttgaacacttctgctaccagctctgcttcccccacactgacccctgtgcctggctaaccctaacttgaccttagggtctctatttcaatgtcatattttctggaatgctgccctgacctcccacatttcaatggtgcttctttcatgcactttcacctacttcattcattcattcattcattcagttcattcatcacaaatcggagagagcacctgccttgtgcgagccactttccaggcactggggaatacagcagtgaacaaaagagacaaaactgcctgcaggactatcctcacygcactgtaagctcccaatgttcttcctctccatactagccaatgtgcaatgtgcaatacgcacctccctgctagccaatgtgcaagacatgcttgctctctgaatggagagaagaacgcacacgttcccaaaggactcctcactaacttactgattatctgcatgctggtcaggtctattctgattttctgaaaactggaaaacccagcggccgtgtaatccttccgacattggcagtcatcgcgccggctcccgttatagggacattctgttgggttgtgtaacctaaattatacagag

SEQ ID NO: 67761 - DNA, 601 bp, Human
ctaccttgaacacttctgctaccagctctgcttcccccacactgacccctgtgcctggctaaccctaacttgaccttagggtctctatttcaatgtcatattttctggaatgctgccctgacctcccacatttcaatggtgcttctttcatgcactttcacctacttcattcattcattcattcattcagttcattcatcacaaatcggagagagcacctgccttgtgcgagccactttccaggcactggggaatacagcagtgaacaaaagagacaaaactgcctgcaggactatcctcrctgcactgtaagctcccaatgttcttcctctccatactagccaatgtgcaatgtgcaatacgcacctccctgctagccaatgtgcaagacatgcttgctctctgaatggagagaagaacgcacacgttcccaaaggactcctcactaacttactgattatctgcatgctggtcaggtctattctgattttctgaaaactggaaaacccagcggccgtgtaatccttccgacattggcagtcatcgcgccggctcccgttatagggacattctgttgggttgtgtaacctaaattatacag

SEQ ID NO: 67762 - DNA, 601 bp, Human
ccatgaatttcttggctttggggttttgtatctgctgtttattctaccttgaacacttctgctaccagctctgcttcccccacactgacccctgtgcctggctaaccctaacttgaccttagggtctctatttcaatgtcatattttctggaatgctgccctgacctcccacatttcaatggtgcttctttcatgcactttcacctacttcattcattcattcattcattcagttcattcatcacaaatcggagagagcacctgccttgtgcgagccactttccaggcactggggaatacrgcagtgaacaaaagagacaaaactgcctgcaggactatcctcactgcactgtaagctcccaatgttcttcctctccatactagccaatgtgcaatgtgcaatacgcacctccctgctagccaatgtgcaagacatgcttgctctctgaatggagagaagaacgcacacgttcccaaaggactcctcactaacttactgattatctgcatgctggtcaggtctattctgattttctgaaaactggaaaacccagcggccgtgtaatccttccgacattggcagtcatcgcgccggctcccg

SEQ ID NO: 67763 - DNA, 601 bp, Human
acctgtgggcacttggcagcgctgtagcaatccccggctgtggcaaaagggacgggatgtccttcgcttgtccttgcaaactgtaagtcagtggctgtggggtggagaaggggttaaaggcaggggaaggtaagagtgggagaaaggcaaggaaggaacaggacattaacaaggagacagaagggaagaagaagaataagagggaatgggagagaaagaagcaatgtgaaatattagtgggtaaatggatccagatgctcacttgctttttcctgattatatttgtggttctgcaagcttyattccccgagcttcatcagccccgaatgtctgtctccccacagtatggaagccaaaaagggggtttcaaatgactttggaattgattcctacataaataaatatgtgaatcacctcacttaaatgtagcgtaattggctggctgagaacctcctgttatcctgcatcacaggcttcaggccagggggaaataagccaggaagagagcatttccagctacttaggagcgattccctgaggtttcctctgtcctcctgttgcctaggcagtattattgccaaaatgtggcgcaattagaacc

SEQ ID NO: 67764 - DNA, 601 bp, Human
catgtagtgttttgcatcttgttttttctgtctaatccatgtaaagtgtttttctatatcatgcaatattcagattcataaaggctgacagtggtgtgttggcacgtgcttgaactggcttttgagagtcaactgtctgccttcttcctagccctccatttagtgacataatgttgacggcttgaaatcaattatagggagaatatttacaccatggcaattgacaaatgttacaaagcaggaccttttttttttagaagtgtcagtcattaaatatttactagcactccgctgactgtayaatattcattttatttaccaccataatttgtttaaccaagccctcgctaaccgacatctaatttgtttctaagttggcgtgttttgttgaatgcagaagttaggcatgtagctatgatcatttccttaggacccactttcaggagctgaattacgagattagactccagagcatttgagagggtcttgatacatgtggccaaactgccctctagagcaactgttctaatcacattcccaggaacagatgcaactgaggatgttcccgggaaaggtgggaggtgaatccctggcaaggggg

SEQ ID NO: 67765 - DNA, 601 bp, Human
tctgttagccactaaaatgcaacagataccaatggggtttttgaagccatcaattgccctaaaaaaaactgtacttcaaaagtttttgattcctgggtaatggaagaaaggctctttttaccattatgtcctttgtttattttccttctctcctgagagcttcctctccacttctctaaaacgtttagcaatgctcttctaaagcttgaggccgaaaaaacgcctcgttaaaacaacgttcagatgtgtttgtcttcggacgttctctgtagttgggggtaaatccatcctatggagacasggcttgggattctgaacgcgtcacagaatcccagtcttcagacttttgaaggttcacaggcaaagtaagaaactcttgacagagtttaacaacagctttgtgaagacctcctttaaacctaagagaaaactggccaagttctcctgcccagaatcactgagttcattatgtttgtcctgccttccaagggcagaagcttcttgtaaagactaacgtctgctttgcaaaattagcccgagctgattatgacaaaatgtttcaaaagacaagctaaaacttgccacgcctctctcaggcaag

SEQ ID NO: 67766 - DNA, 601 bp, Human
cgacacgctcctcagtttacaatggggttatgtctcaataaacacatcgcaagttggaaatatcattaagtcaagaatgcatttaatatatctaactttctgaacatcacagcctaggctagcctaccttaaatgtattcagaacacttgcattagcctatagcagggcaaaatcatctaacacaaagcctattttataataaagtgttgaatattttgtgtaattgattgaatactgtacttagtgaaaaacagaacggctgtatcggtacctgaagtagggtttctaccgagcgtgttytgcttttgaaccatggtgaagttgaaaaatcaagtggaaccgtcgtaagtcagggaccatctgcacagcacagtgtttctcaagctgtactgtgcccatcaccacctgagacactgttcagctgtagactctgactcactagggtctgggacccagaacctgcatttccaacgggcccccaggtgacactgatgcactgcgtagaccacaccttaaccacccagattttagagggtgaaaaacttattattgtagaccctgtgtatctctaattctccagatatatcgcttaataagtta

SEQ ID NO: 67767 - DNA, 601 bp, Human
gctgcttttttatagtcttattttgattaggtagaagtatttgcaatagggttttcagatttagaaaataaaaatacaggatgcttggttaagtatgaatttcagataaacaacatatacatgtttagtataactatgtcccatgtagtgataacagtacacttattgtaaacagtgttcattgtgtacttaaaaaaaaaaaaaaagagatggtgtctcactttgcagcccagcctggagtgcagtcgcgcaatcatggctcactgccctcttgacatcctgggctcaagggatcctcccrcctcaacctccaagtagctgggactacaggcatgcaccaccatgcccagctaatttttaaagtttttgcaaaaccagggtctcaccaccttgcccaggctggtctcgaactcttaggatcaggcgatcctcactgtgtatttgaaattctaatttaactgggtgtcctgtattttatctggcagttctgccttgtaataaaaccctactttcccagctctcttctttgtcttcccctatttctgaggcaaccccaggcagggctcctggctgagatgggacgggagaaatgggccatgcc

SEQ ID NO: 67768 - DNA, 601 bp, Human
agacacaaacttaatcatggcagctagaaaaagagatcaggaaacagattttcctggaatgtcccaattggacgtttctcctctttctcaggtgagggaggcaggttgagctgcttttttatagtcttattttgattaggtagaagtatttgcaatagggttttcagatttagaaaataaaaatacaggatgcttggttaagtatgaatttcagataaacaacatatacatgtttagtataactatgtcccatgtagtgataacagtacacttattgtaaacagtgttcattgtgtacttaaaaaaaaaaaaaaagagatggtgtctcactttgcagcccagcctggagtgcagtcgcgcaatcatggctcactgccctcttgacatcctgggctcaagggatcctcccacctcaacctccaagtagctgggactacaggcatgcaccaccatgcccagctaatttttaaagtttttgcaaaaccagggtctcaccaccttgcccaggctggtctcgaactcttaggatcaggcgatcctcactgtgtatttgaaattctaatttaactgggtgtcctgtattttatctggcagttctgcc

SEQ ID NO: 67769 - DNA, 601 bp, Human
cactgaaacatacagtgtatttcaaaacatcatgttgtacacgataaaaatatacgatttttatttgtcaagagaaaagaaacataatgtatagattttggagggaaggaatggggaaagaacattataatttcggggcacattctaaagctcatgcactctctctcagctatctttattcctttcagtgcaaggaaaaatatttaatgactaatttacaagtaatcaatatgactatttagttaatcggatttgaggacattgattggctgagatggagaagagagagagtgagatagctttttttcacagacacaaacttaatcatggcagctagaaaaagagatcaggaaacagattttcctggaatgtcccaattggacgtttctcctctttctcaggtgagggaggcaggttgagctgcttttttatagtcttattttgattaggtagaagtatttgcaatagggttttcagatttagaaaataaaaatacaggatgcttggttaagtatgaatttcagataaacaacatatacatgtttagtataactatgtcccatgtagtgataacagtacacttattgtaaacagtgttcat

SEQ ID NO: 67770 - DNA, 601 bp, Human
caggtttatttcctgtataatttagtcccacctcacatgctaatgcttactgtgactcttcaggaaggaaatacaatatactagcattttctcccaaaagtgttgggcggtggaagcctattttcaggtagcattgctaggacatgcttctctggaccacacgggggaagtcagacagcatttctccagacagccgggggctagagagggctcagtcccagctcccagatattcataaggagtactcgacaggccctggagattaattttgagctcagactctctgaactgccaaggaacmccaagatttaaaaaaaaaaaaaaaaaaaaaaatgccgacaggcaattgtcatacccagctccctccagcccaggcatctcccaaaagtcttggggaacagccagtgtagtgatcattctttccataaggtggcgctcctggctttaattatttttagtttctggctgaaacggtagtaactatctaacgaataaaattataatttaggttacagtttatctacatgggtttcctacaatcacatttttatttatttatttacttatttttttaacagagcctcactctatcacccaggct

SEQ ID NO: 67771 - DNA, 601 bp, Human
gtgatggtgaagcactcctgagtttgagaaccactgctttagtggaatgctggctaaagtcacacaggtttatttcctgtataatttagtcccacctcacatgctaatgcttactgtgactcttcaggaaggaaatacaatatactagcattttctcccaaaagtgttgggcggtggaagcctattttcaggtagcattgctaggacatgcttctctggaccacacgggggaagtcagacagcatttctccagacagccgggggctagagagggctcagtcccagctcccagatattcatraggagtactcgacaggccctggagattaattttgagctcagactctctgaactgccaaggaacaccaagatttaaaaaaaaaaaaaaaaaaaaaaatgccgacaggcaattgtcatacccagctccctccagcccaggcatctcccaaaagtcttggggaacagccagtgtagtgatcattctttccataaggtggcgctcctggctttaattatttttagtttctggctgaaacggtagtaactatctaacgaataaaattataatttaggttacagtttatctacatgggtttcctac

SEQ ID NO: 67772 - DNA, 601 bp, Human
ttttttttttttgtagagattgggtctccctgtgttgcccaagctggtcttgaattcctgggctcaagcaatcctcctgcctcagccttcccaagtgctgggattatgggcacaaggcactacatctggccacctgcttgtgttttcacaagccctgcaggtgatggtgaagcactcctgagtttgagaaccactgctttagtggaatgctggctaaagtcacacaggtttatttcctgtataatttagtcccacctcacatgctaatgcttactgtgactcttcaggaaggaaatacaatatactagcattttctcccaaaagtgttgggcggtggaagcctattttcaggtagcattgctaggacatgcttctctggaccacacgggggaagtcagacagcatttctccagacagccgggggctagagagggctcagtcccagctcccagatattcataaggagtactcgacaggccctggagattaattttgagctcagactctctgaactgccaaggaacaccaagatttaaaaaaaaaaaaaaaaaaaaaaatgccgacaggcaattgtcatacccagctccctccagcccaggca

SEQ ID NO: 67773 - DNA, 601 bp, Human
tacttgtgctcctgctatttgcccagtaggataccaacagctttacatttttatttcatttatgtttcacaataagtcaatgagaaaggggccactacagtccccattttatagatgaacaaactgagtcccccctctccccacccccattttcctggaagttaaataacttgcccaagatggcagagccagtgggcacagactctggcagtcagatttcagagtccacgtgcttcacctctgggctctgcagccactgacggttttcactgtggcaccaagggctgagttgcggcaggtkggagaggctgatcccaccacctgctcaacttaacatcccaagaatttgaccttattctcaccttgttatcccaatctcctggtgacagcacagctgggaggaagacacagatttaatgtatgtaagctgcccaataaatagtagctattttaaccataattaggttaaaaccagagaaagagtgctctccattgttcacaaggaagtcaacagtgaacttgatattgagactgattttgaccagttctgctcttggaagtgagacagcgttactgttcttcaagtggtactggagatcta

SEQ ID NO: 67774 - DNA, 601 bp, Human
gcctcctttctgtctgtctgtccctcatgcagatatctaagcagagtgaggagaaactttacgacccctagctgagctggtgcagctaaaacatttgccctgaagtccacccccaaccaaggggtgtctcacacgacttattcctggggtcaggtggcagccatgtggacaggctaagcccgggcttacactgcagttcgatgtccttcccaccagctatctcaagccagctcccttccttagtcaccttggccaacttccgaaacaatatggcaaacctcagggctatgaaaacgttatracattaatagccagtacttgtgctcctgctatttgcccagtaggataccaacagctttacatttttatttcatttatgtttcacaataagtcaatgagaaaggggccactacagtccccattttatagatgaacaaactgagtcccccctctccccacccccattttcctggaagttaaataacttgcccaagatggcagagccagtgggcacagactctggcagtcagatttcagagtccacgtgcttcacctctgggctctgcagccactgacggttttcactgtggcaccaagggct

SEQ ID NO: 67775 - DNA, 601 bp, Human
ggcagaggagcttgaaattctgacattttctttcagccttcatctctgggccatggcctcctttctgtctgtctgtccctcatgcagatatctaagcagagtgaggagaaactttacgacccctagctgagctggtgcagctaaaacatttgccctgaagtccacccccaaccaaggggtgtctcacacgacttattcctggggtcaggtggcagccatgtggacaggctaagcccgggcttacactgcagttcgatgtccttcccaccagctatctcaagccagctcccttccttagtcmccttggccaacttccgaaacaatatggcaaacctcagggctatgaaaacgttataacattaatagccagtacttgtgctcctgctatttgcccagtaggataccaacagctttacatttttatttcatttatgtttcacaataagtcaatgagaaaggggccactacagtccccattttatagatgaacaaactgagtcccccctctccccacccccattttcctggaagttaaataacttgcccaagatggcagagccagtgggcacagactctggcagtcagatttcagagtccacgt

SEQ ID NO: 67776 - DNA, 601 bp, Human
tttgatttacagcccttgctctagcccaggaatgtctgttagaccatatctcttagaacagtggccctagttcttccctgaccctgaaaattcctctggcacacaaggaagacaaaaagccccgtaagcgcctctcacacccagccaggacgtgatcatcctttcatgctgcctgtctctgaaggcctattccagaatcttctacctggaagagaccaaaatgggtagctctgagaatgggcatggggagctgtggtggaattctgggtggggctgaagggaactttcacattcccacacrttggagagttgagggtatacagcgttgctggcagaggagcttgaaattctgacattttctttcagccttcatctctgggccatggcctcctttctgtctgtctgtccctcatgcagatatctaagcagagtgaggagaaactttacgacccctagctgagctggtgcagctaaaacatttgccctgaagtccacccccaaccaaggggtgtctcacacgacttattcctggggtcaggtggcagccatgtggacaggctaagcccgggcttacactgcagttcgatgtccttcccaccag

SEQ ID NO: 67777 - DNA, 601 bp, Human
attctttgatttacagcccttgctctagcccaggaatgtctgttagaccatatctcttagaacagtggccctagttcttccctgaccctgaaaattcctctggcacacaaggaagacaaaaagccccgtaagcgcctctcacacccagccaggacgtgatcatcctttcatgctgcctgtctctgaaggcctattccagaatcttctacctggaagagaccaaaatgggtagctctgagaatgggcatggggagctgtggtggaattctgggtggggctgaagggaactttcacattcccrcacgttggagagttgagggtatacagcgttgctggcagaggagcttgaaattctgacattttctttcagccttcatctctgggccatggcctcctttctgtctgtctgtccctcatgcagatatctaagcagagtgaggagaaactttacgacccctagctgagctggtgcagctaaaacatttgccctgaagtccacccccaaccaaggggtgtctcacacgacttattcctggggtcaggtggcagccatgtggacaggctaagcccgggcttacactgcagttcgatgtccttccca

SEQ ID NO: 67778 - DNA, 601 bp, Human
tcttgctttttaatcctgaaaaattttggcagaccagaatctgctccatataagagttgtcttgaacttgaactgatagcttttaagaaatagatgctgttttccgaggtgatggaaagggatttataacttcttccagaattctttgtggtattgctcagtaaatgcctgtgcttccagaagttcagaacacgtcatagtgacaactgcactcagctataatgtatttggaaagggaactaaactttcagctatatattaatcccctgagggaagagccacctagacacgtttttggctyatgtcaaatagtcaagctaccatacttttaaaaataagggcatagtctttaagcgttgcttcaaagatagaagcctgtctcatagcctggattagttcttaaagtgcttgcaaagagtctgccagaaatactaattcattacccctcctcctaacaacactcaatcactgttttctcaaatatcacttaacttcccccgacattgtttctacacacagtttcttgttttggatttaaatacttgtgatcttggctcttctttactgttgagcttgtatttattgggagagcccatcataa

SEQ ID NO: 67779 - DNA, 601 bp, Human
aagggcatagtctttaagcgttgcttcaaagatagaagcctgtctcatagcctggattagttcttaaagtgcttgcaaagagtctgccagaaatactaattcattacccctcctcctaacaacactcaatcactgttttctcaaatatcacttaacttcccccgacattgtttctacacacagtttcttgttttggatttaaatacttgtgatcttggctcttctttactgttgagcttgtatttattgggagagcccatcataatctttggatttatttgtttatttatttatttatttwtggagacggagtttcgctctgtagcctaggctggagtgcagtggcgcgatctcggctcactgcaagctctgcctcctgggttcacgccattctcctgcctcagcctcccgagtagctggggctacaggcgtccaccaccacgcccagctaattttttgtatttttagtagagatagggtttcaccatgttagccaggatggtcttttttttttttttgttgttgatcattcttgggtgtttctcgcagagggggatttggcagggtcacaggacaatagtggagggaaggtcagcagata

SEQ ID NO: 67780 - DNA, 601 bp, Human
ctcttctttactgttgagcttgtatttattgggagagcccatcataatctttggatttatttgtttatttatttatttatttttggagacggagtttcgctctgtagcctaggctggagtgcagtggcgcgatctcggctcactgcaagctctgcctcctgggttcacgccattctcctgcctcagcctcccgagtagctggggctacaggcgtccaccaccacgcccagctaattttttgtatttttagtagagatagggtttcaccatgttagccaggatggtcttttttttttttttkttgttgatcattcttgggtgtttctcgcagagggggatttggcagggtcacaggacaatagtggagggaaggtcagcagataaacaagtgaacaaaggtctctggttttcctaggcagaggaccctgtggccttccgcagtgtttgtgtcccatgggtacttgagattagggagtggtgatgactcttaacgagcacgctgccttcaagcatctgtttaacaaagcacatcttgcaccacccttaatccattcaaccctgagtggacacagcacatgtttcagagagcacagggttgggg

SEQ ID NO: 67781 - DNA, 601 bp, Human
tttttcctctactgttttgagatgcttatcttactaggaaaggaagtttgcaaacatttaaagagacttttctacctctggaatgctagctaatatgattctttccgctaccttatttcctttctaggtgctgaactgcccccttttagaagagttgttttgctctgcggaatgagcagaaacagagacacctcttttaccctttctctttgcctttcttttccttcacagagttctcatcagccatggaaaagtatgctgttaccataacaagggcagcagaggggaactaactgtgatrgtctgaaattttgtctgggttgtagctcttctgcctcttggatagttgatatgattggttcattgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgccatcttggctcaccgcaacctccgcctcctgggttca

SEQ ID NO: 67782 - DNA, 601 bp, Human
accataacaagggcagcagaggggaactaactgtgatggtctgaaattttgtctgggttgtagctcttctgcctcttggatagttgatatgattggttcattgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgscatcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgca

SEQ ID NO: 67783 - DNA, 601 bp, Human
catcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgcacagtgaatgtggtttggccaccacctgtctccctgaagaatacagagttaggcagcttttagtttcctctgggttatttgccatagagcttttcaggagtctgtctcttcatccagagtctccatgaagaacagatgtttaaaactgaagttcattcatgaatgttctataactcagtcaataaaacatagaccttgttctaccttcctaagttgaaagaataaaaagcagagaaaacactttctttgttaagtcctttctgttttttcctttcttattttcccttatgggggtgggagag

SEQ ID NO: 67784 - DNA, 601 bp, Human
tttttaattgtacagctcagtgggattaaatatattcaccttgttttgcaaccatcaccaccatccatcttcagaacgtttttcatcttcctaaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacacaacaaaaagcaacattccgatgccccgttccttcatctccatttccactctcagagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgacc

SEQ ID NO: 67785 - DNA, 601 bp, Human
aaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacacaacaaaaagcaacattccratgccccgttccttcatctccatttccactctcagagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgaccctcttgcctcagcctcccaaagtgctgtgattataggtgtgagcccctatgcccagcctatttcttagtttgggatattaattcattttctg

SEQ ID NO: 67786 - DNA, 601 bp, Human
gagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgaccctcttgcctcagcctcccaaagtgctgtgattataggtgtgagcccctatgcccagcctatttcttagtttgggatattaattcattttctgctatggaagatgaggatttagttgttatatacacmcttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtgacagctcttaagtcagtcatagtttccccagtgtttggtctggtgggcatctgaaccagttctggacaa

SEQ ID NO: 67787 - DNA, 601 bp, Human
caaaatataaaattagttggactgtagtcccagctacttgggaggctaaggtgggaggatcacctgagcccaggaggtcaaggttgcagtaagccgtgatcatgccactgcactcaagcctgggtgatagagcaagaccctgactctcaaaaaaaaaaaaaaaaaaaaaagaaatcagagtttgtaacatttacgtactgttccttaactgttaattcttctatgcttttactatagtttgattataaacgttgaaaatcaaacagcatatacaatattgtgattttttttcataactttycaatataagactaaggagcatgattattttcatagagaaggaatggaaaattgttttttaatttttgtaacactccatcaattgatcacaatcatgccccattttaatactgtgttatatgagctatggatttcttgtgtagtctgttttccttcttcagtagcttaaggttaacttgtttctagttacttatggctgcattggttgacattaaattgagctgacatagcgttggagggagtctgggtgaaatgtgaattgctaggaagtccttgcttcagaaaatgtacatctgtgcat

SEQ ID NO: 67788 - DNA, 601 bp, Human
tggaaatgtgttcacatgaaaacttgtacgtgaatgttattcataatagacaaaaagtggaaacaacccatttatcagttgatggacttgtttttatcgacttaccagtccatcaactgataaattgataaggtgcgatatatacatacaatgaaatatttggtaatgaaaaagaaatgaagtactgataaatgctacaacataaatgaactttgaagacattatgaaagtgaaagaagcagtcacaaaagactgtattgtatgattccatttatatgaaatggccagagtaggtaaaacyatatagagacagaaagtagattagtggttgcctagggtcagagggtgtggggagatcaggtggcatctaaggggttgggggaggttatgggggtaatgaaagggttctaaaattgattatggtgatgattgtacagtcctgcgaatcaactaaaactattgaattatacactgtaagtggatcaattgtaaatgaatgctatttcaataaacttgtaaaataccgtatcttatcagctctttaaggtcatagaggttcttcagagtttctcttatacctcacacatttaggcagaatctc

SEQ ID NO: 67789 - DNA, 601 bp, Human
ttgttaaagctccttccctttgttcattggaaggccatcagaccccctttcagcctatttgcccttattttacatagcatgctaataagcaagttgctgatttccaaacccaccagactagaaacaccaagttagaaagggtgttaagggtgtgctatacagattgaattgtgtctccccaaaattcttatgttgaaaccttaattcccaacatgatagtattaggaggtggtgcctttgggagttaattaggctgagttgaggtcataaaggtgggaccctcatgatgggatttgtgccyttataagatggaacaccacagagttgaggcccccttacccccatgtaagggacacaaagagaaggcagctacctacaagccaggaagagagccctcaccagaaaccatccatgctggcatcttagtgttggacttctagcctccagaactatgagacaatttctgttgtttaagttgtgcagtctgtggtattttgttatggcagcctaagctgactgagtcatagtagtagcctggaaaaaaggtagctcttagtctaaggggacaagggcactgtgggggaggggtgcaccagcacaa

SEQ ID NO: 67790 - DNA, 601 bp, Human
atagagaggggctgccagtttcagctttgactatagctgtgagaagaatgttagtctcagtccttctttggaaagcctttaaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggrgtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttgga

SEQ ID NO: 67791 - DNA, 601 bp, Human
agtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccayctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctc

SEQ ID NO: 67792 - DNA, 601 bp, Human
gccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccrcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaatactctgaaaac

SEQ ID NO: 67793 - DNA, 601 bp, Human
ctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccraagtgctaggattacaggtgtgagccactgtgcctggccaattcttcagttaataactaatgttcagttatatgtctctaaggtttccctcctcccccaaaggtttcttgaaatactctgaaaaccctgaattctaaatcataaatctgatgtagttggtgggagaaaagaatccagaatcaggatgataaaccccaaaaatgactctttgaaccatgccttaaggacttcctggcctaggcttcattggactaaggataacacacacagaaaacaaaacaatttcatagcccccatttc

SEQ ID NO: 67794 - DNA, 601 bp, Human
caatttcatagcccccatttccatcaccctcaggcaaatagaccttgtttcttttgttttgttttgttttttgagacggagtcttgctctgttgcccaggctggagtgcagtggcacgatctcggctcactgcaagctctggttcccgggttcacgccattctcctgcctcagcctcccaagtagctggggctacaggcgcctgccaccacgcccggctaattttttgtattttttagtagagacggggtttcaccatgttagccaggatggtctcgatctcctgacctcgtgatccgccygcctcagcctcccaaagtgctgagattacaggtgtgagccactgcgcctggccgaccttgtttcttatatgagtttcttttatatggtgtgaggaaaagcggtatggtttatttcctctattttccagaactgcgtttaaggtttacctaaattacccctcctccaacacattctttttttctttatcactgtagaagcagaatggtgcggtaggagtggccagctcctgaaatattcctcagggactgcacttggtgacccctagatgggggccagcattccgctttgtcatatttcag

SEQ ID NO: 67795 - DNA, 601 bp, Human
gaatgtgctcccctgagagatggcaaagagctccccaagagctgctgtttagtcatcctgaagacaaagggacaatggggatgttttcacttgtgtccttttccccaaaacttctccccatgggtgatgggactgccattcttatttttcagattaagaccagccaaagcaaagcagagtaattgttttaaggcagcagagagtgggacaatttgaattactttttgtctctcatttagagggaatgacagttaaaactgttatgcttctttgtgtacgtgctaaactcttcattttattkgtcctaactaggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagcta

SEQ ID NO: 67796 - DNA, 601 bp, Human
ccacaagcttagcattccaataatggaacactaggcataaataggttaaacaattttcctgtttttgctattgcctcattacagcagtgtcttaaaacagtagccagagagataccattaaaatataagtcagatcatgtcactcccctgtttaaaaccttcccatagcttctcatctcacttgagactggcccagccaacatggagaaaccccatctctactaaaaatacaaaaattagctgggcatggtggtgcgctgcctgtaatcccagcaacttgggacgctgaggcaggagaatygcttgaactcgggaggtggaggttgcagtgagctgagacggcaccactgcactccagcctgggtgacagagtgagtgaggctccggcaaaaaaagaaaaaagaaaaaaaaatgaaaagctgaagtccttataaccacatgaccctacattatctgagtagcccatcccctaccccaccagctccctgacctcatcttctcctactccctctgctcgatccatgcagccatagtggcttcctggctggtcagggctcctgtgcttaccgcttctcccacctggaacacccttccccagaca

SEQ ID NO: 67797 - DNA, 601 bp, Human
tctctctctccactcttccttttcattcccacctttggttactaactgtcataaaggataattgaactttgtaacttgtaaagaacttaaagatggtctatgccacctgatgagggaatctaaccaagaaaagatgagctgatgtgctgcagatcacccttgtagaaaatgaaagaattgggggtaaaacccaaatctttctgttatctagagaaatcaggagctggaagtcttcagccttacaccacctagctcttgagtttcatttccctcgtccctgaacttcctgtcttccaccagsttcctctgtcttaccattaaggaacttctgaggtccttgacaccaaactgtctttcttccattaaccaattccccaatgttgtcttatctcaattgcatgacttctcttatcctacttggaaatttaattgttcattctggtttttctcttagtcaataccacacctgccaaaacctcccagctcctttcttttaaccccttccgtaactgttgcagacaaaattacatacaaaactgaagtttgtgaccatgactgtctcacaaagggtcctgttctctccacctaggattttggaatc

SEQ ID NO: 67798 - DNA, 601 bp, Human
ttgctaagataactggaagaaggtctctgccacgtagcaccagtgtccctcctgctagtgctcgagcctggtgataaggagtctcaccctggggaaagataccagccctagaaaagacaaagaggcctcaacgaaaatacttctcaaaaccaaggaggctgatcagaggcaaggtacacagctaaccctctaaccctcatgatcccaggagagctaatttaatgacatctaagtctcctgaagctccctggatcatagtagggttggtcctaggctagctaaggccaagcattccagggcyggcctctcggatgggcggccctgtgtgatcacgcagatctgtgctcagaagggcctgcacttggttgacagctctgctgtcacgttcttgaaatcttcaacaattttctctttgaacttgtattttgtaagggagccagaggagcatgaggatgagcagaggagacaggcggaagaagggagagagctttatattttagtaccttcagtggcacatctcccctgccttttgaacaaaagacccacaaattatgtagcaggctgtcagcagtcctgatggaaccccctcccatgtaaccag

SEQ ID NO: 67799 - DNA, 601 bp, Human
catgcaactgagaagacacagttttagtttctaagctgcatgcaaactcaggtagagcctccagaacaacctgggtctgctgtgtcacctcagcatcttcactagttctcccagtcccagcagaaggcacagagctccactgtgagacagcattcgttaagtttgccacatgtcaggagtcacagagggatgtctaagcagtcacgcagatcctaggaactctgctacatgttttgcaacatatggaccctcagaagtaaactcagtacgtctctggagcatctttcaacagaacagtacratgtctagagatccctcaatagaacatcaggcctaactgtaagatgccctagaaccaaggagcttggaacatatcctggggaggaaaacactgaccttccaagggaagagttatttaacttgtataaaaagttctggctgggcacagtggctcacgcctataatcatagcactttgggaggctgaggcgggcggatcacgaggtcaagagatccagaccatcctggccaacatggtaaaactccgtctctactaaaaatacaaaaattagccgggcgtggtggtgggcacctgtagtccc

SEQ ID NO: 67800 - DNA, 601 bp, Human
taacaccccataaatgagcattaacctcttgtaagacaatctctatgtccttctgagagtccactccatgcaactgagaagacacagttttagtttctaagctgcatgcaaactcaggtagagcctccagaacaacctgggtctgctgtgtcacctcagcatcttcactagttctcccagtcccagcagaaggcacagagctccactgtgagacagcattcgttaagtttgccacatgtcaggagtcacagagggatgtctaagcagtcacgcagatcctaggaactctgctacatgttttgcaacatatggaccctcagaagtaaactcagtacgtctctggagcatctttcaacagaacagtacgatgtctagagatccctcaatagaacatcaggcctaactgtaagatgccctagaaccaaggagcttggaacatatcctggggaggaaaacactgaccttccaagggaagagttatttaacttgtataaaaagttctggctgggcacagtggctcacgcctataatcatagcactttgggaggctgaggcgggcggatcacgaggtcaagagatccagaccatcctggccaacatg

SEQ ID NO: 67801 - DNA, 601 bp, Human
gtgataggctcctgtgtccaattcagattggtgacatgctgcttgaaactagtaaaccttgtcatcaggctaattttacaagtcccttctcccctctcatttatagctacttatatttctctgcttttctttatgactttccacatgaagcattctctaaaatatttttgggcaaaacttcattccatgcttcctcaagagtgcagtaatattggaagcacagtttgcaggtcactgtaagaggtcagtgagaagtctcctggtgttaatagcttgagtaatattgttttctcctttagaycacaccattaaattgctttcattacccacaaaggggttatttgtgtcagagcaaataagatctcattcaaattcaaactggataatttcaacctaataaaatagtttatttctaataactagaagaacaagacaatgacaaaaaattgtaaagtctttttaagacatacaagcagaagagaagaaatgtattttttaaataggtcctacaagagttttaatgtgctatctggaaattttggagggggctaccctgtagtttattctcctagaaatgggagggtatgaggtatttcccaaa

SEQ ID NO: 67802 - DNA, 601 bp, Human
agctctcttgcataagactcttggaggagagcaaagaagaaaaaaaaagattccctacatgttgagacatggaagaattagattgcaggaaatgaaagccacccaataagcagtgcttcagtccctgtaagcattccgtcaaggcaatttcaatcctccccttaaaagatgaggtctgagagggggaggaccaagtactgaagagaaagtgagcttccgccttggtcttcatgctgcttaaaagtcaatcaagcctggggtggggacagggctgagccacaagtgcaacgcctgtggaggstctggcctgcagaaaatctaactcctgtcttcaccttcacatttaaaactccatttcttcttttgttcctgtcctcttttgccctccacacagctatgcctcatctcctgctctcaggccaatactggaatcctgagtagggggtagtagtgtactattcttagacatccaagaaacttcccaggcttggtaagtgaaagtttctctttgtgaccaccttccaacaaacctcttttttcaactgtgatttcttctctccaatggtattaaaacacatttaatgaactgggttcttacaag

SEQ ID NO: 67803 - DNA, 601 bp, Human
tgaataacacagggctttccaacacctagttccaggatgttccttaggcatggtaatctccacacccttgggttgtatgagacactagtgttcctctcctttttcacttaagctgacgtgagttggttcttgtttttgcaatcagaagtatagttaatacattgaatggacttctacatttaagtatagggcaagaaattgaaacacacagttccttccagataagtcataaccaccactatcggatcaatcatttgctatagttctagagtcccaaacaaaagaaattcagtcactggtyaaaagccaaaaggtttccagggtttgaaacaaacctataacgtatggttatgcaagctgaattttaatcatgcaaatgaatgagcagaaatcattttccttacattgcctttagctccataagttataggtttgaaaagatgttttaaaagaaatgcacttaagtagattagttttcattttgataaaataaaaagtattagtgcaaattataaacttcatcagtctgcttattcatagcactcttaaaaattgtcttctgaaaaaatttatctgctaaagtacttacaagtaagcacat

SEQ ID NO: 67804 - DNA, 601 bp, Human
gtagtgtaattaagtattgcatcccttgtcagggacacagtcttttgctcaaagattactggaatagaaaccccatttcctgaaaacagtggccggtttttaccaaagaagatacagaaacacagaaaagttttattcactgtagaccttcttctgagcaagccaaagccttgatcctcatgtctacaacatattgaaaggctcactggaatttccttgtgaaacagttaccagaccttttacctcaagtggtaaccagtccttcagttttcaacagttatccaggctttggcaatgaaartaataagtattcactgagggatcctttctttctagatcacagatcaaaaatgaattcccgaaactccatttcccatttttgtgatacatattaaatcctacttaaaacacagcataatcatgaaaatttgtatttacttaagaggtttacaaggacaaccgacggccccttatgacaattaaggtttgctttactcattattaaaaacattttgaaacaaaaaaacccattacaactaaaaatctggacagtccctggattaggctgtggagtttgtcctttggaggaaaagaaaagtga

SEQ ID NO: 67805 - DNA, 601 bp, Human
ctagattgacgtcaatcttgtcttaatcaccaaacttcaggtgtaactgttcagttattgatgaatctcctaactgttctagcaccctgcccacacttcttggtcaacagaatattgtgtccaattatcaaaggccttctggacatccatatactacatactttctagagcattttctttatttaactagcaaccttatcacgaaatgtaaactgagttaatttgtttaatttacctggtttgtatgaatatgaatgcccccccaaccccggcctttttttttttttttttttttttttttacttagaaacccattctacatggctgggtgtggtggctcacacctgtaatcccagcactttgggaggccaaggcgggcaaactgcttgagcccaggagttcaagaccaacctgggcaacatggcaaaactctgtctctacaaaaaaatataaaaattggctgggcatggtggcacatgcctgtagttccagctactcaggaggctgagctgggaggattgcttgagcccaggaagtcatggcctcagtgagtcatcatcgtaacactgcactccagcctgggcgatacaatgagatcctg

SEQ ID NO: 67806 - DNA, 601 bp, Human
cacctagtggtgtttaataaatgtttgctgaatgaaggagcaaggagtcttgattcaagttcagatcctggactagagtgtgagttttaaaaggccattctatttctctgctcccagtatctccatctatatgtcactgggattggatgagaatgccctgtaagggtcctgtctgctgttacatttgatggttgtggggttctctcgtagcttcctttagtcacagccaacatgcagtgctaggaactgaggagaaagacaaacatggatgctctgcattgtgcaatgtgagagaatctcrtggtaaaatttaagacgcatgtcacctgactccagcaaaaactgggatcttgatggagtacaggaatgctctcagatattcaatatctaacatgcaatgggcatttgttaagtgtcaggcactgtggctcatcactgggaatagcaagataaggagacagaggagtaaatgattccaggcaagatatacccaagatgatgtaagggcacgctgcctaactgtcttcacaagggctgaatttaatgttctctgcaaggccaccatgttctgtgtttttaaatggacaggaatgttaagaat

SEQ ID NO: 67807 - DNA, 601 bp, Human
ccatctggctgtcctgctagactgacaccctcaggggagatctcttttgtgccttattcaacttagattacccagtgcttagccaaatgctatacacctagtggtgtttaataaatgtttgctgaatgaaggagcaaggagtcttgattcaagttcagatcctggactagagtgtgagttttaaaaggccattctatttctctgctcccagtatctccatctatatgtcactgggattggatgagaatgccctgtaagggtcctgtctgctgttacatttgatggttgtggggttctctcrtagcttcctttagtcacagccaacatgcagtgctaggaactgaggagaaagacaaacatggatgctctgcattgtgcaatgtgagagaatctcatggtaaaatttaagacgcatgtcacctgactccagcaaaaactgggatcttgatggagtacaggaatgctctcagatattcaatatctaacatgcaatgggcatttgttaagtgtcaggcactgtggctcatcactgggaatagcaagataaggagacagaggagtaaatgattccaggcaagatatacccaagatgatgtaaggg

SEQ ID NO: 67808 - DNA, 601 bp, Human
gctccaagcagtctctggcaatcaaatagaatcagccttgaaatgaaacctacttatccccattatagtaaaatgagcataggcttgaaatcaagcagaccctgagttgaaatcctggttatgactaagggcaaatcagatcaccttcctgggcctccatttcttagctatggaaggagcatgatgatatgacccaacaggatttttgtgaaaatggaatgagataatatgtggaaagtgtccaacacagaaagcactcagagaatattagttgtgactacccagatagtgttggttactycctctgctgtccttcttaggcaacttataagcagatctgggagagtatttcagttgctgctgtgtgcccacacatgtgtgcgcacacaatttctcacactctgccctgtttctgtatccatctggctgtcctgctagactgacaccctcaggggagatctcttttgtgccttattcaacttagattacccagtgcttagccaaatgctatacacctagtggtgtttaataaatgtttgctgaatgaaggagcaaggagtcttgattcaagttcagatcctggactagagtgtgagtttta

SEQ ID NO: 67809 - DNA, 601 bp, Human
tgctctttggctcgccgtgccaggaatgccttctcacctcctaatctgaggtctgcttttctttctaagcttagtgcatactctgccttctccactggagctctcccatctcttccaccacagtgtccatttcctcctctcaactcctgtagcactttctacctatagcattcacgtggcactgggcacattacctgcttaattcctctctagcatttcctgagaactctgggtcaggcagtgtgctcagggctttacatgcacttcccctgtaaaactcacagccttacaaagttgctayttttattattatcctagactaacatacaataaatttgaagtttagagtagctcaacagtttgtcctaggtgcacaagccaaaaaatagaagttatcatttgaactcaggcctgacttccccatgcaaactcttgagcattgagctatactagaggtagtttttaatacatacgtcttgtgtctcaggtgtgttctaagctccctaagcaggtatgctgtgcctcatgtgtttgtattcttagaactaagtatctagcccacactcagtagcacaggagatgagccaggtgaatgtgactg

SEQ ID NO: 67810 - DNA, 601 bp, Human
tgttctctagtttagccacctagtatgtttgtgctgttctgtcgaagaacatttgccttttgttgttcattggaaacagcataaagatgagatcagcagatttttatttctcttctgacaccacggccagccaatcagccaatatttttgttggattcctttggattccttccctccttccatctctccctccctttcttcctttcctggccaaaaaaaaaaaaaaaaatctttcctttaacaaccaaagaatgatgtaattgtgatatatgtagctttatggtcagacatgacatactayggaggggcccttgaagtccagaggtaccctcctactcctccttcactctcttcagtagtaagatgctttacgggccacagctgagcagcctagcacaaagtcaggaacatggctctggtgccaggctgcctgggttccaatcctggctcttccactgatcggctgtgtgcctttgaccacatcacctaacttctctgtgctgtagttacctcaggcttaaaatgagggcaggattagtaccattcccaagggtttttataaaaattaaatggattaattcatatacaatgattaaaacag

SEQ ID NO: 67811 - DNA, 601 bp, Human
ctcagcttcctcagctgtaaactgaggactgactttaggctaggtctgagtttttctagtggtgggtcagaacttgttagtgggtgtgcaatcaatgtgacagattcagactggttttttgttttattcagactggtttgaaacaagtgaaggaactggatgggcagccaagtttgcaactaccaacttgagaattcatattagtaagtttttagccataccacccgataattgtgtctgagaaacaaacaagtcaaatttgtttgagttttatggagagttaaaagccacagtttcacaraattcggcagtttcctacttggaaaagagttcagaagccgcttagcctgatctttcattcataggaaaaaggccttccctttgtacatctcagaacaatccaggcaaaggaaatgccctggtcaagggaggctcttcaactgctgaacaatggtttcttctcttaaataacttcatttaggctgggcgtggtggctcacatctataattccagcactttgggaggctgaggtgggtggatcacccaggtcaggagttcgagaccagcctggccaacatggtgaaaccctgtctctactaa

SEQ ID NO: 67812 - DNA, 601 bp, Human
aatgcctgtaaaacttaaaggtcattcggagttgaagtgcttccagaacacggttaatttcttctgagagcggaaggtgcgggtactccacactttacatcaaacagtaaaaaatcatgaaaatggaatttctgtatggcgataaggtgtgtgtgtgtctgtgtgtttgtgtgtgcatgtatacacatgcatatatatgtgtgtatatatgtgtcagaatggttgtgaaataaaagttggtttgcctttgtaaagttcatatatttttataattcagaatgtccaaataacagatggtatytgttatatcaccaggagtgaatgacatgttagcacttaaagtgggcctggtgattttagtttgtgtaaatattacttgtaatgttttcatggttgtaacataagaattaggctaattttataactttgcatgaagaaaatagcttttttctgtattaataaagtagaattcatttagaaggatttagtcattcattttgtttaacataaatatatcagattatgtggtttatgtttcatcagtaaggttttggtattcattttcaggagcttcagaaaagtttgatgagctattatataa

SEQ ID NO: 67813 - DNA, 601 bp, Human
ttagaattaacattttctggggtaagacctaaaagctaggtgagattccatcttcatctccacaggttttggagataacattaacttaggtacctgttgttctgctgtagtgaattaggaaattgtattgatgtatctcaaaacttaatgaaagaataactggtactattacatacctaactgctctgtgtgtgtttttaaaattactcttgaagatatattccttttaaaatttgggcgtagttatttaaacgtcagctaatacagagaaacataaacttttagaaatatgataaaattytcagagaagttttaaactcttgtcagttaagtttgttttacttatccagtctcttccttttacaccagccccagtcaccaacacaccaaaaaaacacgctacttcttttaacctgggaggggtttttatttatttcattttaaaaaaatactatacctccaggttgcctatggggctttgtgttatacattcattgcaaaaatgttgaggcccatgggtgaaaagtgttggtagaggtttgaatgtagattctttcatgactgcaagtcgtaaagttaccatgtgacctagtgttcgcat

SEQ ID NO: 67814 - DNA, 601 bp, Human
ggtcccaaaattcctttgcacatctgcctctttatcaaatctctctaacaaaaatgtaactcatgataaactcagctatgtgctttctcagtgctttcagtcaagagctaagcactgctagagaaagctgcacagaagaacactagaaatttactatcatcaacctcaaatgagctgtcaacatgactttacagttttaccacatttctctgatcaactctgtctctcattcttcacaagttctatttcatttctctctctttatacctctgacttctccattatctctctcattctaagycatgatattatgtcatattttacaaggaaaataaaagctatcagacaggaacccctttaacttcttcctattaaatgttcacacctactgtattttaacttgaccatcttattctgttataatagaggagttgtctgttatatttatctattgttccatcatgcaggactcctaaatttagcagcttaaagagtgacaacatttattttacttatgaaagtaagtaatttgggcagagctcagctatgcactctatatgacatcagctatcttagctctgctaataaatcactgctatgg

SEQ ID NO: 67815 - DNA, 601 bp, Human
aaacacatgaagccttgctcatttacatgtttccctgttgatgctggctgtacaggtaatttgaaccttacctgggactgtcagctgaagcacctacacatgacctctacatgtggcttgggccccatatcatgtggctaagttccaagaaggagggagagagccaggtataagctgtatcaccttttatgacctagcctccaaagtcaagcagtgtcacttcagctgcattctgtttgttaagtgagtcacttaaatgagtctgtatcaagggaagttgaattagattctgcactttgayggaaggagttagaaaaatttggggacatgtagaaatcacattgtacatctttctctgcaagcccaatcactccactattactttggatcccaacccctcctgctttcccaggagtctttgtattcttatcttttatatgtataataatatgtcttctcatttatttaaaaaacgtgtaccccttttcccttcactttcagttttctctttgaccctactttctctttccctttctcatcgctcacctactaaagtgaactggcctgtgatttacagtatgtgtgatcaaatcagttgact

SEQ ID NO: 67816 - DNA, 601 bp, Human
caagaaatagaatattactgaaaccccagaaacttccctcctgcctgtacccaatcattgctagatttaaaatgtggaatactgcatcatgttttcctttgtgactgccttctttcacttatgtatttgtgacacttatccatgtttttgtcatagcagtgatttattaattttcacagatatatatcattgtataagtatagcaaaacatattttttctatggttgatgtaaatttgggttgtttccagtttggagctcttataaataatgctttgaacacacttgtacatgatttttgrtaaatatatgtatgttttggtgaatatgtatttgatgaatatgtgttatgtatacactcatacatacatgcatatatacatgcatatgtgtctttgtgtgtgcgtgagagagaatgatgttgaattaattgctggatttctgggtcacagatcatgtggttctggtaaataccaccaaataaattttcagattggttgaacctgtttctaaccagcagtgcttagggttttagtcgctccacatccttcccaaacttgatgtttttcatatttctaattatacctattctggtaaacatt

SEQ ID NO: 67817 - DNA, 601 bp, Human
aatattactgaaaccccagaaacttccctcctgcctgtacccaatcattgctagatttaaaatgtggaatactgcatcatgttttcctttgtgactgccttctttcacttatgtatttgtgacacttatccatgtttttgtcatagcagtgatttattaattttcacagatatatatcattgtataagtatagcaaaacatattttttctatggttgatgtaaatttgggttgtttccagtttggagctcttataaataatgctttgaacacacttgtacatgatttttgataaatatatrtatgttttggtgaatatgtatttgatgaatatgtgttatgtatacactcatacatacatgcatatatacatgcatatgtgtctttgtgtgtgcgtgagagagaatgatgttgaattaattgctggatttctgggtcacagatcatgtggttctggtaaataccaccaaataaattttcagattggttgaacctgtttctaaccagcagtgcttagggttttagtcgctccacatccttcccaaacttgatgtttttcatatttctaattatacctattctggtaaacatttcctggttat

SEQ ID NO: 67818 - DNA, 601 bp, Human
attttaaaaattacatttattcttagtttcacatgcttttttgttactataaagggtatcagtgtcaaagttttatcttctaatttttcattgtgagtatataagcatagggttagaaattttatgctgacctatctagtgatcttgctaattttattaactgtaagttatttatagatacatttagattttacatatacacaaatcacttttttgcttaattttgacagtgtaagttttttccttttagtccttatacattttttttgccttattgcactgattaggacttgcaatacartagtacatagaaatcatgataacagccacacttgtcatattcctggtgtcactggaaagctttcaatattttggaaccaggcagaaaatttttaagatatcctgttatctgtttaaggaaggtttcttctattcctggtttgctaattatttttcctttgagaatgggtatttaattttatcaaatgttatttctgcgtctatgagttttgaatcttaaattaatattgcatacctggaataaacccattctggttgcaatatattgtccatttcatatccttttttaatgtaatagtga

SEQ ID NO: 67819 - DNA, 601 bp, Human
cactgaattcaaggtattctgtatcatgttatatttctttagagaggacttattttacttctggtgtgattcaatattatttttactaattgcagtcatgtggtatgtaacaacatttcagtcaaaaacatactgaatatacaatcatggttccaaaaattatactacttcatttttaatgtactttttatatgtttagatacacaaataccattgtattacaactgcctacagaattcagttagtaacatgcagtataggattgtagcctaggagcaataggctatccatatagcttagwtatgtagtaagctatacgatctaggtttatgtaagtgcactctatgatgttcgtacagtgacgagattgcctaatgacacatttctcagaatgtatccctggcattaagtgacacatgactgtatttaacactccatcatgcattattattattgttcagggccctcaatatttatatttatcccatatttgctgtttttttttttttttgcgcttattccttcatgcattctctggtctaagttacttgtgccataaataagtcttgtgtaaaggtgtcctagtgatgaattatgtcag

SEQ ID NO: 67820 - DNA, 601 bp, Human
ccattgtattacaactgcctacagaattcagttagtaacatgcagtataggattgtagcctaggagcaataggctatccatatagcttagatatgtagtaagctatacgatctaggtttatgtaagtgcactctatgatgttcgtacagtgacgagattgcctaatgacacatttctcagaatgtatccctggcattaagtgacacatgactgtatttaacactccatcatgcattattattattgttcagggccctcaatatttatatttatcccatatttgctgtttttttttttttttgcgcttattccttcatgcattctctggtctaagttacttgtgccataaataagtcttgtgtaaaggtgtcctagtgatgaattatgtcagtttttatttatctggatttgtgtattttttaccttcactttttcaggatatattttataagtatggaattttaggttgagaattactttctttgaacactttgaagatgtttcatcatgttttgttttccattgttttgttgagaaatcagctgttagtctcagtgttgctttatgaaggtagtatatctttttttttctttggttgctt

SEQ ID NO: 67821 - DNA, 601 bp, Human
tgaaatatttgcttagttttctaatctcctaaaaaggtgcttctcactatctgttctttagtgtcatgccttaggtatcttaaacatctgaatgcttcaagaagaaaaagtagtacagaatgttgggatttttatttctggtttcttggccctaaagtctctgaattccatttttttcccttgtcagccaagtgtaatgttgaatatttgagccttagctttttgcatgtcctttctaccaattgaggaaatgccctgagggcaaaagctgtaaagaatcttgatctctaatcatttcccrtcttttcaggaccttggtgttcctcaaaacctgctgactcctttgctaatactttcaaacaactcttaccccattcctaccaatatttatgttattttaacaagagttttttttatatatcactttattgaagcagaaatcccttgatagtattttttctttttgtaaatctgtgcaatgaatcatagtataaagtgtgcacatttttaagcttatagattgaagagggtttacaaatgaattcctcatataatcgtgactagatcaatatatgcaaattaacagcattctagaaggttc

SEQ ID NO: 67822 - DNA, 601 bp, Human
cttttcaggaccttggtgttcctcaaaacctgctgactcctttgctaatactttcaaacaactcttaccccattcctaccaatatttatgttattttaacaagagttttttttatatatcactttattgaagcagaaatcccttgatagtattttttctttttgtaaatctgtgcaatgaatcatagtataaagtgtgcacatttttaagcttatagattgaagagggtttacaaatgaattcctcatataatcgtgactagatcaatatatgcaaattaacagcattctagaaggttccyttgtccctccagagtcaataagcatgcttccctcagatgtaaccactattcttatttctgtcaccatatattagtttcgcctgtttttgagctttacttaagtagaataacaattatactgttttatatctgggattttaatttcaacattgtttgcaaaatttagtcctgttgctgaaggtagggttctttactttttgttaatgtatagtgttccatggtgtgaatacacaatttattttttctttctacatttgatggtaattgggttgttttccagtttgggactattatgactag

SEQ ID NO: 67823 - DNA, 601 bp, Human
tactttcaaacaactcttaccccattcctaccaatatttatgttattttaacaagagttttttttatatatcactttattgaagcagaaatcccttgatagtattttttctttttgtaaatctgtgcaatgaatcatagtataaagtgtgcacatttttaagcttatagattgaagagggtttacaaatgaattcctcatataatcgtgactagatcaatatatgcaaattaacagcattctagaaggttcccttgtccctccagagtcaataagcatgcttccctcagatgtaaccactrttcttatttctgtcaccatatattagtttcgcctgtttttgagctttacttaagtagaataacaattatactgttttatatctgggattttaatttcaacattgtttgcaaaatttagtcctgttgctgaaggtagggttctttactttttgttaatgtatagtgttccatggtgtgaatacacaatttattttttctttctacatttgatggtaattgggttgttttccagtttgggactattatgactagaacttctgtgaacattgttgaccatttttgtgcattttcatacacacc

SEQ ID NO: 67824 - DNA, 601 bp, Human
atataatcaagttggggaaccaggaaacctggtgctgtaacttagtctaagtccaaagacctgaggaaaggggagagaaaatggtttaagtcctgggctgagtctgaagaccaaagaaccaggagcactgacgtccaatagcaggagaaggtagatattccagtcttaaaagaaaagaaaaaacaaaaacaaaaacaaaacgtgcgaatttgccctttctccacctttttgttatattcaggccctcaatacattggataatgctcatccacattattaaggtcggtcttctttattcagsctgctgattcaaatgctaatctcttacagaaacattctcacaaacacgcccagaaataatgtttaccagctatctgggcatcccttagtctagtcaagttgacacataaaattaaccaccatagtgggtgtatatcaggatataattatgcttttaatttttgtttccctgatgattaatcatgttgaacacgtttttatatgcttattgggttattcagatatccttttttagatgtaatgcctattaccttaaattaaatcttttgcctatttttctactgggaaaagaaaataggag

SEQ ID NO: 67825 - DNA, 601 bp, Human
agcaccatattataccatttccctaacacagtgaggaaaattttcttttaaaaattatgtacttaaaactcatcaaatctgaaggaccttagaagatctatctacctacctatcaagtttgtagagtattacatagctttttctatgtgtcaggcactgttatcaatcctataacaactcatttaatctttacaactctttgaggtgggaaccatgattgttcttattttatacaagaggtaactgaggcatagattaagtaacttgtccaaagccacacagttaaaaagtaggcaagctrggacttgaacccaaacagtgactctagagtgttgttaaccgtgccatattgactgcctttctaaaaatttgtgaagtttttacttcatttagttttctccttattataatcttttcaatgataagaaactcattacgctgtaaggctatgtgccagtcagagttacaccagagaaacagaaccagtaggatatatcggaagagatatattgcaagaaattgacttattgattgtggtggctggctaggtaagtctaaaatctatagggcaatctgcaatgaagggcaagctggacctctc

SEQ ID NO: 67826 - DNA, 601 bp, Human
tcctagtgccaaattgtaacaggaatttaatctatctaaatacagggagcagtgatttacataataaatgagataattattatttaataaagatttagagaattctctagattcctgtgttcaagaaggagggcctcaaagctgcctgcagttatatttttatgataattatttattactatctcatgacttaaaaattttcttaacaagtaaaataactaccttttaaaaaatactgtaagaccctttgctatgacctcagataatttaaagtgatgtctcacagacctttatttagacygaaaggcttataaaaattttgtgtgtgcctgtaatcccagcactttgggaggccgaggtgggcagatcacgaggtcaggagttcaagaccagcctggccaatgtggtgaaaccccatctctactaaaaaaaaaaaaaaatacaaaactacaaaaattagctgggcgtggtgttgggcacctgtagtcccagctgcttgggaggctaaggtaggagaatcgcttgaatctgggaggcggaggttgtagtcaaccgagattgcgccactgcactccagcctaggcgacagagcgagactcca

SEQ ID NO: 67827 - DNA, 601 bp, Human
taagtgggagctaaataatgaaaacacatggacagaaagatgggaacaatagacactaggatatacttgagggtggaaggcgggaggagggacaggttcagaagaaaaagaagaaaagaaaaagaaaaactattgggtatacctgggtgatgaaaaaatctgtatgccaaacccctgagtcacaagtttccctatataaccaacttgcacatgtacccctgaacctaaaataaaaattaaaatactaaaaaaaagtgagttttaacaaattgagattataataataatatagtgcttattrtataccagacaccattataagtgctttaatctgtttatttaattcacccgaagaccctccaataaggagtgtacttttattaacctcatttgcagatgagaaactgatgcccatagttgttaagtaatgtgcccaagatcacataactgggattcacattcagatagtcttgatttaagaacctgccctagtaaccattattctaacctgctatccatattatatattctgacaaaatttgcttttttcatttttgaatttttctttgcatttggataatcttctgtaaggaatttgtcg

SEQ ID NO: 67828 - DNA, 601 bp, Human
aacaatagacactaggatatacttgagggtggaaggcgggaggagggacaggttcagaagaaaaagaagaaaagaaaaagaaaaactattgggtatacctgggtgatgaaaaaatctgtatgccaaacccctgagtcacaagtttccctatataaccaacttgcacatgtacccctgaacctaaaataaaaattaaaatactaaaaaaaagtgagttttaacaaattgagattataataataatatagtgcttattatataccagacaccattataagtgctttaatctgtttatttaatycacccgaagaccctccaataaggagtgtacttttattaacctcatttgcagatgagaaactgatgcccatagttgttaagtaatgtgcccaagatcacataactgggattcacattcagatagtcttgatttaagaacctgccctagtaaccattattctaacctgctatccatattatatattctgacaaaatttgcttttttcatttttgaatttttctttgcatttggataatcttctgtaaggaatttgtcgtacagtcagtatgttaaatgtattaaaaaataagtgtatggaac

SEQ ID NO: 67829 - DNA, 601 bp, Human
atgaaataatacaaataaaaaacaatacagtataacaactatttacatagcatttacagtgtattaggtattataaataatctagagatgatttaaagtatatgggaagatgtgcataggctatatgtgtgacagtgtatgtatgtttacatatatatatatgtaagtatatatatatacttgagtttttcccataatgttcaatttcctctggaaagaaaatgtaaacttgcttcctctatgctgtatcatcatcttattctcaaattcccttcaaaaccaaactttttaattagtaggrtaacacactgcttccattttcttactttgtgtttacgcctcaaatcctctgaggctgatatctattccttcctgccgtggcaaaagtcatcaataatttgttgtgagttttttcccttactctatagtagagtttccctaatctatagtgttttccccaagtgacttattcactaattacttcatgttctgtcagttccaattactttctatctttgtgacaacatatatctcttctgtgctctgagtgtaatttttgctggatatgaaccctgcaaagtcaaattggggaaattatcgt

SEQ ID NO: 67830 - DNA, 601 bp, Human
ttactctatagtagagtttccctaatctatagtgttttccccaagtgacttattcactaattacttcatgttctgtcagttccaattactttctatctttgtgacaacatatatctcttctgtgctctgagtgtaatttttgctggatatgaaccctgcaaagtcaaattggggaaattatcgtttcctgaatctgcacttcctattttggtgaaaatgatgcacctctttagtcatataagccagaattttgggtgtcatcttagattctttaattttccttgtcttctacctctccttrttgactgagtcttaggaatttgtcccttcatttctaatttcactgattctagcttagttcaggtctttatcaccctttttgaggatatctacaacagtttcttagccattctccctgccttcaatttccctagtcgatcttccaaatctaatctaactccctgcttaaaattatctttatggtgctccattgcatataagataaaatctattcttagcctgacatataagatgatttggcccctttatcttgtttcattttttccctatcacttcttaaagtactttttaaggcacaata

SEQ ID NO: 67831 - DNA, 601 bp, Human
aatgtatatccattggtgacattgccattagcattggaggcaagtgtccatttcataatagatggtgtcctaagttggactgcttctttttttttttttttttttttgtttgatacggaatctcactctgtctcccaggccggagtgcagtggtgcaatctcagctcactgcaacctccacttcctgggttcaagcaattctgctgcctcagcctcccaagtagctaggattacaggcatgcaccacaacacctggctgatttttgtatttcttttcagtagagatgggatttcaccatgytggccaggctggtctcgaactcctgaccacaagtgatccacctgcctcggcctcccaaagtgctaggattacaggcgtgagccaacatacctggccgtactttttaactatgtcttgcctcatttggttcctggctaaatctggcttttcagtcttctcatccattccatatgtactcaatctaataaattcattttctgcttaaattgactagcatcaatttttaatttacatttttgcaactgacaacccagactagtacaggtcctaaaggggactctaattcacatgtcctcccaa

SEQ ID NO: 67832 - DNA, 601 bp, Human
aggtttagttcacagcagtccatggtagagatgtgaactgctaaagttctgtcacttatgctgtccctgtaatatggagcccttctaggctcccacccaatcttgaccaagcgggccacttgcttccttttccttctgtgcctcaaatgttccctgtgtgttctccattgtactctagtgttctttcctagatgttctatttatagtatgattatctattcataattgtggttcttctttctggagagagcaggtgtctcacatctctagtcagccatcttgtaccaaaatcccattattygtaattttctaaatagataatagataatatattcaaaatgtatacattttaacattacagacagaaatatggacttgaagcaaatattccaaaatatcaataatagtatttctgggtgctgggaataagagtgacaaaagaaaaaatctaagaaacaaatataaaacagccatcattctctttggttacctaatataaagcttaaagtgaagaagaaagcctggaaaatggcattgcagacctgagaacagcagaaagagtgaaataacagctccccaccaaggacactgacctttgaaa

SEQ ID NO: 67833 - DNA, 601 bp, Human
tacagtatgaatatgatttttttcattgttcagaagctggagctggaagtgactgaaatacttctgagaaatcttatttccatgaccatgcttgtcatcagaaatacatattcaaatatcatagaagagcatctagtggggagaactttatttttatccaaaactttaagaacaaggagtccaggaaatatattttatagctttccaacctgtccaactattaaagaaggagaatggaagggacattgaatgaaccaatttacaatatccagcatggtccactcttttggctgttcatcasctatttatacccttctactgatgctttcaaagaatggcaattacactattctacagctaacttaatgctactgtccttcatataaatgaaaacactcaacttctacccaaaaagagagatctaaaaatccatcagcccgtatatcaatttctagatgatattcactcatatcatttagccataatatcaccttgactttccacagccctagtactaaattataaagttaatgaccacgccttatgtaaaattcctggggaaaggcaagaaggaaattgatgtgtttatatgtacacacat

SEQ ID NO: 67834 - DNA, 601 bp, Human
ccttttttcatgatttagtgtatttgttacaaaaaataacttgaattcacttttctatataggaacatttttattgattttatgtctcctctttataatctctttcatatttcattatgtttcttctaaatttatcttgtttttttaatacataaatttgaagatgaaaaaggaggtactcctcatatacattcatgtattatacatatatattcatatacatatatatgtacacattcaaatcacaagtctgtcatttttaactttttaattgaaaaatccccaaacttcttgccaatcrtagctaaaactgtacattacccctaaactttcccttattcagatctctaaaatgcctggtgccactccattagcacctgacataatggaaagtgtgaagaaggggaagttggagagaaaagagacagcaatctcaaccaattgctattaaaatatcttacttttgcaagtcttacaaaagcatgtgtccttgtgaacacaatgctagaatctctcccagggtattagaagggttgcctgcacttgagaggtcctgaaatttaatctctgttagcttcacagtaaacctgctgtggccctc

SEQ ID NO: 67835 - DNA, 601 bp, Human
tatttagaaagcccatctggagatttagttatgggactacctggctatagtcttggctagggcgttagtagatcaatgaaattttctcatcaacacgaagggctctaagtgttaaagggagacagtgcccacatcaaccatgactaggagtttcacatgtccatatttcatacattttagtactctggaaatagaatcccactttcctcatccccatcaccttattacatttaagtcttgtgttaattttctattattgctataactaaatagtggcttaaatagtggcttaaaataacayccatttattatctcactgttctgtaggtcagaattctggcaggctcttatctggagtttctggggaagaatttacttccaagctgatccatacttctggcagaatccagtaccttatggttataggactagggtctctgtttcttggttgactgtcatctagggggctcccttagctcttagagccctctctctggtgcttctacataggctgtaatatctcagagccagtaatggtgtgctgatcattctcacacgtgaaatttcatgacatgttgccatggctctcttctgctcctag

SEQ ID NO: 67836 - DNA, 601 bp, Human
cagctctgcaggagggatattcaactgtatcagtattaaaaatctatctttccagaaaagaagtatgaagttaatttacctgctggtattactaatagtttaattaggtaaacagcatgagttcaaaacaattaatcatctgccataaaagtctaattattcctggcacattactgagctatttttactgtgtctgtgagataaatatgaattttgcgggttttttttctttttcttatatttgatagctatagacaataaatttagttcttattttctgttggactctgacttttgaaawgttattttgctaacacattcaattgactatatttactgttttcctaacttgattactactttattttacttctagtgaatatattttatgttttgaagaaaatataatatttcctatacttaaatcataaaattattttaaggataaatatgtacttagtgggaattttttgtttaaagtaagccaatttgccaaattttacattgtgtaaaaaataaagaggctttgctcaggattcctcagattccagtctattctttgttagaattatttcttttctttttttttcttttttttttt

SEQ ID NO: 67837 - DNA, 601 bp, Human
aaaataaagaggctttgctcaggattcctcagattccagtctattctttgttagaattatttcttttctttttttttcttttttttttttttttttgagacagagtttcactcttgtcacccaggctggagtgcaatggtgtgatctcggctcactgcaaccttcacctcccaggtccaagcaattctcctgcctcagcttcctgagtagctggaattacaggcgcccaccaccacgcccagctaatttttgtctttttagtggagactgggttccaccatgttggttagaattatttctktaatgtatgtaccttagctgcaaaaaagcaaaattaaaaaaaaaagatgttttagcatacaagatttttagacagtataggacacatagaactgacagctttcatgttgaagaacaatattgtcttgatttcactggaattgttcatttgggtctatagcattctgtccaaattgcagaaattgattgttatggcatacccacgattttcatgctcatatgttataacagaatagtttttaaaaatcttgtttgaacagtttggttgtttgcatgcttccagtgtttagacttttaaaaa

SEQ ID NO: 67838 - DNA, 601 bp, Human
caatttcacactgagattaaggtgaagcatgttgaaagtaaaacttttatcttttacattttttatttctaaatctattattaaattattaaaatcagaagtgatgagattagcttctagttccaattaagatggagtaagtaaatgcacatcactctattcctcccactgattatgcctaaaaaagattctgaacagaatacataaagtagctgtagaaagactttgaaaagtaaatatagcaggaagattggaaagggaaatcaaaacttgaaaagagacaaatacagtagtgaatttyctgcttttagcaatttcttcctacatcctccagcttagactcaaggcagtcagaattccagaactgtacagtggattcagacagaaaatgctgtggctcacgcctgtaatcccagcactttgggaggcccaggcaggcagatcacgaggtcaggagatggagaccatcctggctaacagggtgaaaccccatctctactaaaaatacaaacaattagctgggtgtggtggcgggcacctgtagtcccagctgctggggaggctgatggcatgaacctgggaggcggagcttgcagtgagc

SEQ ID NO: 67839 - DNA, 601 bp, Human
gagtaagtaaatgcacatcactctattcctcccactgattatgcctaaaaaagattctgaacagaatacataaagtagctgtagaaagactttgaaaagtaaatatagcaggaagattggaaagggaaatcaaaacttgaaaagagacaaatacagtagtgaatttcctgcttttagcaatttcttcctacatcctccagcttagactcaaggcagtcagaattccagaactgtacagtggattcagacagaaaatgctgtggctcacgcctgtaatcccagcactttgggaggcccaggsaggcagatcacgaggtcaggagatggagaccatcctggctaacagggtgaaaccccatctctactaaaaatacaaacaattagctgggtgtggtggcgggcacctgtagtcccagctgctggggaggctgatggcatgaacctgggaggcggagcttgcagtgagccaagatcgtgccattgcactccagcctaggcaacagagcgagactccgtctcaaaaaaaaaaaaaaaaaaaaaaaaagagaaactctctttctctaatgagagaccctgtaaggaaatccctggtgacaaggaa

SEQ ID NO: 67840 - DNA, 601 bp, Human
agaaataaaaagttaacaatattgtctgttggggtttccaatgtgtataggtcggaaacaactaataatatgaaggagaagactttaaagagaaccaaatgtctgtaaggtttataagttacccatgaagtgataaaattttaattctagctgggtgcggtggctcacgcctgtaaacccagcattttgggaggctgaggcagggggatcacctgaggtcaggagtttgagaacagcctcaccaacatggagagacctccctctctactaaaaatacaaaattaggtagtcgtggtggcgygtgcctgaaatcccagctactcaggagaatcggttgaacctgggaggcaggggttgcaatgagccgagatggcaccactgcactccagcctgggcaataagagcaaaactccatctcaaaaaaaaaaaaaattaattctaagtagactttgaaaaatgaagtacatatactgaaatctctagaacaacatcaaaaaaagggaaaaaagcaactctgcaaatttgcagatgttcaagtaattcaaaagaaggcagagaatgagaaatggaagtgaaaaacagagagaagagactccatttt

SEQ ID NO: 67841 - DNA, 601 bp, Human
tcggaaacaactaataatatgaaggagaagactttaaagagaaccaaatgtctgtaaggtttataagttacccatgaagtgataaaattttaattctagctgggtgcggtggctcacgcctgtaaacccagcattttgggaggctgaggcagggggatcacctgaggtcaggagtttgagaacagcctcaccaacatggagagacctccctctctactaaaaatacaaaattaggtagtcgtggtggcgcgtgcctgaaatcccagctactcaggagaatcggttgaacctgggaggcagrggttgcaatgagccgagatggcaccactgcactccagcctgggcaataagagcaaaactccatctcaaaaaaaaaaaaaattaattctaagtagactttgaaaaatgaagtacatatactgaaatctctagaacaacatcaaaaaaagggaaaaaagcaactctgcaaatttgcagatgttcaagtaattcaaaagaaggcagagaatgagaaatggaagtgaaaaacagagagaagagactccattttcagcagtgacatgtaaagaacctagaatctaccactagcattcttacaaga

SEQ ID NO: 67842 - DNA, 601 bp, Human
ataagttacccatgaagtgataaaattttaattctagctgggtgcggtggctcacgcctgtaaacccagcattttgggaggctgaggcagggggatcacctgaggtcaggagtttgagaacagcctcaccaacatggagagacctccctctctactaaaaatacaaaattaggtagtcgtggtggcgcgtgcctgaaatcccagctactcaggagaatcggttgaacctgggaggcaggggttgcaatgagccgagatggcaccactgcactccagcctgggcaataagagcaaaactccrtctcaaaaaaaaaaaaaattaattctaagtagactttgaaaaatgaagtacatatactgaaatctctagaacaacatcaaaaaaagggaaaaaagcaactctgcaaatttgcagatgttcaagtaattcaaaagaaggcagagaatgagaaatggaagtgaaaaacagagagaagagactccattttcagcagtgacatgtaaagaacctagaatctaccactagcattcttacaagataaagctaaaaaattgagaatcagtgttttgttgttttcttccccccatcagagaactgaga

SEQ ID NO: 67843 - DNA, 601 bp, Human
gagtttgagaacagcctcaccaacatggagagacctccctctctactaaaaatacaaaattaggtagtcgtggtggcgcgtgcctgaaatcccagctactcaggagaatcggttgaacctgggaggcaggggttgcaatgagccgagatggcaccactgcactccagcctgggcaataagagcaaaactccatctcaaaaaaaaaaaaaattaattctaagtagactttgaaaaatgaagtacatatactgaaatctctagaacaacatcaaaaaaagggaaaaaagcaactctgcaaatwtgcagatgttcaagtaattcaaaagaaggcagagaatgagaaatggaagtgaaaaacagagagaagagactccattttcagcagtgacatgtaaagaacctagaatctaccactagcattcttacaagataaagctaaaaaattgagaatcagtgttttgttgttttcttccccccatcagagaactgagattgcagggcaaccactagcctgaaatctggagagaaaagcaaatccagagactcatggccgagatctgcttacttagagccaaagccactggagccataaattggtggg

SEQ ID NO: 67844 - DNA, 601 bp, Human
acatcaaaaaaagggaaaaaagcaactctgcaaatttgcagatgttcaagtaattcaaaagaaggcagagaatgagaaatggaagtgaaaaacagagagaagagactccattttcagcagtgacatgtaaagaacctagaatctaccactagcattcttacaagataaagctaaaaaattgagaatcagtgttttgttgttttcttccccccatcagagaactgagattgcagggcaaccactagcctgaaatctggagagaaaagcaaatccagagactcatggccgagatctgcttacytagagccaaagccactggagccataaattggtgggaacatttaaatgatagttttgacaaactgctggaggctgagtgtggactaacatgggagtgtgacacctctgggagcagcagtcttagggaggcccccacactttcatgggttttgcttctatgtattttatcaggtacttcatattctgatgaagatcctggaaaaggtcccctcgtagttcttgcagagagagggagggtaatcattatgaaatatacccagagtattctccaacaaaggtctactctgtaggggaaaatata

SEQ ID NO: 67845 - DNA, 601 bp, Human
gggagcagcagtcttagggaggcccccacactttcatgggttttgcttctatgtattttatcaggtacttcatattctgatgaagatcctggaaaaggtcccctcgtagttcttgcagagagagggagggtaatcattatgaaatatacccagagtattctccaacaaaggtctactctgtaggggaaaatatattattagacccctatcctggtttggggagggcatttctcccacttcagctcactctagccttcctgtgtcggtttcagtgggggaaaatgtataccactggagaaawgcccatgaaggtcacagctcagagaaaataggcaaagtaaaaaataaaggtttaatcctaaaattatagactgtatttcattccccataccttactaccataccaacagagctctggtataataacaatgcatttcagctggaagagttgcaagaatggactcttttctgaggaatagtactgagataagctcaaagtcaatggatgagacaaacataaggatactagaggaacttgaagtttctgacatctatagcaaacattaaacacagcttacctcctggccagattaacaaatcc

SEQ ID NO: 67846 - DNA, 601 bp, Human
gttggcggctttggccagcttcacttggctttactctgcttcacttggctttactcggcttcactcgctcagatctgctgccctctaccccttgcgggagggggagcacagctgagccagtgcaggagccaagacgagtgcttctgggcactgccaggagccaaactccatgcgggccatggcaacacctagtgagggagtacctgcaacccctcaaagccccagaagtaatgttacagtcagtactcttttagctttgccatccatggatggcttaagtgtttaacagttcagtggaccctttgcctgttcacaagttcagagagtgtgatagccttgtgtatcctgagctcttgtcctgcgtacaggaaagattaggttgcatgaatgaattgaaggacagtaagtgtgggggattttattgctgatggaagtggctctcagcgggaaagggagctggaaagaggatggagtgggaaagtagtctccccttgaagtctctctggctagactcttctccaaagtcccactgtcaagccattcctctgaagtcaagctgcttctctccaacgttcagctgctgtttctcctctccatgttt

SEQ ID NO: 67847 - DNA, 601 bp, Human
agcgagatggagaaagatataccatataatcactaaccaaaaggaagctgaagtagctgtatacatttcagagaaaacaaacttcagagcaataaacatcagggatttaaaaaggttgggggagcattacatacgtatttggcagtcaattctccaaaaagtcttatcaatcctaaatatatgaacttaacaacaaagtatcaaaatacttgaagcaaaagctgacagaagtgaaatgaaaaacagccaactccactattatagttgaagacttcaacactcttctttcaataattgatayagattaagcaggcagaaaatcagtgtaagtaggtaattgacctgagcagtactatcaatttgatgtaattagcattcattaaatgctccatttaacaagagcaaaatatacatttttttcttcagcttataggagcatttaccaagatagaccacattcttggccataaaccacatttaacaaatcttttaagatagtaatcatgcaaagtatgttcttagactacagtggaattaaactagaaatcagtaacaggaagaaagctggaaattagttaaagaacatatttctaaataacac

SEQ ID NO: 67848 - DNA, 601 bp, Human
gtacccacttgccagatcttgatttctaagaccattctccagtaaaaggaactaaggctccttggagaaatggatgattctaaaagggctggggcaggaaatacacaaagtgagcatggggcatcttgcagtgctagaaagtaaggatgtgctcaaacacatacacaggtgtacacacatgcacacatacacagtgatggaggtatatcaaagggacataggaggaagttgatggagcttcccatggtcaaaatggaataatttgaccaacaaaataaataatgtaatgttgtataaatgytacaggcattaaaagagtaatgtgtacattagaaacaactttattacacaaagttgacaacttagttgaaatagaccatttcttgaaagatgcaaactactaatattcattcgagatgaaattgataactcagtaatactctgtttattgaagacattgtattagtatttgtaatcttcaaaaaaaatcaaaaacaaaaacgaaaaacaaaacactgtcccagatagttctgggaaattctacaaaacatttaaagaagaaatgataccaattctcacagtttcttctggaaaaatataa

SEQ ID NO: 67849 - DNA, 601 bp, Human
aaaataaaactaccaagcaatgtatctttatgaacacaaacagaaaaatcctcagtaaaatattagtaagttgaatccagcaatatatacaaggaatattacaccaagaccaaaaggggttcattctgataattcaaagctggttcaatatttgaaaattaatctgtgcaacccaccatattagtagactaaaaggtaaaaaccacatgattttatcaacaaatgctgaaaacacattaggtaaaattcagcatcctcctaagataactcttcactaacccaggaaaaaaaaaggaaactytgttatctcaataaggggcatctacaaaacagtgtctacagctaacattttagtagttaatgatgaaaaactgaatgctttcttcctaagacttggaataaggcaagaatgttcattgtcaccaccttgttcaacattgcactgtaattcttgaccaatgcaataaggcaagacaaataaataaaaggcatacagattagaaataaatagttcctgttgaaagacgacatgactgcctacatagaaaattgcaagaaatctataaaaagaaagtctcctaaaactgagtttagcaacaat

SEQ ID NO: 67850 - DNA, 601 bp, Human
ctgaaaacacattaggtaaaattcagcatcctcctaagataactcttcactaacccaggaaaaaaaaaggaaactttgttatctcaataaggggcatctacaaaacagtgtctacagctaacattttagtagttaatgatgaaaaactgaatgctttcttcctaagacttggaataaggcaagaatgttcattgtcaccaccttgttcaacattgcactgtaattcttgaccaatgcaataaggcaagacaaataaataaaaggcatacagattagaaataaatagttcctgttgaaagaygacatgactgcctacatagaaaattgcaagaaatctataaaaagaaagtctcctaaaactgagtttagcaacaataatatataaaaataatatatagtagcaatgcacaatgtattagtttggtacaaaagtaatagaggtttttgccattgaaagtaatggtgaaaaccacaattactgtgtacccatctaataaaacatttttaaagaactgtttacaatagctccaatttttaaaatacttaggtataaatctaacaaaattatgtgcaagatctgtgtgttgaaaactgtaaaaca

SEQ ID NO: 67851 - DNA, 601 bp, Human
aataagtgtctgttttgtgtaaggcactaccagatgttaagaaacaaattattgttatgcacacataatatttatacataaagctacaaatttaagaattttgtcatatagatgctgttgcatatttgtttagattgataaaaattttattacacaaaacaaagtatacagaaatgagctgttacatggcaaaattcattggtcagtgttttgttaactgttattcacacataatatttatacataaagctataaatttaagtttatcttatagatactgttacatacttgtttagattgrtatgaattccattacacaaagtatacacaaatgaactgttaaatggcaaaattcactaatcagtgttttcttattggccttttatgtagtcctaatttgattacattattgttcctatttattttacttatcagtattgtttctattttttatgtttgtcaaacagttggcagtaaatctgaagtaagatttttttagatagattgttttagatagacctttttctttctttcctttccttcccttccctcccctcccctctgcttccaaagagaaccacggaaatttcttatcctttag

SEQ ID NO: 67852 - DNA, 601 bp, Human
tggaaattatttttatgcatttcaagtatgttttaatttaaagttaaatgaggaattaagacagaattgaattaatttctgtttcattaatacctgctcttcatatagtgggtgtttagtaaaagtgtctcaaataaatgaatgttaggggtttttaataattaaaagttatgtttgaactagactttcaccactttttaaatgtatgggatctgtgatgctttctaaaacatattttaaaatctagtaatggaaaatagtatcatgagccatgatttctattggataaaatgctgttttkttttttttttattgtgaagtcaaaacaaataggattcttgtacacaaataaaattaggagcaaaccatgtagcgctgcaaataatatgcatgatgtaagaaatacttaaagagtaactgaatgttcattaattaagcattcctctacttgactctcctttttatatccctgaataccataatagagataataattttatgtctaaggatgagtatggtagcatgaagctataatttcctattatgaaatgtattattgtagaggagaaaacactgatagagctgaaatagaggaatccga

SEQ ID NO: 67853 - DNA, 601 bp, Human
aaattatttttatgcatttcaagtatgttttaatttaaagttaaatgaggaattaagacagaattgaattaatttctgtttcattaatacctgctcttcatatagtgggtgtttagtaaaagtgtctcaaataaatgaatgttaggggtttttaataattaaaagttatgtttgaactagactttcaccactttttaaatgtatgggatctgtgatgctttctaaaacatattttaaaatctagtaatggaaaatagtatcatgagccatgatttctattggataaaatgctgttttgttgtttttttattgtgaagtcaaaacaaataggattcttgtacacaaataaaattaggagcaaaccatgtagcgctgcaaataatatgcatgatgtaagaaatacttaaagagtaactgaatgttcattaattaagcattcctctacttgactctcctttttatatccctgaataccataatagagataataattttatgtctaaggatgagtatggtagcatgaagctataatttcctattatgaaatgtattattgtagaggagaaaacactgatagagctgaaatagaggaatccgatca

SEQ ID NO: 67854 - DNA, 601 bp, Human
ttttatgcatttcaagtatgttttaatttaaagttaaatgaggaattaagacagaattgaattaatttctgtttcattaatacctgctcttcatatagtgggtgtttagtaaaagtgtctcaaataaatgaatgttaggggtttttaataattaaaagttatgtttgaactagactttcaccactttttaaatgtatgggatctgtgatgctttctaaaacatattttaaaatctagtaatggaaaatagtatcatgagccatgatttctattggataaaatgctgttttgttttttttttattgtgaagtcaaaacaaataggattcttgtacacaaataaaattaggagcaaaccatgtagcgctgcaaataatatgcatgatgtaagaaatacttaaagagtaactgaatgttcattaattaagcattcctctacttgactctcctttttatatccctgaataccataatagagataataattttatgtctaaggatgagtatggtagcatgaagctataatttcctattatgaaatgtattattgtagaggagaaaacactgatagagctgaaatagaggaatccgatcatttcaaa

SEQ ID NO: 67855 - DNA, 601 bp, Human
ttgataatagtcaatttctactcatttggtaaaacttttttgagtatttactatatcatagtaagtaagcaagtttccaggaaaaataagatctagttcttacccccaaaaagaagagcaaacataatataatattcaaggcataatgaaatagttgctttaaaatgtctaagcttactgtggaagctaagtgtaagaaaaaagttgttactaaagagaaaatgggggacttcaaaaatattaaagaatgaatagaattttgagacctagagaagaaggttattttaagaaaataacatayacaagtatgtgaaaatatgaacatttagaacttacttaaaaggtttagtaagatactgtctagaaaattaggttctggatttaaactttaaaagttttctattagacatccagaattttgtactacgctgtattagtggggagccaatgcagttttttaaagtggaaaataatataatgcaacctttgttaaaagagcctaaagattttaactagcataatacaggataagttaacttactttactacagagaaatgtgtatagctactatacatcttccgtttttgctgggcatttaat

SEQ ID NO: 67856 - DNA, 601 bp, Human
aagatttcccagctgatttatatgcacattaaggtgtgagaagcactttttccctaataacattttaatatgatttccaaatgtatatcttcactggagaaaattttgaaactacaggaaaaaacaaaaaggtaaaaaaaagtatacataattctgccaaaaggtaatgactgttaatttttgtatatatactctattttgtgtatagacacacaaatttctaccagctccaattttttttttttaaacagagtcttaccgtgtcacccaggctggagtgcagtggtgggatttcgactcrctgcagcctctgcctcccaggctcaagcgatcctcccatctcagtttcccaagtagctgggactataggcatgtgccaccatacccggctaattttttgtatttttggtagaggtggagtttcaccatgttgcccaggtcgatcttgaactcctgaactcaagtgatctgcctgccttggcctcccaaagtgctgggaatacaggcctgagccactgcacccagcccagctccagaatttggatctttcaaaacataatgtttagttaacatttttctttataaagagttgttctacaat

SEQ ID NO: 67857 - DNA, 601 bp, Human
catctaggctgtttttaatgttttgctattaaaaaatgccatgataaacatctttataactaaatatttgtacatatttaggattatttttatattttataggattaatttgaagaagttatgaccattttaaggcttttgcattaaattaattgaatcccagataaacatgcatatctttttggagttaattattataataattattttttcatagattatagcacttgagaatgtgtgaaaataattatatagctactatccttaatgatatttttaaaaacaaatttaaggccaggtrtggtggctcacgcctgtaatcccagcactttgggaggctgaggtgggcagatcccttgcagtcaggagttcaacaacagcctggccaacatggtgaaaccctgtctctactaaaaatgcaaaaattagccaggctccatctacaggtgtggtggcgcacacctgtaatcccagctacttgggaggctgaggcaggagaatcactagaccccaggaagcagaggctgcagtgaggtgagattgcaccactgcagtccagcctgggtgacagagtgagactctatctcaaaataaattaaaa

SEQ ID NO: 67858 - DNA, 601 bp, Human
atctgcagtgactttctccactgaaattttaaaccgctcaaacgcatctatgagagttggaaacaacttcttccaaactcctgttgatgttgatattctgacctcctcccataaatcacaatgttcttacggcatctggaatggtaactccttttcagaaggttttcaatttactttgcccagatccatcagaggaatcactatctgtgacacctttagccttataaaatatatttcttaaataataagacctgatccatgcctgcagaatggatgttgtgttatcaggcatgaaaacaaygttcatctccttgtacatcgagctcttgggtgatcaggtgcattgtcaattagcactaatattttaaaaggaatctttttctgagtggttcccaatggtgggcttaaaatagtaaacaatgctgcaaacagatatggtgtcatctagcctttcacattccatttatagagtacaggtagagtagatttagcatagtttttgagggcactaagagtttctaaatggtaaatgaatattggcttcaatttgaagtcaccagatgtattagcccctagcgagagtcagcctgtcctttgaagc

SEQ ID NO: 67859 - DNA, 601 bp, Human
caattcttcctttcgtctgaacactaagaggccattgtaaggctattgatcggcgtaatttcagtattgctgtgtcttagggaataggaaggcccaaggagagggagagaaatgggggactagctggtgagtggagcagtcagagcacacacaacccttatcaattaagctcaccattttatttgggtgcagtttgtggtgccctaaaacagttaaaatagtaacatctgaacacagatcgccataacagatataataataatgaaaaaggaaatattgtgaaaattattaaaatgtgacwcagagacatgaagtgagcacatgctgtaagaaaaatggcaccaacagatttgcttgacacaaggttgccccaaccctcaatttgtgaaaagtgcaatatctgctgagtgcaataaagcaacacacaataaaatgaggggtgtgcctgtattaatgcattattattaactgcagttaccattctatacgatgaatctccaggacttattcatcctgtctaagtgaaattttgtaccctttagccaacatctcctaaatcttccttccctgaaccctcccatccttcagcccctgacaacca

SEQ ID NO: 67860 - DNA, 601 bp, Human
ttttttcacatatatttatatattttataaacccagcaacataatgttgtaattattgcctcatacaactttaagtctcttaaagaaattaagagagaacagaaaaaatgtgtatttatatagccttttatttatatatttaccatttttagtgctcttcatttctttctgtcaatttgagctgttgtctagtattatttcctctcagctttaaggacttaggtatttctgcttacaacaaatatcctccgttgtttctctgggaatctttcatttcacctttatttttggaggataattktcctggatagagaaatgttggtggatgggtttgctttcttgtttcttttagcacttcatttctctgccttctggccctacttatttctaatgagaagtcattaatcatatttttcccctggacgtgattcatcatttttctcttgctgctttcatgacttttctccttacctttcaacaatttgactatgatatgtctcagtgtggatcttttgggttttattctagttggcattggctgagcttcttggatccataggttactgttttccatcaaattgggacattttcagccattatt

SEQ ID NO: 67861 - DNA, 601 bp, Human
gagccttaaaatatacaaaacaaaattgacctatgtaggagaaattttatagatatagatagagaattcttacccagtaattgaagaatacataggaatatgtagaacacttacaaaattaataatatgactaaatgtattcaacaaatttcaaatgattgatatacaggctacagtatatcaattcttaattacttaactaccacaaggcaattaagttcaatcagtaataaaaagctttaaaaaaatcacacaaatgtatacatttggagatttaaacattttaaataacttaccaaakaattaactcgtaaatttaaggtgtaactatgtatcagaacttgtggggtgcagcaaaagtggatatagagttaaattttaagtgctcaaattaggaaaaagaaagacattcatgatataagaaaacaagtttaaaaagccacatggttaatcaaaagaagaaagaaactgataaagacgagcaaagatcagtgggtggaatagaaaataaagatacatgagaatcaaaggttagtttatgggaaaatattttaaagtactaaatagaactatacctgttttaaaaattgaatcacagaat

SEQ ID NO: 67862 - DNA, 601 bp, Human
ctgcatcacattttttcaagctaaacactacatactgggccttcagaatatttttctgatattttcatggagttctttgcaatgaaacctattaaacaaatgggtcagcaattactacttcttgccatttaacacataatttgtccctaataattttcattttgttgtggcaggaacaaatttaatagattgatgcctccaattatttgcttctgtgctgtagtcaaagccaaacaaagatgtttccttataacaaaacatctattcaagaaaaaaagagtctgattattgttctgggatgctggcttttggttctttgtagaatgaggaactcttctttccttattgttgttgttttagataatactgtgtttttataatataaagagagaaagccactaggctctctcatgctgctactatctagttctataagcttatataaagacagaaatgaagcaagactgatttcttcacaggtaactttagtgaaagagctctgatccctcagtttatctattcattacagttatttgcaagtgcattaagtctgtatggcttctatgactctttgtcagtatgcctctggtcagtttgtaat

SEQ ID NO: 67863 - DNA, 601 bp, Human
atattatacatagttagtatacagtcagcccttccatatctatgggttccacgtccatggatttaaccaatcacagattgaagatatttgggaaaaaaattacatctatacctaacatgtacagacttttgtttcttgttattattccctaaacaatacagtgtaacaactatttacatagcatttacaatatatcaggtattataagtaatctagagatgatttaaagtatatggacagtgtgtataggctttatgcaaagcctctgtcattttatataagggacttgagcacctgggcmttttggtttctgctgtaggtcctggaaccaacccccagggatactgatggacaactataatttattgtgacaattatggactaatttgttttgtaactattacagaagttaaaatgtgtacagtagtgatccaaccacttcatgttacaaattttgaaaacctgaggcccaaagatttgaaatcatctcaagtcagaaagttagttaaataaaaggcctagattaaaacacaaatctgactcctactcaatttatttgctcaatattatcagtatactcctaattttatatattaatacc

SEQ ID NO: 67864 - DNA, 601 bp, Human
attatacatagttagtatacagtcagcccttccatatctatgggttccacgtccatggatttaaccaatcacagattgaagatatttgggaaaaaaattacatctatacctaacatgtacagacttttgtttcttgttattattccctaaacaatacagtgtaacaactatttacatagcatttacaatatatcaggtattataagtaatctagagatgatttaaagtatatggacagtgtgtataggctttatgcaaagcctctgtcattttatataagggacttgagcacctgggcatkttggtttctgctgtaggtcctggaaccaacccccagggatactgatggacaactataatttattgtgacaattatggactaatttgttttgtaactattacagaagttaaaatgtgtacagtagtgatccaaccacttcatgttacaaattttgaaaacctgaggcccaaagatttgaaatcatctcaagtcagaaagttagttaaataaaaggcctagattaaaacacaaatctgactcctactcaatttatttgctcaatattatcagtatactcctaattttatatattaatacctg

SEQ ID NO: 67865 - DNA, 601 bp, Human
ttatacatagttagtatacagtcagcccttccatatctatgggttccacgtccatggatttaaccaatcacagattgaagatatttgggaaaaaaattacatctatacctaacatgtacagacttttgtttcttgttattattccctaaacaatacagtgtaacaactatttacatagcatttacaatatatcaggtattataagtaatctagagatgatttaaagtatatggacagtgtgtataggctttatgcaaagcctctgtcattttatataagggacttgagcacctgggcattytggtttctgctgtaggtcctggaaccaacccccagggatactgatggacaactataatttattgtgacaattatggactaatttgttttgtaactattacagaagttaaaatgtgtacagtagtgatccaaccacttcatgttacaaattttgaaaacctgaggcccaaagatttgaaatcatctcaagtcagaaagttagttaaataaaaggcctagattaaaacacaaatctgactcctactcaatttatttgctcaatattatcagtatactcctaattttatatattaatacctgg

SEQ ID NO: 67866 - DNA, 601 bp, Human
taaaaggcctagattaaaacacaaatctgactcctactcaatttatttgctcaatattatcagtatactcctaattttatatattaatacctggctggtatctttaattacttttgttatttatatttaacttcttgacttctgtgactatcctcacattgaccattagactccagcaagaaagaatgccaccttctaatgatttacacatatacaagaaaattatttatatgtcttgctaaagtcaccacttcttaaattcaaaatagaatcacatatggaatagaatcacagtcttcgkgaagtcaagataaattactttccccttctattaaatagaaaatctagaggaagcttaagtctaaatgacctaggatacaaagatagtttttgttataaagatagttttttccccaatattttgtgtgtcctcttctatggcaatataaaataaatttttagaatttatacctatatttatttagatattataaaatgaaaattgttcatttttactcactatttttcagttatggactttctcttcatttttaattttcttattcatcttctgaagtatttaaaatcactatctacttat

SEQ ID NO: 67867 - DNA, 601 bp, Human
cctaagtgaattaacacaggaacaaaaatccaaatacttcatgtttttacttttaagtgggagctaaacgttgagtgtacgtggacataaagatggaaacagtagacactagggactactagagaggagagggagggaggagaatatgggctgaaaaattacccagtgggtgctatgctcaccacctggatgataggaacattcataccccaaacctcaggatcatccaatatgcccatgtagcaaacctgcacatgtactctctgaatctaaaatataaattttaaaaaataaataattwaaaaaccaattaatttatcaaagatgtacttaagtcatgtgaactaaaatattttatataagcacccatttatccaaatagaattctttaagggatttctagacaactatgtcagatattattatatagacacagcatacaatatatgtacatatgcataaaagcatctaaacacctatactaatgtataaataaaaatattacagcttttattttagaactttaatcatgagatagtaaaacaataagcacatcagtttataaaaagagttagatccaaattatttttctaacaaaatg

SEQ ID NO: 67868 - DNA, 601 bp, Human
agaagggaacttgtctccgctagctttgagacagtattttgtaacaaggcaatctctgagtcctgaaatttttattagccttaagatatcagttgagatatgagtcttatttggagtatatgattttgtcaccatggtcttttagttttgttgtaagaacaacagactgtttgaatgattcctataacgtttgaacatgttaccagctggagtctcagaaaatatcttggcatgccttcaaactttgagagcctatttttaactaaatgtatttaggtgattcggtttaatgccaaatacrtaagagccaactaaacacaggtgctgaatacacaaggccaaataaacacaagcaccaacagaaaataaagtatgtccttaccaggaagaacaataagccttctccaaatgaaggggaaagtctcctcatccaaacctcaaaactgaggtctaaaccttacacctgaagtcaacagggggaaaataaccctccccaacaggagatcagttaaccaggaggcaaaagacgcctctcaaacaggagtgggaaagagaaagaccccttcccagccaaatcccaaataaaacagaactcaaccaa

SEQ ID NO: 67869 - DNA, 601 bp, Human
cttaaagctgtctggacttaaaactgctacagcattagcccttaccattgtcttcctacattcaattaaatattaagtagaaatacccaataacactttgcacttggaacattttactttcacctttcaagaattcgattataggttgagcacagtggctcatgtaagcctgtaatcccaggacttttggaggctcaggcaggtggatcacttgagctcaggaattcaaaaccagcctgggcaacatggcaaaccaaaccctccacacacacacacatacaaatacaaaaaattagctggrcatggtggtgtgcaactgtagtcccagctactcggtagactgaggtgggaagattgcatgagcccaagagtttgaggctgcagtgatcatgctacagcactccagcctggtgacagagtaagaaaaaaaaagaattttattatagatctatgtaatgtatgtgttcctccaattaaacaccagcatatggaaattaatattttataagtaaaaagtaatcatattaatgacattttacatttacagatgcatgtaaacgtgcattttatgtttacagatgcatggataaagtaagagggg

SEQ ID NO: 67870 - DNA, 601 bp, Human
tatagcctcttgcataaggagatattaatagctaaatctatgagcagttattagtgccaggcatattccacttgttttacatgtattatttctttaatcctgataaacctatgaagtggaaataccattgttatcttcattttaagattaacaaaactaagacatagcaaggtcatttagccaataaatggtagagtcagaatttgaacctaggcagtctgatcccagagtccatgccctttacgactacaatataactgccaaagaatccctgactaccaatactgaactcgtagcaacrttttctttccacttctactactaataaagtgggagcatttctttttacacaattattgatagattctcccattgacgtttttacacttctgatggtgcaactaatggcagaggacacattggggtaaggcagacatttagcattgtttcatttttattaatgctatttatttttaccttttattttcacttttttattccttgggtctaggatcttataataatgactgaaaagagttttgttgttattaatttgttccttttctttgagttgaggaaggatttccaacttggattgttt

SEQ ID NO: 67871 - DNA, 601 bp, Human
gtgtctttgtcatgaaacctttgtccattcttatgtccagggtggcattgcctaggttgtctttcaaggtttttatactccggggttttgcatttaggtctttaatccattttgagttgatttttgtatatggtataaggaagggatctatcttcagtcttttgcatgtggctagccagttatcccagcaccatttattgagtagggaaacttttccccattgcttggttttgtcagctttgtcaaagatcgggtggtcgtaggtgtatggacttatttctgggttgtcatagttgaaatsatagtaaatatatatagtcttgtctctgacttttttcacttttataataacaagcatgcaaacatcattctaatggcttgtttgtaaatgtaccataaaatatgtagccactcttctatcgttgagtgttcaggttttatttttgatttttttattattataaataactatgataaacatccttatacataaaagttttttccttattttacattatttccttagcatatattcccagaagtagaattactgggtcaaggaataggaacatttttaaggcttttgatacatattgccaaa

SEQ ID NO: 67872 - DNA, 601 bp, Human
tctttgtaattgttttctcccagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatcttcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattct

SEQ ID NO: 67873 - DNA, 601 bp, Human
cccagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccarttttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttat

SEQ ID NO: 67874 - DNA, 601 bp, Human
atgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaawtttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtc

SEQ ID NO: 67875 - DNA, 601 bp, Human
aggtaaatgaggaaatgtgcagcaaaatatttttaagaaaatttcagtcttttagaaggttcctgataatgactatttttaggttattgaatcatggaaggagaatagataattaaaaataagtaccctgaagtcagtgtacccagtttggaattacacctttactatttattagctctgtaatcttaggcaaaataatttctgtaggtctcaattgcttcacccctacctatgaaatttggataataatcatacctatgttttggattttatgagccagtacagaaagtgtttagcataatgcctagcttctagtaaaccactgtgtcaagaataaaactagagaaggtagaagttcacatatcttattattttagaacataaaactgctcataatctaggataataaagggccttgcaaaaatgagattttgagttgctaatttatatgagttgagcctaaatcctggtcatttattaactattaaccctttaaatagtctttagttgttgatagaatattagttttcctctggtatgataatgatttcaatttacagtactgtattatttacatttaaaatgttatgatcttttacta

SEQ ID NO: 67876 - DNA, 601 bp, Human
tttggataataatcatacctatgttttggattttatgagccagtacagaaagtgtttagcataatgcctagcttctagtaaaccactgtgtcaagaataaaactagagaaggtagaagttcacatatcttattattttagaacataaaactgctcataatctaggataataaagggccttgcaaaaatgagattttgagttgctaatttatatgagttgagcctaaatcctggtcatttattaactattaaccctttaaatagtctttagttgttgatagaatattagttttcctctggtrtgataatgatttcaatttacagtactgtattatttacatttaaaatgttatgatcttttactagcatagaaaataaaacctctgcataaagtagtgaacagagttgagaatagtgcttttcaagcttttatgtacatatgaatcccttggagataaaagctcagattttcaggcccaatgcccccatcatctgaggcaagccacaggaatctacatttttatccttttgtctcccagtttattctgatgtgcatgggtcctaggaccagattttgaaaaaatttacttatagactagcac

SEQ ID NO: 67877 - DNA, 601 bp, Human
acatttttatccttttgtctcccagtttattctgatgtgcatgggtcctaggaccagattttgaaaaaatttacttatagactagcacaaaagtggcagtcaaaagctatggttatgaatttaactttactataaaacctatctttgcatgcatgatttaacttctactttgagaacatgagaatgtatgtcaagtaggttgagcttttagaaagtcagaatataaattaaggagtctatatatttgaagacagtgtaataaagagcaaaattcatgaagctacaaatcatgactagattwctggtcccaactctgccactttatggcctgatgactggggaagctatacccagtaacattgctgaatcttagtttctccatctttaaattggagttaataccatattcactgaatttgtcctatccaactagaatgtaagttccatgaaatcagagacttgccaggttttgctcactgctatatatccagcacctaaaatagtgcctggcatatagtaggtattcaataaataattgtaaaatggatgaactacagtatttgaaatagtctaataaatactgagaataaaaatggcacaa

SEQ ID NO: 67878 - DNA, 601 bp, Human
ctcccagtttattctgatgtgcatgggtcctaggaccagattttgaaaaaatttacttatagactagcacaaaagtggcagtcaaaagctatggttatgaatttaactttactataaaacctatctttgcatgcatgatttaacttctactttgagaacatgagaatgtatgtcaagtaggttgagcttttagaaagtcagaatataaattaaggagtctatatatttgaagacagtgtaataaagagcaaaattcatgaagctacaaatcatgactagattactggtcccaactctgccrctttatggcctgatgactggggaagctatacccagtaacattgctgaatcttagtttctccatctttaaattggagttaataccatattcactgaatttgtcctatccaactagaatgtaagttccatgaaatcagagacttgccaggttttgctcactgctatatatccagcacctaaaatagtgcctggcatatagtaggtattcaataaataattgtaaaatggatgaactacagtatttgaaatagtctaataaatactgagaataaaaatggcacaataccttccctcagaagct

SEQ ID NO: 67879 - DNA, 601 bp, Human
taacttctactttgagaacatgagaatgtatgtcaagtaggttgagcttttagaaagtcagaatataaattaaggagtctatatatttgaagacagtgtaataaagagcaaaattcatgaagctacaaatcatgactagattactggtcccaactctgccactttatggcctgatgactggggaagctatacccagtaacattgctgaatcttagtttctccatctttaaattggagttaataccatattcactgaatttgtcctatccaactagaatgtaagttccatgaaatcagagayttgccaggttttgctcactgctatatatccagcacctaaaatagtgcctggcatatagtaggtattcaataaataattgtaaaatggatgaactacagtatttgaaatagtctaataaatactgagaataaaaatggcacaataccttccctcagaagctcagagcctgggggagacagaaatatgcacaaatactatagcatagttgaataaataaatgtattataaagagcaactgaggtaatgtaatgatgcactatgtaagttatgaagtgatggtagtacttgtagtggtagcac

SEQ ID NO: 67880 - DNA, 601 bp, Human
gggtatgatggctcatccctgtaatccgagctacttgggagactgaggcaggaagatcacttgagcctgggagattggggctacggtgagctgtgattatgccactgcactccagcctgggtgacagaacaagaccccgtctcaaagaaataaataaataaataaagattacaaaaacaaaacaattaaagaattttaaaatgcagcaaaaagaacatatagccagaccaaaacaatgtgaatgcaatacagcctatctcacaagagggatccagaaactctctgttaagttcatgaatcrtggctgtcagcattattatcgcaaatagatatgttatatagtcaataacaagattgatagcactttaaaatagatttagatctcataaaaaactttattttttatattttttctaaatttgctaacaccaatgcaatactgtataattaataaaagcaactccctataacttctcttttcagtcttcaaaataatcctgtgaaataagtgataccattttccccattttactgatgtggaaatcagctcagagaggttaattaatttaaacataatcatgcagctgctaaataataccta

SEQ ID NO: 67881 - DNA, 601 bp, Human
tagatatgttatatagtcaataacaagattgatagcactttaaaatagatttagatctcataaaaaactttattttttatattttttctaaatttgctaacaccaatgcaatactgtataattaataaaagcaactccctataacttctcttttcagtcttcaaaataatcctgtgaaataagtgataccattttccccattttactgatgtggaaatcagctcagagaggttaattaatttaaacataatcatgcagctgctaaataatacctatatttgatcccaggttcttcagattytcaattccaggtcacattatccctttaaagtccttttgacatgattcttaaaatgaaactccaaaccactaaacaataaattgtttcacaagattttcatgaattttacgtgtatcatcttcttaacttttatgctttgagcattttgggagtaggaagactctgtctcaaaaggcagcaaaaaaagagaatgaactgtggtgttaggtagacattgatctgaatccctgatcaaccaatcattagcagtatgatcatgaacaaacgatttaacctctctaaagcatcagttttatcacc

SEQ ID NO: 67882 - DNA, 601 bp, Human
ggaggatcacttaagcccaagaggtcaaggctgcagtgagccatgatcatgccactgcactccagcctgggctacagagctgagaccctgtctctgaaagaagaaaaaaaccctactccacaataagtgtatctatcgaacttctattttcttttagtgctttctgaactctaacttattttttgttgttgtaattaaccagttgtcccctccatatttattgaataattcttatttggcctcttatttgaaattctacctttactaatattaaattaatatatacatctgtctatttctsaactttttaaatttttattgctgcatactatttttatatattcatgaagtacatgttatattttaatatatgcgtagtatgtgtagtgatcaaagctgggtatttagcatatccactaccttgatcgtttattgtttctttgtgttgggaacatttcaaattttctgttccagttactttgaaatatataatatattgttgtgaaatatacaatataaccagcctgctgtgctatgaaatgctagaacttattccttctgtctaactgtatgtttgttctcagtaccttagttctcttca

SEQ ID NO: 67883 - DNA, 601 bp, Human
gattgccttgaggcttgtcaactttattagtatgctaaagatttatggtgtatttgaatcttctcatatttatatttagaaataaaatcttctgccaaatagcagtcatttacttatctattcctattatgtgtttaatttttaataattattcctaaaaggggatagaacaggaaggccactactcatttaaagtgtatgtgcttttcagagggcttgacttatcccaggtagtaaacaggtaacctaccaacaagtggcacactgtaacatacagattgtagtaatggacaaattgatygacagccaaatcttgattatcaatgaaacagatgtaaggatccatggacaatttacaaataaaaatagcagagtactttaaccgtttgttttaatatcttctcaagtattataactatgcacagcagtgcaaaaatcatagtaaatatgaatagttttaattgtcttctttattctctgatgcatctccaaatgatcaaggaaaaaaaaaggcagaagaaagaagtagcctgaacaactcaaactgtacaatcattttctacacatgattttcccaataggtttgttattctaaattgct

SEQ ID NO: 67884 - DNA, 601 bp, Human
aaatcttctgccaaatagcagtcatttacttatctattcctattatgtgtttaatttttaataattattcctaaaaggggatagaacaggaaggccactactcatttaaagtgtatgtgcttttcagagggcttgacttatcccaggtagtaaacaggtaacctaccaacaagtggcacactgtaacatacagattgtagtaatggacaaattgattgacagccaaatcttgattatcaatgaaacagatgtaaggatccatggacaatttacaaataaaaatagcagagtactttaaccrtttgttttaatatcttctcaagtattataactatgcacagcagtgcaaaaatcatagtaaatatgaatagttttaattgtcttctttattctctgatgcatctccaaatgatcaaggaaaaaaaaaggcagaagaaagaagtagcctgaacaactcaaactgtacaatcattttctacacatgattttcccaataggtttgttattctaaattgctggctggctagacgtgaagcaactgtctgcttagctcattcttctgggtagtgcaaaacagcagtccccaaagcagggcgtgcaa

SEQ ID NO: 67885 - DNA, 601 bp, Human
tccctccaagccaggtgcaggatataatctcctggtgcgccgttttttaagcccgtgggaaaagcgcagtattcgggtgggagtgacctgattttccaggtgccgtctgtcacccctttctttgactaggaaagggaactccctgaccccttgcgcttcctgagtgaggcaatgccttgccctgcttcggctcgcacacggtgcgtgcacccactgacctgcgcccactgtctggcactccctagtgagatgaacccggtacctcagatggaaatgcagaaatcacccgtcttctgtgtcsctcacgctgggagctgtagaccgtacctgttcctattcggccatcttggcttctcctcttatcccagaaatttcttaagtattttgttgacctgcatacttccttgaatcaaaatgttgaggttaatagctaacctactgcttgctgcttcttctagcactattatattttaggaacctaatggcatctaaggatttcaccgtgtaataacagtgggaatttatttttcttggtgtttggaaactctcaggaatttttttttcctttttcttatttttctctccctctcaattataggtt

SEQ ID NO: 67886 - DNA, 601 bp, Human
tcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatatgaggatcctttcgatggtaattttggaagatcctatttgaaatagtgawcttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaaca

SEQ ID NO: 67887 - DNA, 601 bp, Human
cttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatrtttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatactt

SEQ ID NO: 67888 - DNA, 601 bp, Human
catggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccat

SEQ ID NO: 67889 - DNA, 601 bp, Human
ttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatggattttgtagttagagaaaccmcagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctata

SEQ ID NO: 67890 - DNA, 601 bp, Human
aagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatggattttgtagttagagaaaccacagtatgattctggctctgctactgccttgccctgtaagtctgggcaagttgcttagacttgctcagccacagtttatttaaaagtgaggacagccmcaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagt

SEQ ID NO: 67891 - DNA, 601 bp, Human
tctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcatagaagtcctattcttgatttaggttcaacatttattccgagctatttatgttaccttatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaa

SEQ ID NO: 67892 - DNA, 601 bp, Human
cttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattgaagtcctattcttgatttaggttcaacatttattccgagctatttatgttaccttatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaat

SEQ ID NO: 67893 - DNA, 601 bp, Human
ttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattgaagtcctattcttgatttaggttcaacatttattccgagctatttatgttaccttatttttatcaatatcttargctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctggg

SEQ ID NO: 67894 - DNA, 601 bp, Human
atatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcasactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaaga

SEQ ID NO: 67895 - DNA, 601 bp, Human
ttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacagrcatgtgccaccacacccggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttatt

SEQ ID NO: 67896 - DNA, 601 bp, Human
gactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatggrtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtca

SEQ ID NO: 67897 - DNA, 601 bp, Human
agtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaagkaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaa

SEQ ID NO: 67898 - DNA, 601 bp, Human
gaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttattkgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattg

SEQ ID NO: 67899 - DNA, 601 bp, Human
gctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttcccsgcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattg

SEQ ID NO: 67900 - DNA, 601 bp, Human
ggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatrgtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtt

SEQ ID NO: 67901 - DNA, 601 bp, Human
aattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcarttaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagttta

SEQ ID NO: 67902 - DNA, 601 bp, Human
gaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccag

SEQ ID NO: 67903 - DNA, 601 bp, Human
tcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcytggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgt

SEQ ID NO: 67904 - DNA, 601 bp, Human
tgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttrtggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagc

SEQ ID NO: 67905 - DNA, 601 bp, Human
tacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcraggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgt

SEQ ID NO: 67906 - DNA, 601 bp, Human
taattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataaataagtttatcaatgtggcaggatatacaaaatcaattttatttctatatgctaacattaaggaatccaaaactcaagttacagaacgatttctgtttacagttagcattgaaaaaatctttgaaataaatttarcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaac

SEQ ID NO: 67907 - DNA, 601 bp, Human
ccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccytcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatatag

SEQ ID NO: 67908 - DNA, 601 bp, Human
cctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttatttttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaa

SEQ ID NO: 67909 - DNA, 601 bp, Human
tgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcrgactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacc

SEQ ID NO: 67910 - DNA, 601 bp, Human
caacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaatttttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaat

SEQ ID NO: 67911 - DNA, 601 bp, Human
caagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaawttttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgagg

SEQ ID NO: 67912 - DNA, 601 bp, Human
aagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaatwtttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggc

SEQ ID NO: 67913 - DNA, 601 bp, Human
agctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaatttttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggcc

SEQ ID NO: 67914 - DNA, 601 bp, Human
agttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaatttttttttttgtttcaagtacatcacatacatttaaaatacataacattcaaaaaccaaagagaacattttcaaaagccttgcaaagtatttcaatgatgacrttaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagct

SEQ ID NO: 67915 - DNA, 601 bp, Human
catacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgccsaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctga

SEQ ID NO: 67916 - DNA, 601 bp, Human
aaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatrttggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcc

SEQ ID NO: 67917 - DNA, 601 bp, Human
attactgaatttaaaaggaaatattttgccatgtttgatttttaaaatatattttaaaattgtagggaaagtccagaatgtgtatcacataggaaaattccaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattwgagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttct

SEQ ID NO: 67918 - DNA, 601 bp, Human
ggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagygcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcc

SEQ ID NO: 67919 - DNA, 601 bp, Human
aaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggwactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagc

SEQ ID NO: 67920 - DNA, 601 bp, Human
cctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaa

SEQ ID NO: 67921 - DNA, 601 bp, Human
cctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtwgtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggagga

SEQ ID NO: 67922 - DNA, 601 bp, Human
ttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccatarttaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaa

SEQ ID NO: 67923 - DNA, 601 bp, Human
ttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgwcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagt

SEQ ID NO: 67924 - DNA, 601 bp, Human
ggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttwaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaa

SEQ ID NO: 67925 - DNA, 601 bp, Human
tgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgttygtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacaga

SEQ ID NO: 67926 - DNA, 601 bp, Human
tgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggstatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagc

SEQ ID NO: 67927 - DNA, 601 bp, Human
tttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaayacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttattta

SEQ ID NO: 67928 - DNA, 601 bp, Human
cattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatattttkttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaa

SEQ ID NO: 67929 - DNA, 601 bp, Human
gatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacayacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaa

SEQ ID NO: 67930 - DNA, 601 bp, Human
gttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatgrtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggc

SEQ ID NO: 67931 - DNA, 601 bp, Human
gcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaayattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcat

SEQ ID NO: 67932 - DNA, 601 bp, Human
ttgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttasttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttct

SEQ ID NO: 67933 - DNA, 601 bp, Human
ttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatcygatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaa

SEQ ID NO: 67934 - DNA, 601 bp, Human
taaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaargggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgc

SEQ ID NO: 67935 - DNA, 601 bp, Human
taaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttstcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatc

SEQ ID NO: 67936 - DNA, 601 bp, Human
cccttcctgcaaatgaagggaacagaggctcaggcagctgaagtaacgtgcctaaggtcacatggcagttgtggcagaggcaggactggaacctagatctgtgctggtgcagtagtaacgtcatccttcctttacagagaggcggcatgggtttccggaagttctcccccttcctggctctcagtatcttggtcctgtaccaggcgggcagcctccaggcggcgccattcaggtgagacagcctggagccagaggcgccttctgctcccactgcccctaggaccagacagctctgtgcctytgaagtcacgcgtggctcctggtgaatcagtgcccacaggtggaccctggcctcatgcccgtcccctgggagtcgcggtggccacatccccaggggaagaagcagagaccaggaagcctggctgcctatcctggggagggtcagtcaggggctcacagcctgcaaggagtttgcttcccttccacaggtctgccctggagagcagcccagacccggccacactcagtaaagaggacgcgcgcctcctgctggctgcactggtgcaggactatgtgcagatgaaggccagtgagctgaagc

SEQ ID NO: 67937 - DNA, 601 bp, Human
aggccagtgagctgaagcaggagcaggagacacagggctccaggtgaggttccccaagcgcccagcacagggactcctctccccgcagcatacacaggaaggtggatcccaagaggcaggagagaacacactggcaaggggtccagcaagctgatttgtccagcaggctccctttctcaagttccaagggagacagaggtcccagtgcacctggagggactgtgtgtggttagacacaataaaaagctccgtttctgaaagctgttagaacatagatgtagaagctttttctagacatagraaaaactcaatttgtgaaaactgatagaaaatgaaatggggaggtgtggaatcgttcactgtggaaattgctcttgcagtactgggagatctcctagcattggatgagttaagactggtaagggtgaagtcaggaatagacccaatatctcagaaagttttagaaatttcacatgtgcatgccattctttcatacctgcaagaagccttcatttcacatttgcaaggtgaagatgaagcccttgcagggggtggggacagagcagtgtctgaggtaggtttgagcctttagatgtgcaag

SEQ ID NO: 67938 - DNA, 601 bp, Human
cagggcacatacttgcagtacctgaaaaactttcatatgttccctggcatcaacttcgggcctgaaattcctggcaagaatagggacatagtcaacagcttgcagagggaccactacccgactccagggtcccccagatggcagctgaacttctctcaactctcctgattccccttcttgctccactttatgaacctgatgcatgtggattcctctctgatttgtcttcatgctggtattggtatttttgcttatgacagagaatgttttgaagacctcaggatggaagggaagacagcakgacttactgaacacgttagagataaaagaaaataagggaagcttcttgagactgtagagggtgttatgacagaggcatccaatttctgcttctaaatgtactacgataaaataagcacgtccttaatgccttggcattagatgaatcaatctatttttctaaaaggaactgagctgcggtgctcattgctctggtccacatccagacttgagggtgtccagtgcctatgctcagaagtagccttagcttcagggtagctgggtatggggcttggtgggtcatcactatgacccagctcaa

SEQ ID NO: 67939 - DNA, 601 bp, Human
gctttcctcaacaatgctgtcaactatgctttattgatcgtcatttcatgaacccaccaatgtagctgctttctcatctcttacatagcttcaagactataaatgctttctgtactttctgaagcagctttgtgcacatattggcaaatttccttctttttctggttgtaccataattctgatgcataacattgaacttacagccaacagcattgtaactcagataaccagcaaagtttatctgccttgtattttctccataaagcacgacatagtcttctcacagaacactaaacagcamctcagcactatgcttggggaccattttaaaaagcaaaatcaccaaaaagtacaaaaattagaaaaatgtgacactaaacagaccacgaaaaggacacctgtttacagtattaaagctgaaaagggctccttcagcctcagctagaaatacatgcattgagtgacagtttttcactgctctgtacgtattcttgaataatcacaaatgcactgtgagtagtgacttttaagttacaaataaattttattaagtaggtgaaattcaaacataaaatccgctaataaggattaactgtatgtg

SEQ ID NO: 67940 - DNA, 601 bp, Human
aaaaccattgctcctagaagaaatacagggttaggttcctgagagcatctgaacttttgttttgtgtgtgtttctgtttaaacacacattacttaatacatatttttttttacaaatgattatttgcatggtctttgaatgactcaaaccaggggacttggaggccgtatgtgttctgtaaggttttttgccaatattcttgtttaacaagccaatctcattgacattgaaaaccactcttccacacaacccctttcctgtacaacacttaacaggtatttttaaaattcttcggaagacycctgatcagcagaacctgcattgcatgcaggtttaacatgtttcatgccatgtcgccttttgaaatgtgcaagtcagccagcactagctgatataaccttaatattttcctaacccagggtaacatgactttggctttcctcaacaatgctgtcaactatgctttattgatcgtcatttcatgaacccaccaatgtagctgctttctcatctcttacatagcttcaagactataaatgctttctgtactttctgaagcagctttgtgcacatattggcaaatttccttctttttctggtt

SEQ ID NO: 67941 - DNA, 601 bp, Human
attatgtaccaagtatatatcaagtaaagaaaacacaaatatgttttaaaaacatataaacaaatgcaactacatacaaattaaagtataagtaattgattttgggacccccatgggtttcttgcatttttgtatgccctgcaagagagacaacgattgtcctttttgataaactatctttccaaggatgtttgtaaagcaaacaaccttggaagataagagatagggtctccttccataggaggaagggaaagtatactttttccaaagggaaagcatacttactgtcttaatattattwaaaaaaaacctgattctctaagctcacggttcttttcctataataatacaaccctcttcacgtcatgctgtaggaattgggattcagaaactggcacaaaaatagtaatacagtaattccccctctcgtgcaggggatacatcccaagttccccagtggatgcctgaaaccgtggatagtaccaaaccctaatgtaatatgtactgtgttttttctatctgataactgagatggttactgtgtgactaacaggcaggttgtgtctagaacatggatatggatacggatatggacaaagag

SEQ ID NO: 67942 - DNA, 601 bp, Human
acagggctggcaggatataggaggcagcctggaattggcttgtgagccctgcccagccccacctcaactaaccttgaaaacataaaaaaattaatataaataccaacacatatagaaacattagaaacaatataaatgtaaacagatgaacatatttacaacatataatactagtaatactggaactatttcatgtaagtaaaaataaacacaaataggaacacaaatatattatatttgtgttatatatatataacacaaatataacatataaatgttagcattatgtaccaagtatatatcaagtaaagaaaacacaaatatgttttaaaaacatataaacaaatgcaactacatacaaattaaagtataagtaattgattttgggacccccatgggtttcttgcatttttgtatgccctgcaagagagacaacgattgtcctttttgataaactatctttccaaggatgtttgtaaagcaaacaaccttggaagataagagatagggtctccttccataggaggaagggaaagtatactttttccaaagggaaagcatacttactgtcttaatattattaaaaaaaaacctgattctc

SEQ ID NO: 67943 - DNA, 601 bp, Human
tttgagccgctgcctttgggtgccatcccctgagaagctgattccacagttctcacagcacctgggatgggaaaggcaggtgtggggctccaagagcacccccaatcacaaccctcacccatctggctcaccttagaccaacactcacccaggagcagggaatgaagctggggctgtgtcagtgtcagccttggtctcatccctcggggcctccttcctgacctcaccactctggggtccaacctgacgtttccgagtcttggctggccttgaaggcttctttcgcttcttgctggcaacygccacgggatgggcctggaaagtaagggaaggaggaatatgggtcagtggttgggtgttgggtggcacatccacccctacctaggtatctcatgttgtgaagtaccttgggggctggatagcacaagatgccttgtttgaagtcgaagagggtgagatcacacgcagggcccaggtatcgagtcagctcaactttgcttcggatcctgtctcctgtggggctagggatgggccatgatgggttagcacccaggtggagccaatgccatttcactcatacaaccttttgacagggctggca

SEQ ID NO: 67944 - DNA, 601 bp, Human
atcccttcagactctaccagctccatcacatcctgctcccactgcagagttgtgaagaggaagcaggttgtgcttaccttaaacattctctgttcccggttgaaggcaattctctgtgctgtggggaggaagagggaagaagaaaagtggaaaggaagcaacagacatctgacttcactcactgcctgtgccctgacttccactattcaacctctacctatgcctgctatctccaatatccaacctccaaccatgccagtagcctctgtcctgacatccacattcaaaccccagcctagcrtgacactggacctgctccagctcctatctcccgatgccccatcctctggaggccactcacctcgacagtctttgcacaacgttttgagccgctgcctttgggtgccatcccctgagaagctgattccacagttctcacagcacctgggatgggaaaggcaggtgtggggctccaagagcacccccaatcacaaccctcacccatctggctcaccttagaccaacactcacccaggagcagggaatgaagctggggctgtgtcagtgtcagccttggtctcatccctcggggcctccttcc

SEQ ID NO: 67945 - DNA, 601 bp, Human
ccaggggccgaggtgagccttgggctctttccacttgcccaactcaccctttccacaatccggaggcagcgtctccgttcacacttgcagaacagccccgatgccacatcatggggcagctgcaggaggcaggtggagcaggccccacagtcttctgttacctggcaggctgcacactccccacagcccacacgctgccaggaatggtagggacgagatcacgggcctgctccagaagcactggtcctcccatgtctactgaccctacatcagctggcatcaccatgaattttagtccccmattagcctcatcaccgtatctgagaaggtctggttagtcaccatcactgaggccattagtatgtctactggtcccctgttcacttcatcactgtgtctactgatgcactaatggtaatggggattaattaccccattaattcccattattgtgtctgctgacctatggagagcaccctataaaatgactcttcatcctgtggacccatcatcatcccttcagactctaccagctccatcacatcctgctcccactgcagagttgtgaagaggaagcaggttgtgcttaccttaaacattc

SEQ ID NO: 67946 - DNA, 601 bp, Human
tctgttggcggggggcaggtgggagcagaggcatgaagcatggggccaagcccatgggggccaggggccgaggtgagccttgggctctttccacttgcccaactcaccctttccacaatccggaggcagcgtctccgttcacacttgcagaacagccccgatgccacatcatggggcagctgcaggaggcaggtggagcaggccccacagtcttctgttacctggcaggctgcacactccccacagcccacacgctgccaggaatggtagggacgagatcacgggcctgctccagaagcaytggtcctcccatgtctactgaccctacatcagctggcatcaccatgaattttagtcccccattagcctcatcaccgtatctgagaaggtctggttagtcaccatcactgaggccattagtatgtctactggtcccctgttcacttcatcactgtgtctactgatgcactaatggtaatggggattaattaccccattaattcccattattgtgtctgctgacctatggagagcaccctataaaatgactcttcatcctgtggacccatcatcatcccttcagactctaccagctccatca

SEQ ID NO: 67947 - DNA, 601 bp, Human
ggctctgtgggctctggggactgtgatgggggtggtggaggcagtggctgggctccggggcgccgcctggcagccatcttggagtcacagcctcccttgcggcgggcatgtttaccctgggaaagatcagaaagggtggtttcagcttggtggcaccaggcagacacagaaactccccacaccctaagtgcagaaagcatgcatgggacaggcagacagagggtggcgtgaggcactcacagttgggggagccacagccaggggagtgcgtcgctgacatctctgatgacggcgacgcagrcggtgagcaaggtgctggcagacagaggcaggtaggcggggccagaaaggcgagcatagggttaggcagaaaagaaagacatgaggtaggcaaggccaggttgaaaggaagcagaggcagcgacgattttaacagcagaatgagctctgctccctccagcccaactcacccgtaggcaacgtcgctggacacatttccactggcgcctgagaccagggcggggagggcgaaggcagatggggcaatggccacaatcctcttgggtctgacagccccggcatactccacaccctcggctct

SEQ ID NO: 67948 - DNA, 601 bp, Human
gtagggccaagatggtgccgtcgggcagagctgggcctctttcgacgacggtaaggtgggggcgatcctgccccatcctcagactctgaccagacactgggcagcagccgcttctatggggaaagatagggtgctatggctacctggtgtcctgaccaatcacatccaccctgcccggctccacatgcctgctaatctcccatcagtcccagcacggaatctgcttacatatgagcccttcatcactgagcctgctagtctcctattagcaacaccaatgccacctagactcattaagccwagaacaatgtctgttaatcctcaaccaaagctactgccccacccacccacctaccaagcctgcccaccacttccaggcactggggcgcctggcccaacctatcccgtccacctgacccttcctgccccacccaccatggcaaactgcaggcattggcgccaacgacacttctggcgcttctggttgctgcccccgaatttgggcttgtcgcagcagaagtcgcagcggccacagtccatccgccgtaggcaggctgcacaggccccgcacttgcggttctgccggcggttcgtgtagggc

SEQ ID NO: 67949 - DNA, 601 bp, Human
ataccactgcccaggcaagcccagcaccatttctctggtacacattgctcaatgtcaggcaacagcccacccagaggtctcctggagactctaaaggccttcaagacccaaatgattattctctgaataagaatttatatattaaagctgacccctatagaaattccttaggaaaatagggaccagactccctatctttttctttcaaatctcatgatagagtaccaagtctttcccctacccccaaaggagagtcctaacctggaatgctattgggctggatctcaggagaaatctctagggtcctacacacacgcccctcattaattgtgaccagcatagtgggtatgggcctttacctcccaccacaccatgccaaactgccggctatactttcaaaactcagggcccacatctggccaacacccactccttccccacccctcactgtgtggggcacaccttggcaaccagactgctgtatctcggaagcgggttccacccaggctgaaaatctccgtgatctagagaagaattaacaccataggtcaatgtggttgttggggctacagcagggtcagggcagggtggggcatcccca

SEQ ID NO: 67950 - DNA, 601 bp, Human; identical to SEQ ID NO: 67939

SEQ ID NO: 67951 - DNA, 601 bp, Human; identical to SEQ ID NO: 67940

SEQ ID NO: 67952 - DNA, 601 bp, Human; identical to SEQ ID NO: 67941

SEQ ID NO: 67953 - DNA, 601 bp, Human; identical to SEQ ID NO: 67942

SEQ ID NO: 67954 - DNA, 601 bp, Human; identical to SEQ ID NO: 67943

SEQ ID NO: 67955 - DNA, 601 bp, Human; identical to SEQ ID NO: 67944

SEQ ID NO: 67956 - DNA, 601 bp, Human; identical to SEQ ID NO: 67945

SEQ ID NO: 67957 - DNA, 601 bp, Human; identical to SEQ ID NO: 67946

SEQ ID NO: 67958 - DNA, 601 bp, Human; identical to SEQ ID NO: 67947

SEQ ID NO: 67959 - DNA, 601 bp, Human; identical to SEQ ID NO: 67948

SEQ ID NO: 67960 - DNA, 601 bp, Human; identical to SEQ ID NO: 67949

SEQ ID NO: 67961 - DNA, 601 bp, Human; identical to SEQ ID NO: 67939

SEQ ID NO: 67962 - DNA, 601 bp, Human; identical to SEQ ID NO: 67940

SEQ ID NO: 67963 - DNA, 601 bp, Human; identical to SEQ ID NO: 67941

SEQ ID NO: 67964 - DNA, 601 bp, Human; identical to SEQ ID NO: 67942

SEQ ID NO: 67965 - DNA, 601 bp, Human; identical to SEQ ID NO: 67943

SEQ ID NO: 67966 - DNA, 601 bp, Human; identical to SEQ ID NO: 67944

SEQ ID NO: 67967 - DNA, 601 bp, Human; identical to SEQ ID NO: 67945

SEQ ID NO: 67968 - DNA, 601 bp, Human; identical to SEQ ID NO: 67946

SEQ ID NO: 67969 - DNA, 601 bp, Human; identical to SEQ ID NO: 67947

SEQ ID NO: 67970 - DNA, 601 bp, Human; identical to SEQ ID NO: 67948

SEQ ID NO: 67971 - DNA, 601 bp, Human; identical to SEQ ID NO: 67949

SEQ ID NO: 67972 - DNA, 601 bp, Human; identical to SEQ ID NO: 67939

SEQ ID NO: 67973 - DNA, 601 bp, Human; identical to SEQ ID NO: 67940

SEQ ID NO: 67974 - DNA, 601 bp, Human; identical to SEQ ID NO: 67941

SEQ ID NO: 67975 - DNA, 601 bp, Human; identical to SEQ ID NO: 67942

SEQ ID NO: 67976 - DNA, 601 bp, Human; identical to SEQ ID NO: 67943

SEQ ID NO: 67977 - DNA, 601 bp, Human; identical to SEQ ID NO: 67944

SEQ ID NO: 67978 - DNA, 601 bp, Human; identical to SEQ ID NO: 67945

SEQ ID NO: 67979 - DNA, 601 bp, Human; identical to SEQ ID NO: 67946

SEQ ID NO: 67980 - DNA, 601 bp, Human; identical to SEQ ID NO: 67947

SEQ ID NO: 67981 - DNA, 601 bp, Human; identical to SEQ ID NO: 67948

SEQ ID NO: 67982 - DNA, 601 bp, Human; identical to SEQ ID NO: 67949

SEQ ID NO: 67983 - DNA, 601 bp, Human; identical to SEQ ID NO: 67939

SEQ ID NO: 67984 - DNA, 601 bp, Human; identical to SEQ ID NO: 67940

SEQ ID NO: 67985 - DNA, 601 bp, Human; identical to SEQ ID NO: 67941

SEQ ID NO: 67986 - DNA, 601 bp, Human; identical to SEQ ID NO: 67942

SEQ ID NO: 67987 - DNA, 601 bp, Human; identical to SEQ ID NO: 67943

SEQ ID NO: 67988 - DNA, 601 bp, Human; identical to SEQ ID NO: 67944

SEQ ID NO: 67989 - DNA, 601 bp, Human; identical to SEQ ID NO: 67945

SEQ ID NO: 67990 - DNA, 601 bp, Human; identical to SEQ ID NO: 67946

SEQ ID NO: 67991 - DNA, 601 bp, Human; identical to SEQ ID NO: 67947

SEQ ID NO: 67992 - DNA, 601 bp, Human; identical to SEQ ID NO: 67948

SEQ ID NO: 67993 - DNA, 601 bp, Human; identical to SEQ ID NO: 67949

SEQ ID NO: 67994 - DNA, 601 bp, Human
cgggaggccagggcccgggctggggggaggggaacccggcatccaccgcccctgcctccccacccgcactcccgcatcccgaccgcgccttccccgcgccggtcaaccccctccatccctgtcgccgggttccctccggccttggcggcccggcctccccagccactccccctccccttccctcccctccccttccctccgtctctccgggtccaccttgaggctccttccccactagacgtggccaccgcacctctgccctgggctgatattttctccaaactacctcccgtccgccctyatcccttctccctcctcctcactcctcctaggcctgacatctcccggcctctctggatctccccagtgatgtgccagaaaaagagtgacaggagagcgaggggagacttgggggagggggaacatcgggccaggcccagcctgggggcctcgggtttcttccccacacgctcctgcctggctggtttggggaagcaggtctggacagttctcactggctgctcagagcttgcagggctttccgaatagatttggctgggaagggttcagccccatcgtgatcatctagcgtttaatgaac

SEQ ID NO: 67995 - DNA, 601 bp, Human
tgattccaaggtgcatcctcattttagaaacattaaaaccctcgggaaatggcaagacttgagggagggatttgtgaatcttggaactgagaaagaatgctattgatagtattcctgtgtgatgatgccgtttctgacctaccgtcctgagagtgcatgcattgtgaagctgagtttcttctagtccttcctgcacgccagcacacattgtggggttgtatttgtaagatgactggctggagttaggcatagtaggaggctattgaacggaggaaagttcccatatgagaatccaacccarggtcttaatgtggtactctccagaaactgagccaactaactggcagcaaacgtcttatgagctattcctgaatttagccgagtaacatttgtcagaagccgaacagaaaatatagttttttttttttttttttgagacggagtctcgctctgtcgcccaggccggactgcggactgcagtggcgcaatctcggctcactgcaagctccgcttcccggggttcacgccattctcctgcctcagcctcccgagtagctgggactacaggcgcccgccaccgcgcccggctaattttttgtat

SEQ ID NO: 67996 - DNA, 601 bp, Human
agaaaaggtttgtaccgggaagacccggcacttgcattattatttcaactgccaaaaccggagtatatgaaatgtatctttgctccatgtattcagccaacctgaaagactggcaggacaggagcatttgactttaggaggcacagatgtggtgtgcttgggtgtgtggtgggggtggctagttctccagcagggaggccagtctggggagtggtcttcatttgaaatagaaaagctgctgagctcttgcttgtgagggacacacatgtggtctttattgacttcctcaactggtagaggyatagatttcatcggtgactttgctaaaatcagcttctgcatccgtgagatccagggggcaagggaaaggagctattcatcttaagagggaaaccttgccagtgagcagaggtaaagggaggtcattttggatggagagaattacagactggctcaaggcagaaactactgagtaattaaagaaccagggcaagctgttcaggtgcaagagcaaaagtgaatttaaattcctagataaatttcagtagggaaggaaatacccatgtatagacatctaaagattgaaaagaaacgcaataat

SEQ ID NO: 67997 - DNA, 601 bp, Human
agtacaatttcgtgtgacagttagccaagtttcgtgaagcatgctgtggccacggatggtttttcttgtgcacagagttgactggccaatactagcataagcctagatcttgcactcactagcaccatgccctaccagctttgctaaactgaccagatgttgttagtcaactttttagcataacgtcagtgttttaggctctggatgcttcatttgcctcaagtaaataaggacttgtcctatctaaaatgctttaactccatgcaaaatgattttttccctgaaactatttcctagatakaggagatacataccacttgtgtgatacatttaaaataactgagcaagaagcatggcttcaaatctgccttgtagcttgactatatataaaaaagcttaaaaggatgtatatccttagaccagaaagtgccattctagcaatatttagaaaatcagaggtgtgtacagaaataattgtaaaagatttattaatgcaacattactagtaatatcaaacattgaaaacaaccaaaagtgccagcaactgaggattggtcaggctcgcccaaataaaatactgcatggcattaaaaacatttgg

SEQ ID NO: 67998 - DNA, 601 bp, Human
acagaggaagattttcatattaaaatttggcagaggcttcttttacttttgttcatctttgtataatgtttacgtttctaacacagacgtgtaaccactaacatttcttaaaggaatatttgaaatctcaggagtcgagctgtgccttccgggtgtggctggattgctgagatggatgaaggagaaatgaagatggagctggatcatggagcctaccttgaaaaggtgctgggcctctaaggagcctccacgtgtcagccagtggcttctgtggtctcagcttgtcacaaaagagtggcayccagccagcagccctcctccacctacactccagtagtgttcaaaatccaaggaggcccatcttcccaggcttgacagtcgactcttagatgtgctgttgcgtgagtctggtggtttccaactctctgagcagatccctactgagccatgcctctctggcctctgtgagtgaaggttcttcctccagacagatagagtcccttgctaggaatgcagttttgtgagtggagcttgggttctactcattttgtgagggttccagccctcatctcctccacaaggtgctttgtgcagtgtacaa

SEQ ID NO: 67999 - DNA, 601 bp, Human
ccttatatggcaataagtgttaattaagttaaggatcttgagagagaggtttatcctggattatctgggtgggccctaaatgcaatcatatgtatctttataagcaggaggacagaggggtgttgagagagaagagacagtgtggccacagaagcagagattggagtgacctgaagccaccagaagctggaagagaggcagggagcagattcccccaagagccttcagagggagggcagccctaccgatgctgtgatgctggacttctggcctccagaccagtgagagaatgacctttgtwgttttcagccacccagtttgtggtcatttgtcacagtaggcacaggaaactaatccagtgtgccaaaatcaaggtgttggcaaggctgtgtttcttctggagcctccaggagaaaatccgcgtctttgcctcctccatcctctaaaggctgcccacattcactggctcctggcagcgcatcactctgcttccatcatcactgttctctgactgacccttctgcttccccttataaggaccctggtgattacactgggcccactcagataatccaggataatcttcccatcacagaaacct

SEQ ID NO: 68000 - DNA, 601 bp, Human
ccagacagagactaattgagaagactgacattaaggaatgctaccagaataccccagaatttgacttgagccctaatctttgtgtgtgggagctgtccaacatttcagcatacttttgcatttgcctactttgaaagaaacatgataataatctggctgtcttgactgttttactgtgtgccatgttctgaggaaactgacacaattcaggatctagtctctcaggtattttgatctgataacttaattatcagcttttcttgaggtcaccaagccctgagaaaactgacttacatttatwtgcttaggcacatttgtaccagaaagtcaatttaataaatatacttcttccctgtatcatggtggcttgaaaatcagaaaggtaatcagagcttgatttataagcatgaaatcagagcaaatacagttggaagttaagaaattatgtgttatccacaccatggttcaagcttgattaattctcctctctctaccagaggagacatcattcatcctagtgaccagaataccaattccagctaagcagagtggtccattggacagtgttacagttgcactaacatagttttcctttctaact

SEQ ID NO: 68001 - DNA, 601 bp, Human
tactttgaaagaaacatgataataatctggctgtcttgactgttttactgtgtgccatgttctgaggaaactgacacaattcaggatctagtctctcaggtattttgatctgataacttaattatcagcttttcttgaggtcaccaagccctgagaaaactgacttacatttatttgcttaggcacatttgtaccagaaagtcaatttaataaatatacttcttccctgtatcatggtggcttgaaaatcagaaaggtaatcagagcttgatttataagcatgaaatcagagcaaatacarttggaagttaagaaattatgtgttatccacaccatggttcaagcttgattaattctcctctctctaccagaggagacatcattcatcctagtgaccagaataccaattccagctaagcagagtggtccattggacagtgttacagttgcactaacatagttttcctttctaactatctttttctctagattccataataagccatcccctttttataattgccattacaatcagcttctacatcatgacatcgttacagtttgccaagtttgtagcttattttgcactgataaattttaa

SEQ ID NO: 68002 - DNA, 601 bp, Human
atactaatgggccttttctgtttggggactactgatattccggccacagaagacagtggaaagatagcagagggaagtatgtcttcagcttgcttggcccattcatatctgcctatcgcctctattccttgttatcctcatcaatctatttggccatcttggaacctggtgtgagtccaaaaggaggagctcctgcttctggggtttgttcttgggtacccatagaaacagatgagacattagaagataggaattttattttattttattttattttattttattttattttattttatttatttttgaaacaaggtcttactctgttgcccgggctggagtacagtggtgagatcatagctcactgcagcctggatctcccgggctccagcttgatcctccccactcagcctcccgaataactgggaatacaggtgtgcaccaccttgccccactaatcttttttatttttagtagagatgaaggcctcactatgttgcccacactggtcttgaattcctgggctcaagcgatattcctgcctcatctcccaaagtgctgggattacaggtgtgagccatcacacccagccaacaggagt

SEQ ID NO: 68003 - DNA, 601 bp, Human
cagacagaaccacaattataattttagaatatacttcacatttttcttcaacaactgttggtatatttttgttctgtaatacaatcatacattgcttaatgatgggatacattccgagaaatgtgtcttgtgattttgccattgtgcaaacatcatagagtgtactcacccaaacctagatggtattgcctactacatacctagactgtatggcatagcctattgctcctaggctacaaacttgtacagcatgtgactgcactggatactgtaggcaattggaacataatggttagtattygggtatctaaatatatggtctgggtatggtggctcatgcctgtaatcccagcactttaggaggttgaggcggcaggatcacttgagtccaggagttagagacagcagtgagccatgattgtaccactgaactccagtgtgggtgagacagagtgagatcccatcattcatagatagatagatagatagataactgatagataggcatataattgatagataggtacgtagatctaaacatagaaagggtacggtgaactatgattgcaccactgcactccagcctaggaaacaaatcaag

SEQ ID NO: 68004 - DNA, 601 bp, Human
cttctccttacctaatttcattgttaccggccccatgtcaaagattatttaaaactccccggctgtcaaaattccattaacaacctctgacctataaccgtcactcactgaattgacacgtgtgaggttctgtgcggatgctccacttgagttagcttgaaccttcacaacagtccggcagcataggtattttagaattattagtaatgttgagcatgtttcacatgtttgttggccatttacacttccccttccatgagtcatctgtcaagaggctctgtgcccacgagccatacacatratgatgtccaaaaagcgcttctattttactgtaagaaactcaggcaaagagaggccgcctttgcccagaggatctctcatgcctgggaggtcgtgagaggcagagctggagttgggtgctgtggagtccttttcaccacctttttcatgcaccatgctgcccgtccacatagctcaatgtgcctgtttatttcttaggaaatacaccacagggctactatttaggtagtgcaattaaagtttactttctgaattctctatttcccctatctttagcagaaaacttgggaaagcctaagtc

SEQ ID NO: 68005 - DNA, 601 bp, Human
aatacatttcatgatagctggagtatggcaacagcactcctgagttacaggcatgcgccaccatgcccagctaatttctatttttgtaaagatagggtctcactatgttgcctaggctaaaaccttctgataaggatattttctagtatctcatgtttagagcaaattactagaatatcaaggatctagtaaaaaaaaaaaaaaaaaagtaaatgccatggatatgtctgggatcagtacagatttatcccaggatactagatctttagtagaaggcatgaatggtgagaattcctcagcrggatttccggatgtttgttagacatgagcacacagatgacttgtgggttctcaaactcgacagcccaaaacagttcacagaagagtaaatatatatgggtaataaacatagaaatatgttctccctcactagtaatcaaagaaacattattttaaagataaaaaaatacttctctttcaatcaacacactttttaaaataataacaatgttggtgttgaaatgagcactcataaacttctggggaaaaaatgaaaggtacagcctttatggaagctgttagtccttaaaaaatatatcat

SEQ ID NO: 68006 - DNA, 601 bp, Human
ggtggctcacgcctgtaatcccagcactttgggaggccgaggtgggcggatcacgaggtcaggagatcgagatcatccttgctaacacggtgaaaccccgtctctactaaaaatacaaaaaattagccgggcacagtggcgggcgcctgtagtcccagctactcgggaggctgaggcaggagaatggcgtgaacccgggaggcgtagctggcactgagccaagattgcaccactgcactctagcctgggtgacagagcgagaccccgtctcaaaaataaaaacaaaaacaaaaacaaaaamaaaacaagtgtgtggaagccattagcttagctgctgtggctattagacaagtaggctttgccattgggtgaagagagacttagtagactattgatgtctgataattcccattattggggaggaaatgtaatttcttcttaaccttcataagttcatagttgggacagacccctgtaacaaaagacagatcagcaaaagaaaaacaagcaaagtttttttattttgtttttctcttcagatacagggtctcactctgtcactaaggctggggtgccgtggcatgatcacagctcattgaag

SEQ ID NO: 68007 - DNA, 601 bp, Human
catgcctggccaagcaagtttattaatgtgtggagggcacagaatgcaggagaaaccccaatgaaaggcaacttcaaggcagtggcgtcaaactctggcttatatgccatcttcagaaaagaacaatacatttgtagagaaataacaggacagaagaaagcaattttaggcttccaaaagggggaaactgtgggaagttagatacatgggaagaaaccaatggtgtaaggtttgtttacagattcctctggtgctgtgtctgggctgataagaactatctccagtaaagaagaatttatawcctgtctttaggcagaaaagcaggagaatagagctcatcctctatttgctgctctttaattacttttagctcaaaaataagtcaaataggcatattttggggtgacatattctggttttcctttaccttgaagttgagtcataacaccaaaggttcgtctatatcttgcatgtacaaataggtagaaaggtttatgctaattaggtgagcccagattggcaggttgttgaagggctaatttaactcacaaaaggccttttcgtgtttagaatcccaaggaagaagtttggacttggttaa

SEQ ID NO: 68008 - DNA, 601 bp, Human
atgcctggccaagcaagtttattaatgtgtggagggcacagaatgcaggagaaaccccaatgaaaggcaacttcaaggcagtggcgtcaaactctggcttatatgccatcttcagaaaagaacaatacatttgtagagaaataacaggacagaagaaagcaattttaggcttccaaaagggggaaactgtgggaagttagatacatgggaagaaaccaatggtgtaaggtttgtttacagattcctctggtgctgtgtctgggctgataagaactatctccagtaaagaagaatttatatmctgtctttaggcagaaaagcaggagaatagagctcatcctctatttgctgctctttaattacttttagctcaaaaataagtcaaataggcatattttggggtgacatattctggttttcctttaccttgaagttgagtcataacaccaaaggttcgtctatatcttgcatgtacaaataggtagaaaggtttatgctaattaggtgagcccagattggcaggttgttgaagggctaatttaactcacaaaaggccttttcgtgtttagaatcccaaggaagaagtttggacttggttaag

SEQ ID NO: 68009 - DNA, 601 bp, Human
gctggagaaagatcgtgagtcgcactcatgggtcttcttggacagataaaatctagaacttgagggtaggatatggagtctgaagggggatgggtgagatgttgagataaggagcacaagcctacttttaatctgtatttctttttttttttttttttttgagatggagtttcactctttgttgcccaggctggggtgcagtggtgtgatattggctcactgcaacctccacctcccgggttcaagccattatcctatctcagcctcccaagaagctgagattacaggtgcgtgtcaccayacccagctaatttttgtatttttagtaggggtggggttttgccatgttggccaggctggtctcgaactcctgacctcaggtgatccacctgtctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtg

SEQ ID NO: 68010 - DNA, 601 bp, Human
ttagtaggggtggggttttgccatgttggccaggctggtctcgaactcctgacctcaggtgatccacctgtctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtgatcaaggactccacaatcatcygcaggtctagctgctgtccccacactccaacaaaatgactcagagtttcatcatttcttattgcacaatttaatgaccatatcgccacctctggtctggtagcttcattaaacagggcagatgacctcctctttgaaagtgggccctcccttggctcctaagacatcaccttctctccacctcctctattttcatcgcgtccctaacattcctccaggactgagtcattggtcttatgctctttttttaaaataaaagtaataataaatatgtttcccatgtccagaatttcccattttc

SEQ ID NO: 68011 - DNA, 601 bp, Human
tctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtgatcaaggactccacaatcatctgcaggtctagctgctgtccccacactccaacaaaatgactcagagtttcatcatttcttattgcacaatytaatgaccatatcgccacctctggtctggtagcttcattaaacagggcagatgacctcctctttgaaagtgggccctcccttggctcctaagacatcaccttctctccacctcctctattttcatcgcgtccctaacattcctccaggactgagtcattggtcttatgctctttttttaaaataaaagtaataataaatatgtttcccatgtccagaatttcccattttctcctcgctgctttctggcatcctgtcatctttaaaggcccaattaggtgccaccttcctccagaaaccct

SEQ ID NO: 68012 - DNA, 601 bp, Human
gttgtgacctaaaagtgttgtgagaacaaaatcctggaggagtttcagtccctacctgaacccacagccgtccagatccctgtcctggatgtgtgggagggggcgcatgctgggctccaggccaaccctgcaaatactccacttgccccgtctctgcattgattaatccagctttgagaggctgagcctctcaatgaatcaggtccttgctcagccataagaagaaggtgattggccaggtctgccagggctttgtgacccgctggcttgctccccagcccctcagaacccctcagccccrcctgcacatactgcctccatgcaagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccggtaggatggcgtctacaaagcaggctatatgggaaatctggagctggggagggattgtggtc

SEQ ID NO: 68013 - DNA, 601 bp, Human
tgtgagtccaggcccaagtcaacccccaatgcaaaagccaatcagaagttggacctctttggtgagttcaaactgtggttttaggggatacggaggctggcttagttcagtccaggatcttagaacagccccaatgctccaggcccctcagccagcccagcttttagaggctcccaatttgagctctaaactgagctctggaaagggggtttgggggatgggggatacatttaaaggagtttttgctcaggacctgggtgccacctgctggccatgtttagttctacttacagagccaaakctacgagaggaaaattaaaagggcatcctgccctccccaatgtgatgtttgctcaaaggaaacaaggaggctgttacttcatgctgccctagcaggtgcagcagagaattcctgcagagacccctgggtgccctggatgagtcctcctgagccaaatggacccccactagggcagagtgtagcaccagttgtgaggacctgagcgagtcctgagtagggactgaagctgtgttcctgctactagctacctgcttccccagaagccccatagtgggtaacagcatgattcgttgctgggtc

SEQ ID NO: 68014 - DNA, 601 bp, Human
tcaaaatcagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttattatttttttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtggga

SEQ ID NO: 68015 - DNA, 601 bp, Human
aaatcagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttatttttattttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtgggatgc

SEQ ID NO: 68016 - DNA, 601 bp, Human
cagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttattttttttttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtgggatgccatg

SEQ ID NO: 68017 - DNA, 601 bp, Human
tcaaaggaggaagaactaggaataaagaagagggttttctctcatgatttttcttcaaagcattcatttaagttaaacatgctctgtcctatgtacttggggtcaggggtgggaacgtaagtggcacacagctctgcagatgccttgctgagcctccctgtctaaagcagtactactcaaacaggactgtgcctgcagatcctccgggcatcttggtcaaaggcagtttctcatttagttaggtctgggggaggacaagagaattggaatttctaaccagctgatccccatatagtcccastgcgcaggtctggggccacaattgagaaccatggaacagagaatgaatgaactttggggtggggacggcattccagacagagggtgagtaggaagctgcctatagctcctaactggggaatcaaagtaggagataaggctgaagaggtggggtccccttatgagtttgataagtggtcaggaggagtcacatgataacagcagatgcctgcgacaggcagggaaatattctttctgtaagaatataaggtgtataagatgtatcttatttcacagagacactttacatattaaacctgaa

SEQ ID NO: 68018 - DNA, 601 bp, Human
ggagataaggctgaagaggtggggtccccttatgagtttgataagtggtcaggaggagtcacatgataacagcagatgcctgcgacaggcagggaaatattctttctgtaagaatataaggtgtataagatgtatcttatttcacagagacactttacatattaaacctgaagaaatattcttcactcactccagaaacacatgtcctcacaattctcggaaaacacagtccttttgacctatcttgtttttccatttctgataaagatgtggttacaagaaatatgtccttttcttaacrgcgcaagtcagttagcagcagcagctgacccttggcctctggggtgggaaggaggctcactgctggctccactccaactgctggtttcagtgcgggagcatagggtcagagtggccaaaagaagccagaaatcccaagttgttaaacatctgaactttaaaatattgggcactaattcaaaactgtttccaacactatgagtgctgaacagtttaagtctgcaaggcaaattcggccaaggagtgtctcttttatgactgctggctgaaaggacttgaagtgggggagggcggtggccag

SEQ ID NO: 68019 - DNA, 601 bp, Human
ctaaaacacaaatctggtcaggttactgtcgcttaaaaccctctaatggcttcctgtcatccaaatagaaagtccagattcctccttctggtaaacaagggcctggcaacctgtccctgccaacctcattgtgccacaccccaacagaaaaatctgctccccgggcctgctccacgactcagagtgcccggaataagctctgcctttgttcttgctagtccctgtggctgaaatgccttccacccatccctttttatgtctggaaaattcctattcttctcaggctccaacatctctgctytgaagccttcgctgaccctgcccagcagatgcgctcacacccttctttgtgctgtccctgaacatttatgtgcctgtttcactgcctcatcactccctactgaggggatctgcctgtctgtaaatgcctcaaggcagaggccatttcttaattaacttggaattactggctcctggtgcacgtctagcatatagtagatgctcatgaaatgtctaaggaataaagaccctccctctggggataaactgcgaggccaatctggagggaatgtttcttacttcccagtatcatacagcccct

SEQ ID NO: 68020 - DNA, 601 bp, Human; identical to SEQ ID NO: 36697

SEQ ID NO: 68021 - DNA, 601 bp, Human; identical to SEQ ID NO: 36698

SEQ ID NO: 68022 - DNA, 601 bp, Human; identical to SEQ ID NO: 36699

SEQ ID NO: 68023 - DNA, 601 bp, Human; identical to SEQ ID NO: 36700

SEQ ID NO: 68024 - DNA, 601 bp, Human
aagcgcagaggctgggtggctttgggggcagtgggcaacattcattccctggccttgtaaggcacagcacagccagtcatcaaggtggccacccatcaacaggctgctcccttttgttctgcataatttgggcactaaggaagcctggctgttggtgtgtgggggtgtgggcatgtggggtggctacatgctgtttagagacaaggaaaggctgtttcctctccctggccctccgaaacccccaaccaacaaccgatattgagcggggaagaggggtgacgtagcaggggctgaaccaaartcaaaaggacacctgaagagatgccaggcctacggcagagcccccaccgcgtctctgcaggcccctgcaggaaggggtccagctctcttctgctcaccccctcccccaacccagcttgaaggcccccacccaaagaaagagcgagaagcacacagaagcaccacgtcagagacaaagggaaagggactaggagagaaacagaaagattgagagaggtgggggaagagaaaaagccggagaccctgccaaattccggagacaaacggacggtcagccgacagacaagatggcccacggggg

SEQ ID NO: 68025 - DNA, 601 bp, Human
aacgaggaaatcagggaaacagctgtaagaggtaacatgagaagggccttgaaggatgggaaggattttgataaagacaggtgaatgctatgccaggcacgccaaggcagtatgaagggaaggtggagtgaagtgtggagtgggactcagcatgtgttcctggccttggtgtgcctcctttccaggcccacctcccagaacctccactcctggatcctgcccccgccctccctagacatgaagctgaagtgtggccctttaagagacgagcgggacattggggccaaaaagtctgattcckggcacagagaactgatggctagattccagagctggggttgtcatgggaggaaggggtgcagcctgctatggctgaggatggcagtgggaggagcatgttaattggacttcagtccgactataagcacccagcagagcccaccttaactgcatggtaccataagtctcccttgacaaatgaatggggcttgggacctcacctggggatgccagaggctgagtgaggtcaggctgagtgctaagtccattctggtccaattctcagccccaccactacccaacctgaacccagcaaggacag

SEQ ID NO: 68026 - DNA, 601 bp, Human
ttattttctacaatgatttattttaataacaagaaaatagggtttttaaaagaagtcagccctgacctactggccccggacctcggctggaattccctttgttgctgtcccttatccctcctacttcctgagtcctgggcacccagctcccctatcccagccatccccatctctgcatctgcacccaggaacattcctgggactctgggtggagagtggcttgggcaggtatttggagaatggggtttaagggctgctccccaacttaccgaccacctccccagccatgaagacaaagcamacggcacaggcagcatatagctgcctccgtgcatgcagcctctcaggggtaaggcccggcggcggaagggggtccctgtggcagtggtggaagggcatctccacaggtttggactcctcagggaggggctctgagggctctgtgaagagactgaggcaagcaacatggttcaacctgggcctggcccacaggctggcctgctcactccacgtccttagtccccagtgctggcctcatcagaccatctccttccccaggcctggtcgtatctgggagctgcatcggcagagggccacatga

SEQ ID NO: 68027 - DNA, 601 bp, Human
tctgtgggaggtcactccagaggctgggaagggacaggagggattctgttgttctcaagtgacctatttgacttccccctcctgaggagtcagcacacaggctgaaagatgcagtgagacacaagtttattggtggagctgcagcggagtcctccctctttcagggatagccaagggcacagcaccaacagagggatggagagatagacccccaaacagacacatggatggagcagactcatagaaaccatagcacagccacataggcacagagacacacaggccacagcaccaagaacacacacacacacacacacacacacacacacacacacacagacaaaaccacagggctaagacacacggacaaagtgcgggctttggggcccctgcatagacagagcgagggccatgtggggagggggcccctactgacctcccccaggcataggcacaccaacagcacatagacaggcagatgcccccagccagccagcctgccacacagacaaatggactgcagggaaaggatgttcgtggctccacatgaaccatggggagatggcaccacaggccttcaacacaccctgccacactgagg

SEQ ID NO: 68028 - DNA, 601 bp, Human
cctgcctcagtctcccgagtagctgggattacaggcacccgccaccatgcccagctaatttttgtatttctagtggagacggggtttcaccatgttggccaggctggtctcaaacttccgacctcaggtgatccgcccacctcagcctcccaaagtgctgggattacaggcatgagccaccacgcccagccactttaaggagtatttcaaaaagtttctcagttccaagggactgagcaacagctgcccttagcagtggctaattcaataatgcatccttagagtggctctccctctttcyctccatgggatcactccctactacctaacaaggtatctgcacataagcttcaggctctgctttccggaacccaaggctaagatagtgatccatgttcagattatggcaagtggaacaaacctaacccaaacgccactataaaaagaataaagcttgggcaatatggcaaaaccccatctctaccaaaaaacaaaagaaattagctgggcatggtggtgcaagcccgcggtcccaaccactcgggaggctaaggcagaggatcctctgttgcccaggctggagtgcagtggcatagtcaca

SEQ ID NO: 68029 - DNA, 601 bp, Human
caggctggagtgcagtggcaggatcttggttcattgcaacctctacttcctgggttcaagcaattctcctgcctcagcctcctgagtagctgggattacaggcatgcgccaccatgcccggctaatttttgtatttttagtagagacgggacttcaccatgttggccaggctggtctcgaactccttacctcaagtgatctgcctgcctcggcctcccaaagtgctggtgagccaccatacccagcctggggtaagtctttggaatctttgaccattgtgggatgggagtggcagataaargtttcttcttttctctagaaaatagctattcatccagacagtcctaaagagtatttcttttcttttcttttctttttttttggagatggagtctcgctctgtcgcccaggctggagtgctgtagcgcaatctcagctcactgcaacctccgcctcccaggctcaagcaattttcctgcctcagtctcccgagtagctgggattacaggcacccgccaccatgcccagctaatttttgtatttctagtggagacggggtttcaccatgttggccaggctggtctcaaacttccgacctcag

SEQ ID NO: 68030 - DNA, 601 bp, Human
tgaatcatttcaaatgttcttgattcactatctcttactccagccattactgcagttctactggatagattcttgcttcaggcctgtgccacacctgggcctttgctattgatggctgcagtgactatgcatgtgtgaactagtagcggagcggagttatcccatgaggtcaatctttcttttctttttttttttttttttgagacagagtcttgctttgtcacccaggctggagtgcagtggcacaatctcagctcactgcaacctctgcctcacaggttcaagcaattctcctgtctcsgcctcccaagtagctgggactacaggcacctgccaccacacccagctaatttttgtatttttagcagagatggggtttcaccttgttggtcagctggtctcgaactcctgacctcaggttatccacccacctcagcctcccaaagcgcagggattacaggcgtgagccactgcgcccggccttttttttttcagatggagtctcgctctgtcgtccaggctggagtgcagtggcaggatcttggttcattgcaacctctacttcctgggttcaagcaattctcctgcctcagcctcctga

SEQ ID NO: 68031 - DNA, 601 bp, Human
ctttggtaaggtgtttacaaaagactcttatacatttaatcctcacaaaagatctgggaggtaggtggtcacacctccattcatccattcattcattcactcatttatttttgagatggagtctcattctgtcgcccaggctggagtgcagtggtgcgatctccgctcactgcaacctctgccttccgggttcaagcgattctcctgcctcagcctcctgagtagctgggattgcaggtgcccaccaccacacctggctgatttttgtatttttagtagagatggggtttcaccatgttarccaggctggtctcaaactcctgaccccaggtgatccacctgccttggccgcccaaagtgttgggattataggtgtgagccacggcacccagcctacacccccatttaatgatgagtctttgagagatgagatgacttggtaaggagtgcagttggaactgaacccaggccttctctcaaggaggaccaaggaggccagggtattcctggcatgggctgagatgggctcagaggtcagtggcaccaggaggcccctgtggctgctcccctgctgggtgttcctgcccaagtgaggccccaa

SEQ ID NO: 68032 - DNA, 601 bp, Human
aaccccagggcttcattgtggaaacaaatgactagtcccttcctgctgcctcaaagccctcacctccccaatgatggtgacacctcatgtgtattctgtcagaaactgggatgagcagacccaggtccaggaactttgcattgagcagtaaagggaagtcagagtcagaaagtatagagagaggaaggagaatttaaggccacagggctgagaaccacagactgtcagaatcaaaaggggctttaagataatttaatgcaaaccacttattttagaggtatggaaatgaagtccagggtcycacataaccagtaagtgcagggccaatgcaacaaccaggtggctggattcctagacactgttctttccaggactcagcacaatgaataaatcatgtgtagaatggtaggaaaccctgttttctcccccaagcccaatgcaagaccctgccaacagctttcaccttggtctaggggatctctatttgtagagaacagcaagaataacttttttttttaaagactgagtctcactctgttgtccaggctagagtgcagtggcatgatcttggctcactgcaacctctgcctcccgattcaag

SEQ ID NO: 68033 - DNA, 601 bp, Human
actcagtactaatgaaaaataaattcaacatataggagctgccttttcctgactcctccctccttttgctcatcttcagctctctattccatccctctcttcagcagaacaagagattgtgtttgtgtggtggtgagggcaggagaggctaagaacaggattgggggaacaagagtatagcaggggagatgggccctatctatcagcccaagccctcagcagctctttacacagccagttacctgtggcagcaagagggggaaagtcttgagagcacagaagagggaagaagggggagatraaaggaaatgtgctgaaagagtacagctgtaagactgcaaaagagagagggctcaagaacaaacctgagtcacaatgcagggtgtgtgtgtggctgagtaaggctttgtgctaagagagactggcccagaggagtttccagggagacagacaggccctgctatgctgtgaccaccactacagcagccccattctccttgctgtgctactcacctgggggttgctgagccagcagggcctccggatggggtagactgaatagcagtactttcccgtctgagcaggccagagccaagagacc

SEQ ID NO: 68034 - DNA, 601 bp, Human
atatgtccagtattgaaccaccaaagaaagaaccaaaaaacaagcatatataaaaaatttaaagagcaatagttccttatgttttattttggtttttttaccattataatatccagcagctaggtgttggtggggcctggtaggcatccaggccaggctaaggcactgaccacactcagaggggtctgtagcttgcatagaccccacctgcagagttgccacacattgtacctgcagggaaagaagagatgggactagggttagggacacctacactgtttggaacgaaagctcaaatcartgcttaatccagcaggatgagggtatttttcagaagtataaggagactcactgtggaatcagcaaggtgaggctctaagaagatggagcctcagctaaggtagcaggttcctcactcaccttatatatggcaggcttcactgcatctgtgaggaaaaagagcaggaactaactctatggatcccaaggactcagcaggtcttactctgtcacccaggcccgagtgcagtggcatgatcatggctcactgcagcctccaactcctgggctcaagcaatcctcctgcctcagcctcccaaaa

SEQ ID NO: 68035 - DNA, 601 bp, Human
gacttttaaaaagcataggtggggcacacggtggctcatgcctgtaatctcaacactgtgggaggccaatgcaggtggtggatcacctgaggtcaggagtttgagaccagcctgatcaacatggtgaaaccccgtctctactaaaaatacaaaaaattggccagatgtggtggtgggtgtctgtaatcccagctactcgggaggctaaagcagcagaatcgcttgaactcaggaggcggagcttgcagtgagattgtgccactgcactccagcctgagtgacaagagcagactccgtctcaaaaaaaaaaaaaaaaaagcataaaaactctaggaagccaggcgcagtggctcacacttgtaatctcaacactttgggaggccaatgcgggtggatcacttgaggtcaggagttcaagaccagcctggccaacatggtaaaacccccatctctactaaaaatacaaaaaaaaattagccagtgtggtggtgtacacctgtaatcccagctacttgggagggtgagacatgagaatcacttgaacccaggaagcagaggttgcagtaagccgagatcacgccagtgcactccagcctgggag

SEQ ID NO: 68036 - DNA, 601 bp, Human
tgatacggtatcagatctgctttatatataggctggaaaggagaccatgaaattaggttctataatactcaagacagaataaaagcagaggaaagtggtttgggcaggaaaggcttaaagatggaaaaaagtagtatctttaaatatatgctcagatgcagtacggtagggaagattatatacaactctgtgctaagattttctgggatatcagggccgggagacctgacactagtttgtactctaccagaatttgggagggcatgtgggttaggatccaacagctgctgttagatgttcrtatacgtacaaatcttcgctctacaggtcgcttgacatttattggattcagtgccatatctggtaatatagcagcaatgagctccccggatatatctcctgcagctattgtcccaagccagtcggatcctgaaagactctaatagaaagagacagatttcattcattcatatattcattcagagctatgaactggtaacagctgcacagtctgagagacagacacacaaacaaaaatgagtttaccataaccgacagccctgatgatagagttacaacatccctatcttctccttctacc

SEQ ID NO: 68037 - DNA, 601 bp, Human
gtatttttagtagagacggagtttcgccatgttggccaggatggtcttgatctcttgaccttgtgatctgcccgcctaatccccccaaactgctgggattacaggcatgagccactgcacctggccgaggctccttagttttacatctttgtgctgaactcaggcttgcgtactatacaaagactaaagttttctaccttttctaataccacacccattctcctggcctcagcttaccaaatctgtgtcttgaaagagcaagtagtgatggttgacagtttcagtgtaagttcgagccttrggagggttggggaccccagatgaagcagaagaatggtctggaccttcaggactgtcctgatacggtatcagatctgctttatatataggctggaaaggagaccatgaaattaggttctataatactcaagacagaataaaagcagaggaaagtggtttgggcaggaaaggcttaaagatggaaaaaagtagtatctttaaatatatgctcagatgcagtacggtagggaagattatatacaactctgtgctaagattttctgggatatcagggccgggagacctgacactagtttgtact

SEQ ID NO: 68038 - DNA, 601 bp, Human
ggccaaggctagggagtgggcagaaggcgatggctggttggagagaagccaggccgtctagtgggggaggatggttggaacatagcattgaagtgggctcggctttcaagctgcatacggtggcccagtggggaggcgagtccacggacaaaatggattcgaaccagccctgactgccccccagataccagccatccataggagtccaggtttgggctgaaacgtacctgtgaagagaacagaaaacaagagagagatgctcatgggtggtgctttagggtgactcctagctgtatgaacaaaaaaaaaaaatgagccacaatctgaaaggacaggaccatgaggggtgacagaggtaagaatgaaaagccagtgaatgaggtacgtctgtcatgctctggaggaggaggaggttgtcatctgtgtaaccttttcatctaccatttcatcagccccaggcccagaactggggggaaatgagagtggagggtggagaggatgagagactaccttatgaatagcctccagctgcagcctgtccaggcagagttgagaatgcccctctccctcctgcatgcgcagcattggttctctacggagc

SEQ ID NO: 68039 - DNA, 601 bp, Human; identical to SEQ ID NO: 40027

SEQ ID NO: 68040 - DNA, 601 bp, Human; identical to SEQ ID NO: 40028

SEQ ID NO: 68041 - DNA, 601 bp, Human; identical to SEQ ID NO: 40029

SEQ ID NO: 68042 - DNA, 601 bp, Human; identical to SEQ ID NO: 40030

SEQ ID NO: 68043 - DNA, 601 bp, Human; identical to SEQ ID NO: 40031

SEQ ID NO: 68044 - DNA, 601 bp, Human; identical to SEQ ID NO: 40032

SEQ ID NO: 68045 - DNA, 601 bp, Human; identical to SEQ ID NO: 40033

SEQ ID NO: 68046 - DNA, 601 bp, Human; identical to SEQ ID NO: 40034

SEQ ID NO: 68047 - DNA, 601 bp, Human
ccggccgcctcggggctcctctggctgctcccagggcacagctgtaccaggagcagcagcgcggccagcagcgctgcgcgtcccgcctgcctcatggtgccgccggccctggacacacaggggcagcgcagggtgaggtgcgcctgggacagctgcaggccgccgctcccctccccgcgctcgcccggcgacccctccggccgccgcccaatgcccgcagcctgccctccagccccagccactgcgccagtgctgttccatcccttccacccagcctccctccccggaggagcgtggtggytgagctgagcggagtcctggtgcagggggaggctgggcggacgctctgagccactcacaggttgtcggcgagcgtctgtacggtccaagattgagctccagtctctgtccctcggggcaggctgaagacgccttggggaacacagggtctgtcccggggctgtcgccagccttatatagtgccaggacagctccgactgacgtcagcgaagaacatgcactgattgtagaagcaatgacagccacagcttcgagtctgacggctggcgggcccccggaggggcgcacctccctacaccag

SEQ ID NO: 68048 - DNA, 601 bp, Human
ataaacctgctgtaaacatttgtgtgcaggtttttgtgtagacataagttttcaaatcatttgggtaaatactaaggagctcaattgctgggttgcatgtgagagtatgtttacttttgtaagaaactgacagactcttagtggctgtgtaccattttgtattctcatcagcaatgaatgttctacttcctcaccagcatttgggggttttatattttggccgttttagtagttgtgtagtggtatctccttttttaaaattgtaatttcctaatgacatgatgttgagcatcttttcatrtgcttatttgtctctttttatatgtttatttgctgactttgtttttttttttttttgagacagagtctcgctctgtcgcccaggctggagtgcagtggtgtgatctcggctcactgcaagctccgcctaccaggttcacaccattttcctccctcagcctcccaactagctgggactacaggtgccccccaccagacccggctaatttttttttgtatttttagtagagatggggttttaccatgttagccaggatggtctcgatctcttgacctcatgatctgcctgcctcggcctccc

SEQ ID NO: 68049 - DNA, 601 bp, Human
ggctaatggcctgtaatcccagcactttgggaggcttaggtgggaggattgtctgaggccaggagtttgagaccagcctgggcaacatagtgagaccccgtctctacaaaaaaaaaaaaattagctgggtgtggtggtgcatgcctgtaggcccagccacttgggaggctgaagcaggagtatcacttgagtccagcacttcaggcagcagtgagctgtgattgtgccactgcactccagcctaggggagaaaggggcttttaatacctttctaaacatagaaattttttgcatactgtaraactgtagcacttcaaatgtaagggatacaaaaaagttaagataaacttgggtgtagaagagaatatcatatagagatacaaactgcaaaaagaaggaaatacagacaggagataatagagatacaaataaaaagaatacagtaattgctttataaaacagtctgtggcctggcatggtggctcatgcctgtaatcccagcactttgggagaccaaggtgggtgggtcacctgaggtacggagttcgagaccagcctgaccaacatggtaaaaccctgtctctactaaaaatacaaaatt

SEQ ID NO: 68050 - DNA, 601 bp, Human
cgcgatctcggctcactgcaacctccacctccctggttccagtgattcttctgcctcagcctcctgagtagctgggattacaggtgcctgccaccgtgcccagttatttttgtatttttagtagagacagggtttcaccaggttggccaggctggtctcgaactcctgacctcaagtgatccgcccgcctcggcctcttgaagtgctgggattacaggtgtgaaggcattgcgcttgggtgtgttttttcctttacaatatcatttaaaaatttttattttttatagaatataaagtaaarttgtctattttttgtgtacttgtcatacaggtacacacatgcatagattgatgtaacccaccatcacagtcaggatacagaccagtttcaacacctgaaaaaattccctgtggtatcactttgtagtcacatcttccctttaccactaatcttttgggaccactgatctgttctccatactatggagttttgtgttttctacattgttactgaaatgtaatcattcagtatgtaacctgttgatgctagctgcttgcacttagcatgatgcccttgagattctgtcaagtttttgcatgt

SEQ ID NO: 68051 - DNA, 601 bp, Human
tgtgtgaacataagcttttatgtctccagggtaaatacacagaagtgggattacagggccatttggtaagtttgtgtttaactttgtaagaaactgtcaaaccagtgtggctgtaccatttgtatttcctttagaaatgtatgagagttccagttgttctgcatccttgccagaacttcatactatctttatattgttaagatatctatactgccccaaacaatttgcagactcattgcaatttgcagactcattgcaattcctatcaaaatcccagtaacttttttctatttctgcaggaaaaaaaaaaaatctgttctaaaattcatatagaatctcaagggaccctaaatagttcaacataatcttgacaaagaacagagttggaagattaacacttgatttcaaaatttagtatgaagctacagtaatcaatatagcaaagtaccagcataaagatggacatatagactgaaggaatatagagccgagaaataaactattgcatatatggtcaaatgattttcagcaaggaggccaagaccattcattgggggaagcgacaatcttttcaacaaatgttgctgggaagactggatac

SEQ ID NO: 68052 - DNA, 601 bp, Human
ataatcccggctctttgggaggcccaggcgggcagatcaggaggtcaggagatcgagaccatcctggctaatacggtgaaaccccatctttgctaaaaatacaaaaaaattagccgggtgaggtggcaggcatctgtagtcccagctactcgggaggctgaggcaggagaatggcatgaacccgggaggcagagcttgcagtgagccgagatcatgccactgcactccagcctgggggacagggcaagactcggtctcaaaaaaaaaaaaaaaaaggaaaatacatgagaatcaggagagrtcactttttactgcgattaccaattaacaattgagagatgaactgctcacctggatatgattagggtcacatggtggtactcataacacttgaactcactgcaataggaacaaaattatcacagttttataatatgtactacagctaattttatttagttatgatttaatactgtattttttacatttgtttacatttttcttgactggtgccatgtactatttgtgtgcgtaagttttgataattttaactttatagtagatttgtgtatattttatgtcagtaaatgatcaaatagac

SEQ ID NO: 68053 - DNA, 601 bp, Human
ttgttctctttctgcctttcacaactcaaatactctctcatatagcctcatatttaccccattagacagaatttagtcacatgaccacaccaagctgagagggagactgggaaagaggtggttctttctttcttttttttaatattttaaaatgagagaggaatagactctggtaaaacagcagtaatttttttttttttctttgagtcagagtcttgctctgtcacccaggcaggagtgcagtggcttgaccttggctcactgcaaccttcatctcccgggttcaagtgattctcttgcstcagcctccctagtagctgggattacaggcatgcaccaccacacccagctaatttttgtatttttagtagagacgggtttcaccatgttggccagactggtcttgagctcctgacttcaattgatccgcccgcctcagcctcccaaagtgctgggattataggcgtgagccaccgcacccagccacacaaccagtaatttttgctatgcatcatgtctttcaataacttgagttttaagttttagccatatatacttttctgtagtgttaaattttctttacttaatttttaagtctagc

SEQ ID NO: 68054 - DNA, 601 bp, Human
gactctggtaaaacagcagtaatttttttttttttctttgagtcagagtcttgctctgtcacccaggcaggagtgcagtggcttgaccttggctcactgcaaccttcatctcccgggttcaagtgattctcttgcctcagcctccctagtagctgggattacaggcatgcaccaccacacccagctaatttttgtatttttagtagagacgggtttcaccatgttggccagactggtcttgagctcctgacttcaattgatccgcccgcctcagcctcccaaagtgctgggattataggcrtgagccaccgcacccagccacacaaccagtaatttttgctatgcatcatgtctttcaataacttgagttttaagttttagccatatatacttttctgtagtgttaaattttctttacttaatttttaagtctagcccaacttaaattcttttgtgtggcttcatatcctgcagtttgaaagtacatttttcataattactggattttgcatcaccttaaatagaatgtaaaagattatgttgtgttctataataaagtgagatattatttgtgttcatgctaacttgttatgaaagttat

SEQ ID NO: 68055 - DNA, 601 bp, Human
caatggacacctccattcttttgcactttcctttcctctccttttggaaatgttctaattctagatttttcttttaaaaagcagaatgtgcttataagtcatcttaaagttgaaactggctgggcacggtggctcacacctgtaatcccagctgagggaggctgaggcgggcagatcacctgaggtcaggagtttgagaccagcctggccaacatggcgaaaccccatctctattaaaaatactaaaattagccaggcgtggtggcaggcgcctgtaatcccagctacttggaggctgagrcatgagaatcacttgaacccaggaggcggagttagctgagattgcagagattgcgccactgcactacagcctgggggaaagagtgagactctgttgcccaaaaaaaaagaaaaaagttgaaactttgaaacttcttaatcgaagcttaacttcagtttgtgggaactattttgcttattgtgttttctgatgcttccttaaatctttcttagtgcctgatggacctggattggtcaagaggctgatgaaagaagcttccttgttaggttgtgagcttggatgcttggataagaatggact

SEQ ID NO: 68056 - DNA, 601 bp, Human
ttttattttttcttttgagacagagttttgctcttgtttcccaggctgcagcgcaatggcacaatctcggctcactgcaacctctgcctcccgggttcaagtgattctcctgcctcagtctcctgagtagctgggattacaggcgtgcgccaccacgcctggcaaattttgtattttttagtagagacagggtttcgccatgttggtcaggcaggtggcgaactcccgacctcaggtgatctgcctgccttggcctcctagagtgctgggattacaggtgtgaaccactgcacctggctcttttttttttttttttttggttcgagacagagtctcactctgtaacctaggctggagtgcagtggtgtgatcttatctcactgcaacctccgcctcgtggattcaagctattctcctgcctcagcctcccgagtagctgggattataggcacacgccaccatgcctggctaatttttgtatttttagtagaaattgggtttcactatgttggccaggcttgtcttgagctcttaacctcgtgattcacccatctcggcctcccaaagtgttgggattacaggtgtgagccaccgtgcctgg

SEQ ID NO: 68057 - DNA, 601 bp, Human
gctgggattacaggcatgagccatggcacccagccaaattttcttttttttatatttttgttttgagatggagtctcgctctgttgcccaggctggagttcagtggcatgatcttggctcactgcgagctccgcctcccatgttcatgccattctcctgcctcagcctcccgagtagctgtgactacaggtgcccgccaccatgcccagctaattttttgtatttttagtacaggtggggtttcaccgtgttagccaggatggtctcgagctcctgaccttatgatccacccaccttggcmgcccaaagtgctgggattacaggcgtgagccactgcacccggcatgcctggctcattttttgtatttttagtaaagacagggtttcaccatgttggccaggctggtctcgaactcctgacctcaaggtgatctacccgtcttggcctcctagagtgctgggattacaggtgtgagccactgtgcccagctgtagtatttatatttttacattttcattggatgtgacttgtaatttcctaagcatctttctgaagtacatttataaatagtatgtgcagatgttatcaaaggcactactg

SEQ ID NO: 68058 - DNA, 601 bp, Human
cctctagttgctcagatataccaaaattggaaggagataggtatgtgagtttgttttagtagtatttaatagatgttacatgttttcctaaattttatattctcatagttctaataattaaagaggaggaaaaaaaagttacgcagttaagagatcagagagtaaatgtttggttagaaatctgaaatctgtgattcttgaagaaaaatcttcattcagaaacaccgtagtttataaaatatgcttaactttctatcacaatctatgtcaattggaaataattgccacattgaacaatagctgatgaaaagtcaacattggaaagtctaaataatgaaatgaaattctattgtagtttcaccttctgctaaatcttttcatagagcattcgaactagatgatttcagtttccgttttttcattagcacctcaaattatggcagtgctaatgaataataataatgggatgacctgaggtgaggcaagaggatctaattgtttaaaacagtgtaccagtagtcagcagtgagttgagataccataattattgctatagaaatattttggtaaaattgctgttctggattctccttcactcaac

SEQ ID NO: 68059 - DNA, 601 bp, Human
caggtgatctgcccaccttggcctcctaaagtgctaggattacaggcgtgagccaccgtgcccggccagacctggctctttcttttgtttttttgagacggagtgtccctctgtggccaggctggtctcgagctgctgacctcaggtgatccacttgcctcagcctcccaaagtgctgggattacagaggtgagccactgcgcccggccaagtttttgaactctttcaaaaaataactccttggtcttgttaaattacttaaactgtgggcttcagtttttcctttgtaaagtgtttgctrtgttaagttttttttgattgtcactggaacctttcctttgtgtgctatagttttgttattttccctgggtctaaggatctcagtacatgtttttacagttacaatactcgtatttggccaattttcttaccctttttctacctttattcttttcatctatgcctgtttgatttttcacacattttaaagatactgtaatcatgtttactttagctaatagtgtcttgaaaattatcatgtatttttgtcgactacatatagcacttcatttaggggtgtaaaaattgtctttatgtatta

SEQ ID NO: 68060 - DNA, 601 bp, Human
cccgggttcaaacgattctcctgcttcaccctccccagtagctggtattacaggcacatgccaccacgcttggctaattttgtatttttagtagagacgggagtttcaccatgttgaccagtctggtctcgaactcctgacctcaggtgatccacccgcctcaccctgccaaagtgctgggattacaggtgtgagcctccacgcccagccttgagcacttttatatttatttccttttctctgtttttccaatctaaatcattaaggcaattatatatatatatatattttatttttttatttttttttttttaattttctattttttgtattttcgaaaatcgcctagagtggttttttcttttgagacgggatctcactctgttgtccaggctggagtgcagtggcgtgatctcagctcagtgcaacctctgcctcctgggttcaagcagtttctcttgccacagcctcctgagcagtgggactacaggcatgtaccaccatgcctggctactttttgtgtttttggtagagacggggtttcaccatgttggagaggctgttctcaaactccagggctcaagtgatctggcctgccttg

SEQ ID NO: 68061 - DNA, 601 bp, Human
cgattctcctgcttcaccctccccagtagctggtattacaggcacatgccaccacgcttggctaattttgtatttttagtagagacgggagtttcaccatgttgaccagtctggtctcgaactcctgacctcaggtgatccacccgcctcaccctgccaaagtgctgggattacaggtgtgagcctccacgcccagccttgagcacttttatatttatttccttttctctgtttttccaatctaaatcattaaggcaattatatatatatatatattttatttttttattttttttttttwaattttctattttttgtattttcgaaaatcgcctagagtggttttttcttttgagacgggatctcactctgttgtccaggctggagtgcagtggcgtgatctcagctcagtgcaacctctgcctcctgggttcaagcagtttctcttgccacagcctcctgagcagtgggactacaggcatgtaccaccatgcctggctactttttgtgtttttggtagagacggggtttcaccatgttggagaggctgttctcaaactccagggctcaagtgatctggcctgccttggcctcccaaagt

SEQ ID NO: 68062 - DNA, 601 bp, Human
cctctaattttttgtatttttagtagaggcggggttttgccatgttactcaggctggtctcgaactcctgagctcaggtaatctgcctacctcaacctcccaaagtgctaggatgacagatgtgagccacctgcctggcctaagttgaaaataattttgagtcccttgaatacctttacggtttttctgagtaagctcatcttagatttgattatgtcttaagaaaaaaaaaaaaaagaaaaaaaacagcctggtatttatgggggattggttccaggaccctctctagataccaaaaccyggatgtgctcaagtcccttgtataaaatggtatagttttgcttataacctatgcacatctacattttcctgttactttaaatgaactctagattacttataatatctactacaatgtaaatactgagtaaaaagttgttatgctctattgttaattggcaaaaaagtttgtacatgttgtacatgtttagtagagatgcagccatccatttttaaaaaaagaaagttttccggctgggcacggtggctcatgcctgtaatcccagcactttgagaggccgaggcgggtggattacctgag

SEQ ID NO: 68063 - DNA, 601 bp, Human
tgcacatctacattttcctgttactttaaatgaactctagattacttataatatctactacaatgtaaatactgagtaaaaagttgttatgctctattgttaattggcaaaaaagtttgtacatgttgtacatgtttagtagagatgcagccatccatttttaaaaaaagaaagttttccggctgggcacggtggctcatgcctgtaatcccagcactttgagaggccgaggcgggtggattacctgaggtcgggagtttgagaccagcctgaccaacatggagaaaccatgtctctactraaaatacaaaattagctgggtatggtggcacagctattcttgcggctgaggcaggagaattgcttgaacctgggaggcggaggttttggtgagctgagatcacaccattgcactccagcctaggcaacaagagcaaaactccatctccagaaaataaataagtaaataaaaaatgttttccatctgcagttagttgaatccgtggatgtagaacctgtgaatatggagggctgactgcactttaaatttttttaggccaggcgtggtggctcacgcctgtaatcccagcactttgggagg

SEQ ID NO: 68064 - DNA, 601 bp, Human
gtagaacctgtgaatatggagggctgactgcactttaaatttttttaggccaggcgtggtggctcacgcctgtaatcccagcactttgggaggctgaggtgggtggatcacctgaggtcaggagtttgagaccatcctggacaacatggtgaaacccaggctctactaaaaatagaaaaattagctgggtgtggtggcgtgagcttgtaatcccagctacttgggaggctgaggcactagaatcacttgaacctgggattcagaggttgtggtgagccgaaattgcaccactgcactctakcctgtgtgacagagcaagaatttgtctcaaaaataaataaataaataaataaataattttacttgtgtattcataatgtgctgactggatgagtagaaacatatctaatgaatattgttcctttttaaagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagt

SEQ ID NO: 68065 - DNA, 601 bp, Human
tatggagggctgactgcactttaaatttttttaggccaggcgtggtggctcacgcctgtaatcccagcactttgggaggctgaggtgggtggatcacctgaggtcaggagtttgagaccatcctggacaacatggtgaaacccaggctctactaaaaatagaaaaattagctgggtgtggtggcgtgagcttgtaatcccagctacttgggaggctgaggcactagaatcacttgaacctgggattcagaggttgtggtgagccgaaattgcaccactgcactctagcctgtgtgacagakcaagaatttgtctcaaaaataaataaataaataaataaataattttacttgtgtattcataatgtgctgactggatgagtagaaacatatctaatgaatattgttcctttttaaagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaagga

SEQ ID NO: 68066 - DNA, 601 bp, Human
ctgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtaagttgtctgattatgctataaatcttataaaatccatgtatatrtggcatttgtttatgtgcaaacctagtatgaattttaggttcaaatagatggggaggaattaatttttttgtaatgaagtggtaaatccttctttttaaactgttcttaaaacttttttctactgccctaggtaaggattctaactgtaaataagttagtaagtcacttagcaagtatcttctgctttaacctcaagaaaatcacgtgcttttatttcagtgagtccctgactctgcatctgctcaaatttatgaccttgggcaagttatgttaaattcattaaacctgtttttatttat

SEQ ID NO: 68067 - DNA, 601 bp, Human
attgtctagcaggaatttaggactaggagatagttgaagcctaagtgactgtaactaaggcatggcagaggaattaggatctgagcagagttacgcatgcatctcatctgtggttctgatagtaattagactgtttttcctctctttaaatagatttcaagagtttagccaaggaacgtaatggtgaaatgtagtggttagattgccttttttgaactatatgtagtgaaattatttttttatttttattttttgtttttgagacagagtctcaccctgtcaacaggctggggtgcagttwcgcaatcttggctcactgcaacttctgcctcccaggttcaagtgattctccggccttagcctcctgagtagctgggaccacaggtgcgcgtcaccacacttggctaatttttgtatttttagtagtgacgaggtttcactatgttggctagtctggtctcgaactgctgacctcgagcgatccgtctgccttggcctcccaaagtgttgggattataggcatgatccactgtacccagtgaaatttctgtaatttctagtgaaagtataatggaaaaaaatctttaaatatcataaaaat

SEQ ID NO: 68068 - DNA, 601 bp, Human
tggcaccccggtgcacatctttataagaaactactattttccagaaatgcaataagggtttttaatgctttcaattatttgatgagctatgctttaggtaactcagaagagaaatagtatttacaccttaaatatttaagttattaagttttttagcatttaaataaaagtattggccaggtgtggtggtgcatacctgtaatcccagctacttgggaggctgagacaggagaatcacttgaacccaggaggagaaggttgcagtgagctgagatcgcgtcacttcactccagcctaggckaccgagcaagattccatctcaaacaaaacaaacaaacaaaaaagtatttaaaatagatggtggttttcttggagttggtacagtccggaattcctagaacatgatctcatgtgatagggaatttatccagatgatgaaagataagaaaaacctgagaagttagttgctttcaaaatgagctcctaattcttcagggattgactgatgaaggtgcatttgaaaagataataacaaagcggaaagaaaagttgatgccttaaaatgtatgtacatgtatgatttttaaaaagcatctcagac

SEQ ID NO: 68069 - DNA, 601 bp, Human
tgttcccggcctgagactctcagttcttaagagtagaattattgggtcatgggttataattttttttttctttttaaaatgtgttaaatatatataatgaggtttactattttaactgttttacagcatgtaatgtagtggctgtaatacattcacaatgttgtataaccaccagtactgatttccagaactttcccatcatcctaaacaaaaactctgtaaccattaagcagtaacttcccattcattctaccctccgctgctggtaacctcaattctacttctgtatgactttgcttaytgtagatacctcatataagtggaatcatgtatttgtccttttgtgtctggtttctttcactcagcatattttttatgtttttaatgctcacccatgtatcacatcttggttcctttttatgccaaataatattccattacagtagggcccatccacccccccaatccctgccccttatctgtggtttcagttatctgtggtcagctttggtctggaaatattaaatggaaaatttcagaaatcaacaattgataattattaaattactcaccattctgagtagtgtgataaaaatctctt

SEQ ID NO: 68070 - DNA, 601 bp, Human
cgaaatttttgacttggaaagaaaaatattttatgtgcagatttctaagatttatggtaagaacaaatcttctgtttgtgaaattgtgaacagtatattgctatcattgtgctattttgttgttgttcatctcttcctgtgcctaatttataaattaaatttatcatatgtgtgtgtgtatatatatgaatatatatatatgaaaaaacaatatatatacatattgggtttgatactatccacagtttcagtcatcactgcgaggtcttggaactgtgactactgtaaggggtgactattstaactcagcatttgggttgtttccacattttggctattgtgaataatgtccctataaacattggtgtacaaatatttgagtacccgttttcagttgttttgggtatatacctaggagtggaattgttgggtcacatggtaattctatgttcaaccctttttttttttttgagatggagtttcacgcttgttgcccaggctggagtgcactgacgcgatctcggctcactgcaacctttgcctccccggctctagtgagtctcctgcctcagcctcccaagtagctgggattaggcacgca

SEQ ID NO: 68071 - DNA, 601 bp, Human
gtccctataaacattggtgtacaaatatttgagtacccgttttcagttgttttgggtatatacctaggagtggaattgttgggtcacatggtaattctatgttcaaccctttttttttttttgagatggagtttcacgcttgttgcccaggctggagtgcactgacgcgatctcggctcactgcaacctttgcctccccggctctagtgagtctcctgcctcagcctcccaagtagctgggattaggcacgcaccaccacgcccagctattttttgtatttttagtagagacactatttcrccatgttgaccatgctggtctccaactcctgacctcaggtgatcctcccacctcgcccacccaacgtgctgggattacaggtgtgagccaccgcgtctggcctatgtttaaccttttgagaatcaccaagttattttccacagagtctgcaccattttgcatttccacaagcagtttggaagggtcccagtttttctacatcctggccaacatttgttatttttggtctttttgacaactagtggttgtgaagtggtatctgttgtggttttggtttgcactttcctaatgattagtgat

SEQ ID NO: 68072 - DNA, 601 bp, Human
caccgcgtctggcctatgtttaaccttttgagaatcaccaagttattttccacagagtctgcaccattttgcatttccacaagcagtttggaagggtcccagtttttctacatcctggccaacatttgttatttttggtctttttgacaactagtggttgtgaagtggtatctgttgtggttttggtttgcactttcctaatgattagtgatgttgagcatttcttcatgtgtttattggtgatttgtatttctataatagacgtagaaatatctattcatgtccttgtccacttttgaatttttttttttttgattgagttgtaggaacatttttagaaattcaggattcatatcttaatagatatgatttgcaaatacttactttctcatattctgtgggttgtctttttactttcttggtagtgtcctttgatgcacaaaacattggcattttgaaaaagtccagtttatctttttgttgataatcttacattcatacatcattttcctgtttttctttagtttttgtccattgttccctttagctaattggctatataaagagaattcatttaacgtttttgactaataattccaat

SEQ ID NO: 68073 - DNA, 601 bp, Human
ttacaggcgtgagccactgctcctggcctttaatttttttaaaaatatttttgtttgttgagtcgtttataccattatttcctgtaatctctatacccctggtttcctcttattctataaaaatatttacaatagatccttgaattctttgctaaatctgaagtccgagaagacattttcaggtgtgtgtgtgtgtgtgtgttttacatcttgaatgtgggtccctctttctttgcatgtcttgtaatgttttatttatttactggacatttaaaacaacactatagcaatctggattcgwatctccctaccttttgccaggtggttgttgctttgtttgttttgtgaaaacaaacaaactgttgaatctgtgaaatctgaatctgtaaaatctcttctgtattgtgcagctgctgatttctgtcatttattctgcctagttttaatttttaagacttgtttcttattttgtttcttttggggcagcagagcttagtattcagccaaagattgataggtttggtgtccaaatacctttagccagtaaggctgtgctcaagtgtgccctggcttttattttctgttgtgctttctcaggtct

SEQ ID NO: 68074 - DNA, 601 bp, Human
gggaacaatggcttagcattttttaatgttatacatttcactgatgtgaatacatgtatagcatttgtaaagaagcctaattagtatgaagcacgttattactcttataatactagcatgtatgcaagattttcttaactgccacagaaatagaaaaaacaatttaatttttcagtttgtaagtatttctttaccacatagcttttgactgttttagtgttttattcatatgttatgtacttgcttgatgtctagcattttattttttaaaaaatagggtctaaaagttaattattggtcwgatgtacattggcttgcactttagtaccactgcttttcttgccatccttattagggctaaagttcagtaagcccttttctaacaggttgggtttgggtttcttcaatagcgagtattgtctctaattttaaatatttaagttagaattttcttctttgctattttttagccagagttagttatcttagttatatatagatacctgagcccactttattaactttcagaatatttggcaagtgttgcaatagaaaacctacccatgaattaaaacttcacttcattgtcttcttttttttt

SEQ ID NO: 68075 - DNA, 601 bp, Human
attgtgaatagaactgttatggaagttacttttaaggttattagtgaagccagcctttcatgtaatgctaaaaatacactcatttttatctttcttacaagttcagaatttgttgcattgagttattaaagtagattatacacatttagcatggttagaaactagatgttactactgagtgttttctccttaataagttagtttaagaggctggggataatttcacggtaaaatggcaacttaaccccagtttcaaacattgaaacttgaaaattttcctttttgaaaaattacatatacrcctggcactctctatctgtgggtttcacatcccaggagtcaaccaacctcagaaacaaccaatcgtggattgaaaatactttgggggggaaaaaataaaaaaaattacgacagtaagaaaatatacaaataaaaaatagtattagaccacatgtggtggctcatgcctataatcccagcattttgagaggccaaggcaggaggatcactttagcccaggaatttgagaccagcctgggaagtatagcaagcacatgtctacaaaatttttttaaaaaaattagctgggtgtagtggtgca

SEQ ID NO: 68076 - DNA, 601 bp, Human
aatcgtggattgaaaatactttgggggggaaaaaataaaaaaaattacgacagtaagaaaatatacaaataaaaaatagtattagaccacatgtggtggctcatgcctataatcccagcattttgagaggccaaggcaggaggatcactttagcccaggaatttgagaccagcctgggaagtatagcaagcacatgtctacaaaatttttttaaaaaaattagctgggtgtagtggtgcacacctgtggtgctactcaggtggcagtactcatgaggctgaggcaggaggatcacttgagsccaggatttggaggttacagtgagctatgactgcaccactgcactccagcctaggtgacagagtgagactctgtctgaaataaataaatagtatttgcatggcattcacattgtattaggttttattagtaaactaaagatgattaaaagtatacgggaggatatgaataaggttatatacaaatattatgccattttatataagggactggaacatctgtggattttgacatctgtgggggtcctggaactaatcccccacagatactgagggatggatgactatatgtgtgtctgtat

SEQ ID NO: 68077 - DNA, 601 bp, Human
cttgttaaaggtgaagtaatacattttacaaaagcagaattaataataccacagttgtaaaaaagacgaaaaaaaactgatctcaaaaaaaataagattgttttctttgggactttcgttcgaaatttcatcagttttctggtagctgaggtcatttcctgtcataaagtaactaactgtatggttatctgatcctactttttgtgtcttaagaggtctcagtgctttttgaaaaaacgttgaagaaatgactacaggatgacttagtgtgacataacagagctcttttgagtaagcagamataatgttctgccatttttacccttcccatcacatcagagtcccgtctcttcagagttttattatatattattacagtatcttcccttaaaagaggtattttgtttgtttgtttttgtttttttgagacagtctcattctgtcacccaggctggagtgtagtggcgctatctttgctcactgaaacctccgcctcctaggttcaagtgattctcttgcctcagcctcccaagtagcagggattacgcccagataatttttgtagttttagtagagatggggtttcaccatgttggccaag

SEQ ID NO: 68078 - DNA, 601 bp, Human
acagtagtgttaagaaaaatgtaacagtgtagtgctagcacagcaggcaggtagctaagtagagtgatagcatttataatcatgaaagatttaatacctggtaatgcaacaatagactgatagtttgctggcagatgtagtaatttaatgataattaagaaatgtattttatatatagattgtatagtatgatcccaatttggttaatatcacatactagtgataataattatttgagtgttctttttttttttttttttttgagacggagtcttgctctgtcgcccaggctggagtgcartggtgccatcttggctcacggcaagctccgcctcctgggttcacgccattctcctgcctcagcctcctgagtagttgggactacaggcgcccgccaccacgccccactaatttttttttgtatttgtagtagacggggtttcactgtgttagccaggatggtctcgatctcctgaccttgtgatctgcctgcctcaccctcccaaagtgctgggattacaggcgtgagccactgcgcccggcctatttgagtgctttctttgtgccaagcacagttaacagtggtttagttgactctgag

SEQ ID NO: 68079 - DNA, 601 bp, Human
ttaacagtggtttagttgactctgaggtaggaaatattactcttattttacattagaagaaactgagccacagagaggataatttgtcatgtgcctaataaatggcagagccatttttcaaacccaggtagtgactccaaagcctgcatgcacatttttaaccgtcagtactataatgctatgtgtatatgtgcacatatatatggatgtgtgtacatgtatgcataagaagactggatggatatacgttctgttattatctagatgatagcttaatgacagttttgtgtgtgtgtgtgcttgtgtgtgtgtgtgtgtagttgatgacatttttaccattaaaatgaataatattggggaaaaaacatgccaaatgtttatctcaattagtcaaagataatggttttatgctattcatatcattcctttgttggttgttttttgctgacagcgtgtgaaggtggttcaactttcttctgctcaaacagtataatttgaaagttctggcctactgtactttttgtggagttagttgttgatcttgttctatgaagatgaaaaacagtggaatttattggtgattcagttattttccccattc

SEQ ID NO: 68080 - DNA, 601 bp, Human
ttaaacattgtggatcagatttaacacactattagaagtagtatgacctttcagtgatgttttactatacgcttggtttgtttgtattttgtctttggagtgacttaaatatatttgggaagaagaatgtttgagttaactttattatttcattttatttattttagagttttgagacggggtctcactctttcccccaggctggaatgcagtggcgcaaactcggctcactgcaacctctgcctcccagattcaagccatcctcccacctcaacttccctagtagctgggatcacaggcrtgtgccaccatgcccagctaatttttgtctttgtagtagagacggggtttcaccatattggccaggctggtctcaactcctaacctcaggtgatctgcccaccttggcctctcaaagtgctggggttacaggcgtgagccactgcacccagcctgaattaactttaggcaaattacctagcttttgtaatgtatactgaatagggagtaattgttagcagatatttccctttataattattttagaccataatatttatttcttttggtatgagagtttcttcatatgccctctgttggc

SEQ ID NO: 68081 - DNA, 601 bp, Human
gtgctggggttacaggcgtgagccactgcacccagcctgaattaactttaggcaaattacctagcttttgtaatgtatactgaatagggagtaattgttagcagatatttccctttataattattttagaccataatatttatttcttttggtatgagagtttcttcatatgccctctgttggcaactcacaatcttgtttttggtgactatttgggagtatacagaaagagaagttggggcgtaattttaagacaggttctaatcctcatggttgattttctgaaagtagctgtgaaccrtgcagctccttacaattgacttatcttggatttcctggaagtcaggaaggaggttttgtttatcatcattatttataaggaatcatactgatactgatcagtaataccaggcattttacatatatataggtcttccagtttttcaaggacttctgtgtactttatctgatgtaatcttcattataactctgaagtaggcatagcaggttctgttacctcccttttttaaatactgaaagtgagtgaaccttagcgattggggagcctgacatatctcacgtagttattttattttattgt

SEQ ID NO: 68082 - DNA, 601 bp, Human
ttgccttacacgcatctcaccattttctgtcttctctatccaagtgatgcatcaattagaccattgtaatttatgattggaactagtaggagagactagaactggagataccaatgccttcagtataccaaaagaagcagtgaaatctgttagggtgaaagcgtaagggaaggactgtaaggttcattccaagctctgaggtcatcaagtttgcaaatgagtaaagaagactcagaacaaggaatttagaaatcatgatatgtcggccgggcacggtggctcacgcctgtaatcccagcastttgggaggctgaggtgggcagatcacgaggtcaggagatcgagaccatcctggctaacacggtgaaaccccgtctctactaaaaatgccaaaaaattagccaaatgcggtgatgggcacctgtaggctgaggcaggagaatggcgtgaacccgggaggcagagcttgcagtgagctgagatagcgtcactgcactccagcccgggcgaaagagtgagactccgcctcaaaaaaaaaaatcatgatatgtctccactttaatgtctcattgtgttgttcctcattattagtctctctaca

SEQ ID NO: 68083 - DNA, 601 bp, Human
actcatgttctttctgcatggcttttctgccacttcaagggagcaaatgtatgaaactctcttattcttcctatgaatcccctcattttgttagagaagcattttattatcccataacttaggactgattgccccttgacttactagtcctttaaatttctcttaagtaaaaccttgcagcttaaaaaaaagttgcgttaattcctaataaccactaacatagaatatagtcttcgtgaggactgggacttaccttttattcttctgtctcccaattcttgtattgagtaagtgtgcaatmagcattttttggagcatgtgtcaggccctatgctgacccccaataagacattggaaaacaaggttatgacagtttattcttgtgtttgatagtccttcagctgttaatgacagtttttatacctccccattcttttcatctgtgaattctgttttgctttgtgatttaaataattctgtttaaatgagtgctaattccaaaaaaaaaaaaaaattgcaaagtagtgaatataatccttgccttcccaagctgcatacgcagtccctgtgaattcatttgtgttcttccctctagacttct

SEQ ID NO: 68084 - DNA, 601 bp, Human
atcacccagactggagtgcagtggcagtatctcagctcactgcaacctacacctcctgagttcaagtgtttctcatgcctcagcctcctgagtagctgggattggaggcttgtgccaccatgcctggctagtgtgtgtgtgtgtgtgtgtgtgtgtgtgtgtgtgtgtgtttagtagagacaaggtctcaccatgttgaccaagctggtcttgaactacttacctcaagtgatccacctacctcagcctcccaaagtgttaggattacaggcgtgagccaccatgcctagccaattgctcrttgaccaagcttacaatgttgaatttgtgtccactaaatgaagggcacagtatgactgcactgtaatgagtggtgtttttttttttttaacataaggaaatttaattataagaggatatgtgcagtttttgttattggtatattgtttattttagcttattttttaattttattagaattctggcacaatatagcccttgtttgcttttaaaaagatgggctgttagattgcctggattttcccctttatccactacctatgagcaaattacttccctcagctttagtttcattttgtag

SEQ ID NO: 68085 - DNA, 601 bp, Human
atgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaaggtaaagaactttaagaaagtaaattgatacgctttctatgtttctgacaagttatgaaaaatgaatatataattaaaaaatataactatctttttaaatacattgctcagatttttattgtggcagatgtgtatatrtgtatatttataatttttcatttcagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggttagtacagagtgcaaattttaatgttattgaaactttgtattttatataatgtcttgcttata

SEQ ID NO: 68086 - DNA, 601 bp, Human
tgttattgaaactttgtattttatataatgtcttgcttataattctgtcaagaaatgtcttttcataggtgtacagataagagagcaagaggaagtaggagattagcacgttacaataacacttaatgcgtgaaaatattgtgattaattaatgggctccatttattagtacctatcaagtgggtaattctttttaatggttgtatgttaacaggtttaagagatttaattcttagtatttgtacatgtacataaagaggacattacaagaattattttgttcaatctttttttactttargtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcat

SEQ ID NO: 68087 - DNA, 601 bp, Human
gtttgtatttggcttacatattttaaaggctgggaatatacttgatgtgatttcgctgcatgttttaggatctgtgtcaatattttctattgtaaattttggtattttaaaaaatgtcagtatttatgaaatgtctctttaggttaatctatttctccctgttattttaaacatttcttaaatgaagttgtgtgtgttttttttgggtttctggtattgacatgcacatcattgtgctactggcaaagtattaagtattgcattgaagttgaacagtgaaacttttcataaattgctaacytaatatagagctatcattttctagccaggaggtatttttgatcattacacgagctcacacattcactgacacagccatctgacacatccagctccataggcaagaaatgtaatttacttaagtgctaaatattttcgtctccaagtatgtaacagatttctacatacaaggagtaaatacattgcagaataaatagaatataattatctactgattactagaaaagaggaaagtgtatttaggcatgcgtattttaatattatacaatacatttaaataggaaagtttactgttttcttt

SEQ ID NO: 68088 - DNA, 601 bp, Human
ttatttgcagcacatttaatatttttatgatgtaagcttttaagaatgagcaaccctcatgtgattgactgccatatagttaatacttttaaaatttattccttttcattatttgaacttagtatagtatgtttttcctgtactattataactaaagtcaaactcccttacataagtttgagctgtaaggcacagttgttgttcccatcaacaataatgagttttgtttgaacacacttttttataggaataaaaacattagaacctagtttagtgctatatgaattataagttgagagtyagatgttttatttcagttcctgtgaatctaagaatagtatcttataccttgctttctagtttatatagtccattttggattcagcctgcacttaatctgttcttataccttgaagtctttgtctttcattagatttgatgttctactcagtttctggctgttggtgtctattttttagacttattacatataaatattagtgttagtaatgataagatatgttttggatttatagaatgttttgtttcacttatattatcagatctaattaggaatcctaaagtcatctggatgtttttc

SEQ ID NO: 68089 - DNA, 601 bp, Human
gagtttttttcatctatggagataacagccaagtggatttttaaaaataacgttagtgatgttttttttcctgataccaaaaacaggtgtcaggcagggctcactttgggaggttgaggcgggtggatcagttggcaccaggagttcaagaccggcctggccaatgtggtggcgtgtgcctgtagtcccagttactcaggaggatgaggcaggagaatccttaaatctgggaggcagaggttgcagtgagctgatatcacaccactagtccagcctgggtgacacagcaagactatcttaaaaaaaaaaaaaaaaaaaaaagtgtcaatagtagtaatttagaaagtgttctctgagaaggaagacttaataagctgctaactcaattattattcatttataattgtggctatacctttctagtactttatatttaaagtaactttctgtgtacatgctgtatggagaacacagtcaccagattgtaaggtctttatgaacagagagttttttctcttctttggtctgtttgttcattgttgtcgactgctgattgctgttgtttagggatgggggagataggataggagggaagtgtgga

SEQ ID NO: 68090 - DNA, 601 bp, Human
ctattagttctttggccttataaactagatccattattttcctggtaaatacattttatcttggttctcattacaacaaaatgctataatttcataatatcctaattatgttgatatagtgtgatttggcaacgatgaagaaaatgcaatgtagaaaacatgtaaaaatacaaagtgatgaagacagcagttttaaaagctcttattctttaagatccagcatgtgatttttttggtgtatttttttcttactttttctttttttttcctttttaaaaagtatctttataaattagcatgyataatcctttatcatctccataccccttacttttcaaaagtctgttttgggtactaatctgtatatgtcagatgctgcagtcattttcaaccatttgtcattccttaatcttatgtttgctcatgattttctattttttacttgatattctctttatctggagtagatttcctgtgtgcacgatgaacacttcgttatcgaaggttcacataaagcgtgcctttctctaagaggctttttctgtcattcccagcagagttagggactttgccatctgtacttcccttgcgctctcaaata

SEQ ID NO: 68091 - DNA, 601 bp, Human
tcttcttgattgagctttggtaattttgtgaaggaagttgttcctttacattgttgtatttgttagtggaaatatgtatatgtattaatgtttataggatctataagtttccttcatttctgatgttggtaatttttatctttttttggggtcattctggctagaagttcatcaatattatttcaaaaaaaggcagcttatagattatttcttcttttctactttctttgaatttaatttgatctttatggcttagataattgattttagacctttcttttctaatacaagcatttgacawagtcagaattggtctatatagactatatagactacatacatttaatgtaattattgacatgctggattaaaattgatcattttgctatttttctatttatttcatctatttttgattccttttaagaaatctttttctgttgacttttgaattaagcaacttttaaaataatttcatttccatccttatttataactgaatttcttatttatttttgagacagtgtttgtttgctctgtcgcacaggttggagcgtagtggtgcgatcttggctctctgcaacctccgccttctgggttc

SEQ ID NO: 68092 - DNA, 601 bp, Human
gttgcttaactcttttacctcttggaatgttaatacattacattaaatttttaaaataaatgaacatttgtatactgtggcaaaatccttttctaatatatttttgcctgttggtatttttttctttgtcagtgtgtgagaaacagccacatcttctgtttgattagattaaaaagaatagttacatgctggtatcacatatttttctattcatgtcctctcttcttgatgtatgtagagtgatgttctcagtcatataacagaacaacttatttttattgttggtgatatagaggtattktcatgtaagaagatagccataaaccgtgctctactgaatattgtcattgatattttaatctctaagagtccattcgggttatgtgtagagggtttagacagctattatatattcattcttcagcagttttggaaaaagtgacttttcagcttctatattttaattattatttgtttcaccatgttggccaggctggttttgaactcctgaagtcaggtgatccacctgcctcggcctcccaaagtgttgagattacaggcatgagccactgcgcctggctggatatatatacttttaatg

SEQ ID NO: 68093 - DNA, 601 bp, Human
ataatcatgctatagtaaatgtttctgacagtttttccttagatgatctcataaaagacaatactgtgatatattgtatgtttaccatatgcctcacacgatgtaacttctgcaagtattcatgaacattagacatacatttgtatgtgtttggacatactttaagcaaatttgaacttaaatagaattctttgttaatactgcttttgaggaatggaataaaacatatatttttaagttggctacgtgtgaaaggaaccttgtaaagtgatggtatcagagtcatactgtcttaggtagyactttatatgtgtatatgaatgtagggatattgtgtctgtagttggtacttcaactgtttttataatggttctgtttatttattattgattatcgtattcatcgaaatcttttcatgactttctgcaccctttcctgctgtttacagaatgaaacaatatcataacatgtaaatgacatttgaacacattggctaaatatttagtgatttttttcttttcttttctttttttttttttttttttttttttttacatttaggtaattttaatgagttgtcctaatgtcattctaccttgat

SEQ ID NO: 68094 - DNA, 601 bp, Human
ctaaattagggaagtaaaaagagaattgagctagatgcagtggctcatgcctggaatcctagcactttagtaggctgaggcaggcagatggcttgagcccaggattttgacaacagtctgcacaacatggcgaaacctcgtctctcctaaaaatacagaaattcatggcatgtgcctgtggtctcagttacttgtgaggctgaggtgagatgatcacttgagcctgggatgttgaggctgcagtgaaccgcgattacaccactgcactccagcctgggcaacacagcgagaccttatcttaaaaaaaaaaaaaagagaattggagacttgataacagttatatagtgaaaaaaattaaaatttcaaatcaattcattcagcctttaaatttcttaataactaaatcacattatatgatcacccatttattttataatttttagtggtgtgctgtatgccacagtaatgaaaggaatattcagagtaataactatctatgagagcccttaatactcattttttaaagtaaaacacattaaattttaaaacatattactttgttgtctaagattcctgtttttgtcctaaataaaaattaaca

SEQ ID NO: 68095 - DNA, 601 bp, Human
caccatccaggagggggaggacaatacctgataaaataggaagtacttcaggagcagaggctgccaacaaaataattactgtcccagtgtttcacctgtttcacaaactcttggcaggtaatattcctcaatgaataaacgtcaaagaaattttagtagccttaaaactatgtaaatcagaggcacagtcaccaaaatcattttaatcaggtgccattgatgagatcagtgagttagtgagacttcttccatacagttcctccgaagagaagtgagagcaaaggaggagtaatctattacrtatcctttttaacactatcaagttatttatttctactttactggttttctaagtttttctgtcagtgtgccatgaaatgattgatgaaatagacatttagagagttcatgacaagttatttaggaaacaccgtggggcaaatttgtaggactagttcaagcagtagaactcttagaccactggtagttaagccatatgttcttcccagataaaacacatttattgagcaccatcctgtctgttgttcaaggtgataacaggttgagcatccctaatccaaaaattcagtatctgatactt

SEQ ID NO: 68096 - DNA, 601 bp, Human
tgccaacagcaggtttcccacgatgccccacatgatgccaagatgtgtgtgcattactgtgtttttttgctctgtggtgttggaaatttaaaaaaggccccagatacccttatgggtaacaatgataaaaagaggaagtatttatgtttatctgtagcacagaaaaacaagctgttggagaaactggacagcaatgtaagtgtgaaatgtctttcaagagagtatggtgttggagtgaccaccatacatgacctgaacaaacagaaagataaaccattgatgttctgtgctgcaagtggtkaatagaggttaatgaaaaatagaaaaagcactccatgaagctaaaaatgaagatattgattgtgtattgaaacagtgaatccatcagtgttggcagtgaacacgtgcctcttaatggtatgctgatcatgaaacaagtaacgatctatcatgatgaactgaatgttgaaaggagctgtgaatattcaacacactggttgcagaagtttaagagaagatacgacattacatttttaaagatttgtggtgataaagcatctgatgatcaggaagcaatggagaagttcattgataaatttgc

SEQ ID NO: 68097 - DNA, 601 bp, Human
aatatagaaagcagcacttctgctgtaatgaacttggatgtaatgaacttacatgtaatgaacatgtaatgaacttggatgtttagctgagatttccacacaaagtggtgaaagtacaacctgtctttttcttgctgcttatagtgaaatgtgcgaggaaagatataaattgagagaagaactgttgaaaaacaagcaatcagtgcttgtcaatttgtgaaattacctatccagatcacagaaggtgctaaaatttagatatttgctatcagaaaagcatgctccaaagtataagccaagrgtgaggctggacaaccttttgctagtgccttagaaacatcaaaagtcagagtattcagtcacatagagggctctttgaagagattaggcatgtaactcatggatctcctcagccgtctaagcataagcgaggaatagaggatatgatgtgatgatggaagcatccaagagccatggaacgtaagtagcctctggaagctggaaaaggtgaggaactgttatttcctaagagcctccagaagcaatgcatcctttgattttagtcccataagacctgttttggatttctgacctctggaat

SEQ ID NO: 68098 - DNA, 601 bp, Human
tttcttgctgcttatagtgaaatgtgcgaggaaagatataaattgagagaagaactgttgaaaaacaagcaatcagtgcttgtcaatttgtgaaattacctatccagatcacagaaggtgctaaaatttagatatttgctatcagaaaagcatgctccaaagtataagccaagagtgaggctggacaaccttttgctagtgccttagaaacatcaaaagtcagagtattcagtcacatagagggctctttgaagagattaggcatgtaactcatggatctcctcagccgtctaagcataascgaggaatagaggatatgatgtgatgatggaagcatccaagagccatggaacgtaagtagcctctggaagctggaaaaggtgaggaactgttatttcctaagagcctccagaagcaatgcatcctttgattttagtcccataagacctgttttggatttctgacctctggaattttaaaataataaattgtgctgttctgagccactgagtttgtggcaatgtgttatagcagcagtagaaaactaatacagagtttggtctgtagttgtaatgcctttgtctggttttggtgtcaggat

SEQ ID NO: 68099 - DNA, 601 bp, Human
aagcatgctccaaagtataagccaagagtgaggctggacaaccttttgctagtgccttagaaacatcaaaagtcagagtattcagtcacatagagggctctttgaagagattaggcatgtaactcatggatctcctcagccgtctaagcataagcgaggaatagaggatatgatgtgatgatggaagcatccaagagccatggaacgtaagtagcctctggaagctggaaaaggtgaggaactgttatttcctaagagcctccagaagcaatgcatcctttgattttagtcccataagacstgttttggatttctgacctctggaattttaaaataataaattgtgctgttctgagccactgagtttgtggcaatgtgttatagcagcagtagaaaactaatacagagtttggtctgtagttgtaatgcctttgtctggttttggtgtcaggatactactagctatatgggatgggttgagaatttctaatatatcaaattaaggatactgttaggtgtgtttaataagagacactgtctgggcatggtgtaatcctagcctgtaatcctgtaatcacacttgtaatcccagcactttggg

SEQ ID NO: 68100 - DNA, 601 bp, Human
ggcatggtgtaatcctagcctgtaatcctgtaatcacacttgtaatcccagcactttgggaggccaaggcaggagggtcacctgaggtcagcagttcgagatcagcctggccaacatggtgaaaccccgtctctactaaaaatacaaaaattagcccggtgtggtagtgggtgcctgtaatcccagccgttcaggaggctgaggcaagagaattgcttgaacccgggaggtggaggttgcagtgagccgagatggcttcattgcactcaagcttgggtgacaagagtgaaattccatctcaaaaaaaaaaaaaaaaagagacactgcagattgcaacagtagtgaactggaagatgtatcaaaagaaatcattcggcttggcgcggcagctaatgcctgtaatcccagcactttgggaggccgaggcaggcggatcacctgaggtcaggagtttgagatcagcctggccaacatggtgaaaccccatctctactaaaagtacaaaaattagctgggcgtggtggtggacgcttgtaatcccagctactcgggaggctgaggaaggagaattgcttgaacccaggaggcagaggctgcagtg

SEQ ID NO: 68101 - DNA, 601 bp, Human
agaagaaaaatttcccaaatagatgtaaaacttaaatctcaattcaacatgtaagaaactgttaactcatgcaggatatgcatgcctggaactgtcatggtaaaagtggttaaaaacaaagacagctggccactgcagtgcatctctgaaatcccagctactcaggagactgaagcgggaggattacttgagcccacgggttccagaccacctgggcaacataacaagacctcatacccccaaaaaagcaaaaaaaaaaaaaaaaaaaaaaaaaagctaagacaatgagagaatataaaamccagctataaagaaaatgacctatattttcaaaacagcagcaataacactaacaactggcctttcaacagaaaccatatgagccagggaattacaactttattttattttattttttaaattatacttttagggtacatgtgcacaacgtgcaggtttgttacacatgtatacatgtgcaatgttggtatgctgcacccattaactcatcatttaacattaggtatgtctcctaatgctatccgtctcccctcctcccaccccacaacaggccccggtgtgtgatgttccccttccctgt

SEQ ID NO: 68102 - DNA, 601 bp, Human
tatcctagtatatcagaaataaaatttctttgttgttaattgagcaaaaagcatgttttcatatacttttcagttttgactttcaaaatgtgaaataatacaagtgaatataatactttaaaaaattaaatccacttaatattaataccctaaaacagttctgtttgaatcgttatacttgtgacatttatgtaaatatcagtttatattctactgtttggtgcttttgctgaacctgtattttgaaattaatctttgttgatgcctaagcctgtggtggtctcatttgtatagctctagyatacttgctgtatatttaactataccttattgtgtgtattagtcttaatgttgactagcatttttatttccagttgttagctataatgaaaaaagttgtgaagaattgtatacatatctaatataagacttaaaaatttgtatctgtataatgggtgatgggaaatatatgatagtggttttaatttgctcttctgattttcgtgaagttgagggtctttcacttgttaaagaatttgaatgctataaattgagagctctttgattttgctgtctttttgctttcattgtatttgttttg

SEQ ID NO: 68103 - DNA, 601 bp, Human
aacagttctgtttgaatcgttatacttgtgacatttatgtaaatatcagtttatattctactgtttggtgcttttgctgaacctgtattttgaaattaatctttgttgatgcctaagcctgtggtggtctcatttgtatagctctagcatacttgctgtatatttaactataccttattgtgtgtattagtcttaatgttgactagcatttttatttccagttgttagctataatgaaaaaagttgtgaagaattgtatacatatctaatataagacttaaaaatttgtatctgtataatkggtgatgggaaatatatgatagtggttttaatttgctcttctgattttcgtgaagttgagggtctttcacttgttaaagaatttgaatgctataaattgagagctctttgattttgctgtctttttgctttcattgtatttgttttgttttgtggcatcatatgagaatagtcctttaagaaaacaattatgatgaggtaaagttctgcttctgtaacaatgttctattatataggtacttttatatgaaactatcttctgtgcagcataaaataataaatatagaggatctttaaaaat

SEQ ID NO: 68104 - DNA, 601 bp, Human
gcccatgtagtttaaacctgtgttattcaggtgtcaactgtatttattttagtaggtcaggaatttctaattacttgatctgatttttttttaagtagatagaggggtaagaaccatattttttattgatacatagtagttgtacatatttatgttatacatacgatattttgataaagacatagaatgtgtaataagaaccatggtatttcaacactgttaccacagagtgttaaagtaggtgtaaccctaaacagaaaaggaaaaaaaaatggctttctgtaatttcacactatttttwgtgcatatacaatgaatttttattaaaaaggatagttatgatatctctctctctaataattgtctcgtgtaccatccatgtagcattgctttctttgcatttaataccccttcctggctagaacacagtagaacactgttgggaaaaaaatagttttacttgttcattatctgttcttggttaaagctactcccaagaaaagcagttactttcttactgttgtaagatactactaatgcttcttttctattgttcaggttttagtttaaattctagttcgtaataattttgacataatct

SEQ ID NO: 68105 - DNA, 601 bp, Human
aagtgcacttcctgggaaggtgtgtatgttaaactgatttttggtaaatgtatggaattgcagagacttagatattataccttggaactgttttagaaatttaatgtgacagatcgaagtttgacctttcttttatgatgtattattttcctggaaaaaagaaatttctttcatcaggctttagatgttcttgaatttggtaacttgtccagtggttaattctaattgatatatttggatgtggtaacaaatacttattttgagataataccttatattaagataaaatgatgtaacttayagtcagtaggttaaacggtagcatgcctcctaaatgatattaaatatggattgttttcaggaaaacacagcttaatataagtatataagtacatatataattaagtaaacataaatataaatatataaatatataattagttatcagttttggttagaatagtaataattttttaagtggctactatttatttatttgagacagggtttccctctgtcacccatgctggaatgcagtggcacgatcttggcttactgcaacctccacctctcaggttcaagcaattctcctgcctcagcc

SEQ ID NO: 68106 - DNA, 601 bp, Human
acctccacctctcaggttcaagcaattctcctgcctcagcctcctgagtaggtgggattacagacatacagcagcatgcccggctaatttttgtatttttggtagagatggggtttcaccatgttagccaggctggtctcaaatcctggccccatgtgatctgcccaccttggcctccaaaagtgctggaattagagacctgagccaacacaccctgccttaagtggcatttaaaaacctgaacaaattatctagccagagtcttccttagacttagtaaaatttctattttggaaaattrgtctaaagtttattttccaattttttcatttgcgtatatagtattatttttggcaatgtgggagttgaggtaatgtgataggatccactccaccattttttactacatttagttgtcatgtccttttcttctgtaatctggaagagttcctagcctatctttatctttcataatactgatatttttacagaatgtaaccatttattttatagaatattctacagattggtttgtaagtgtgagagtagtcctcataattttgcctgagacattgtattcaagggatgatttgcttatatt

SEQ ID NO: 68107 - DNA, 601 bp, Human
atttttgctgttgtgtcttgtatacgttactaaatcttgtatgttttggagtagtccatcttcagtgtccatattcattgctttgtcctgtttttttcctctgtgtaaagttaaaatttacctgtttgctttgttataattttattcctcaaactggaagcatcatatagtaattgctcttagagcaagggagttaccctgggatgtatgtcttaatattctggaggtgtgcttttaaaggatagtttctaaatctttcttgttagagccaggttttgccctgaatgcagtcccttgaacragaccttcagagtgtggtatggatgtagaccaaaacaatcactaagaggttaagtactgttccagctatacctaacatagtcaagatagattcttctttttcttctcttcttgcttcttaacatcttctgctgtagtgatgacagaagtaccagttttcccagaaaatgtcttcatctagagaaaaagagaatgattgtgaagcaaattgctagaaaatgtatttattacaaatactagtacatactagaaaattgctagaaaatactagtaaatactagaaaattgctagaaaagaaat

SEQ ID NO: 68108 - DNA, 601 bp, Human
aggcgcacattgaatcctgtaataacaatgaagtatgtgtaaaggagctaaatttgaagacatctaagggttttctgatgaagctcttcatggcaaaaatagaatgaaagaattcaagattgaagtagtttttatgttgttttgtgctttaacaggcaggtttttattaagggtttattatctttatccattcttgttgcttgctgaccaccggtacacattaatttacaataaaagcacatgtcttaaaaggagagcataaatcagctctacattagttttccaagttctcctcttggtkgggggggtcttcaaaatctttaaaaaaaaaaaaaaaataaggccggcacagtggctcacacctgtaatcccagcactttgggaggccaaggccggtggatcacctgagttcaagggtttgcctggccaacatggtgaaaccctgtctctactgaaaatacaaaaaaattagccaggtgtagtggcgggtgcctgtaatcccagctgcttggaaggctgaggcaggagaattgcctgaacccgggaggcggaggttgcagtgagccgagatcacgccactgcactccagcctgggcaacag

SEQ ID NO: 68109 - DNA, 601 bp, Human
aaagatttttgtaaaataaacacacaattttatctctcacattttttggactattcccagtctcgtgtgccagtgcttattattaccttgttttgctagcttttgccttcatactccttgatatgaagagaatatcttcttctatttccataatgtaagattcccagttggcctctcctaatgctaactcaatagagtaaaatatataccagttaaataagagggaatagcatgtttcatttatttcagaggagctgtgttgttttctctatgcccttttgtttacatgtgaatataatgkaactatatattttttcttttttcttcttcagtcatagtcttctctgccacccgggctggagtgcagtggtgtgctcatagggcactgcagccttcaattcttaggctcaaacatcctcctgattagctgggactacaggcacctgccaccatgcccagctaagttttaaaattttttgtagaaataggttctcattatgttgcccaggctagtttcaaaactcctggccttaagcaatcctcttgtctcagcctcctgagtcactgggattgcatacataagccactgtgcccgactttt

SEQ ID NO: 68110 - DNA, 601 bp, Human
atctcgtgagaactcactattatgaggacagcatggaggtaaccacccccatgattcagttacctcccactgggttcctcccatgacacatgggggttatgagaactacaatgcatgatgagttttgggtggagacacagccaaaccatatcacatagtctccctctttttatgtttttgttatttgtgttttgttttatgtttacccaaataatcatttattttttattaacatttatgggttatgtttaccatataacccatttttataccttactgtcctatccccaccccaaaatgwcattatagtacttgcgaatttgctccagtacagcataaagcatattctaattttttatggctacataatgggcatttagtaattaaaacagttgcatattaataaacataaataggttcttttttgagataaggtctcactctatgtcccaggctagagtgcagtggtgtaatcatgactaactgcagcttcccatgcccggctaattttttaaattttatacagacaggatcttgcccaggcttggagtacagtggtgtgattatggctcactgcagcctcgacctcctggactcaagt

SEQ ID NO: 68111 - DNA, 601 bp, Human
tgtttgtttgtttgtttgtttgttttgagatggagtctcgctctgtcacccaggctggagtgcaatggtattatcctggctcactgcaacctccactttctgggttcaagcgattctcctgcctcagcacccccaagtaggtgggaccacagacttgcaccacaacacccggctaatttttgtatttttagtagagatgggtttcaccatgttggccaggctggtctcgaactcctgacctcaggttttccacccaccttggcctcccaaagtgctggagttacaggtgtgagccatcacrctcggcctatttgtttatttttaagggttgaggtcttgctctgttgcccaggctagggtgcaatggtgtcatcgtagcccactttagcctcaaactcctggtctcaagcagtcctcccaccttagcctcccaagtagctgggaatacaggtttttgccatcacatctggcttattttattttattttattttatttttgtggagacaggttttcttgctcttttgaccttgcttgtctcgatctcttggtctcaagtgatcctcctgcctcagcctcccaaaatgttgggattacaggtg

SEQ ID NO: 68112 - DNA, 601 bp, Human
tccctgtgtgatctcatagctataggtatgaagtttttcccaaatggtgtcccattgtacctgttagacaaatagatgctagtttctcacataatgttgatgtcagagacatctttcagtgtcaataaataccactgacattgttctaaatacttcaaattcacctttgtatttaggtgctatattttatttaactatttattagtagattttaggttattttcagttcataataacctcatacatacatcttttggtgcttgcagaaatctctgcagatagaatcttagaagtataattsttaggtttatggattacttctgttttattttagaagtcaaaggattcagtatttgatggaattaaaataagtcttaatgcttatctttaaggaaaactgaattgttatttttagtttgtttacaccttagtagattcagaggatgagttctgtcaaaactcttttttaaataacctaggagaccttttcctttcccttggcaggatctgttcagtgaccttttcctttctcatggcagaatctgttcagtggttgtcagtttattcctcaaagatggcctaattctgaattttgaagcat

SEQ ID NO: 68113 - DNA, 601 bp, Human
gtgggcacataactagaaaattggtcttctttctaaggggctgacatataaatgggggaaataataaccaggcaggtttttttttttttttttggacagagtctcgctctctcggccaggctggagtgcagtggcttgatctcggctcactgcaacctccgtctcctggtttcaagcaattctcttgcttcagcctcccgagtagctgggattacaggcgtgtgtcaccacgcccagctaatttttgtatttttagtagagacggggtttcaccatgttggccaggctggtcacaaactcytgacctcaggtaatccgcccgcctcagcctcccaaagttctgggagtacatacaggtgtgagccactgcgctgggccaacctggcagttgtaacaacatagtatctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgc

SEQ ID NO: 68114 - DNA, 601 bp, Human
gctgacatataaatgggggaaataataaccaggcaggtttttttttttttttttggacagagtctcgctctctcggccaggctggagtgcagtggcttgatctcggctcactgcaacctccgtctcctggtttcaagcaattctcttgcttcagcctcccgagtagctgggattacaggcgtgtgtcaccacgcccagctaatttttgtatttttagtagagacggggtttcaccatgttggccaggctggtcacaaactcctgacctcaggtaatccgcccgcctcagcctcccaaagtkctgggagtacatacaggtgtgagccactgcgctgggccaacctggcagttgtaacaacatagtatctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgcctgagcatagtgtagctggaaggtagtggtgggagatga

SEQ ID NO: 68115 - DNA, 601 bp, Human
atattgatgttggctggtttactaataaccagaatttgaattaaggccatttctgagatagcattccttctggaggaacaaaagattaggccagtattttatgtcaaaatagagattttacattcaacactttgcattttttgaactagaagacaaggttagagttaagtattctcaggattttcttcagaaattaaaggtgtttttttaaggaatatatgtgacatttggtacattagtttaatagcattttgaatgtgtactttacctatacctataatgctaaaacgtattgtaattytttttccccctgagacagtctctcactctgtcgcccaggctggagtgcagtgacataatcttggctcactgcagcctccacctcctgggttcaagtgatttttctacctcagcctcccaagtaactggaactacaggctcccgccaccacgcccggctaatttttttgtatttttgtagagacggaggttcgccatgttggccaggctgttcacgaactcctgacctcaggcgatctgcccatcttggcctcccaaagtgctggcattacaggcatgagccaccttgcccggcctgtaaa

SEQ ID NO: 68116 - DNA, 601 bp, Human
ctacccaaatagttcattgatcattaggattcacgcttgtataatggctaaatttaagccttaattggttgttggaaaacactgattaaatgcctaaatacaacttactctgttacttaagtgatttaaaaaaaaaaacaacttaaaaaaaaattataaattgacttagtgtttctgcctcagaagcataacatattagtataaaatgatcactttattctttatcaaatggcattatatgagctttatgtttcacgacagttttcactgtattatctcagacaaaatctcaagcagtccctttttttttttttttttttttttttgagacagggttaaactctgtcacccaggctatgtggcactatatcggctcactgcaacctccaccacccagagcgatcctcccaccttgacccaagtagctgggactacaggcgtacaccaccactcccggcgaatttttgtgtttatagtagagatggggtttccccttgctgcccaggctggtcttgaactcctgagctcaagcaatccacctgcctcagcctcctgaagtcctgggattacaaatgtgagccactacacccggccaaaatct

SEQ ID NO: 68117 - DNA, 601 bp, Human
ccaagtagctgggactacaggcgtacaccaccactcccggcgaatttttgtgtttatagtagagatggggtttccccttgctgcccaggctggtcttgaactcctgagctcaagcaatccacctgcctcagcctcctgaagtcctgggattacaaatgtgagccactacacccggccaaaatctcaaccagtcttaattactgaatttgaagtctgttgctaagtaaaatttacttcgtagcaggtctttctgggcacattacatttagtaacttgttcatattatctatagattttagcrttcgggtagttcaaattccacctttttataaatgagaaaaacaaagttcatacagactgttatttgttctcagttctctgatggttagtgacatagctatgataagaactcatacctcctaatgtctcaaaacatttatctgctaaattaaacttcactcccaaataataattaggtttgtgtgtaaatgattaattaaaaatcagagcatggagcttctgagctggttctaatatttaggatatttaagaattatttttaaggggccgggcattgtggcttacgcctgtaatcccagca

SEQ ID NO: 68118 - DNA, 601 bp, Human
gagtgtaagtgtaaaatattaagatgtatttaagaaaataattctcaaggcttcgttgcatagagaagagggtaagggcttgggaatcttaaattaatggtcttttaccatcatacttaccgatgtgttccttgatacacacaattgtggacttatttttaaagtttacacactgttagcatttaatcttaggtcctatatctacagataggtatgaggctacatatctgccattgttagtcccaagaatgctctaaagcagggctgtccaatgttttggcttccctgggccactttggargaagaataattgtcttgggccacacaaaaattcgctaacacaaacaatatagctaatgaactttaaagaaaaatagcaaaaaaatctcataatatttttaaaaactttacgattttgttttgggctgcattcaaagccatcctgggccgcatgtggcctgcgggttgcacaagcttgcactaaaggtcaaatggtatatgtatgacagcactttgaataatacacaagacttcacagatacaactcattaaattattaatcaactacctgttgaatgaattaacgtattttgcgttcttg

SEQ ID NO: 68119 - DNA, 601 bp, Human
tagccacatttatttctcagatgtaattttttgttccttttttctggtacacaaaacactcattcttttttgtttaacttttatgttaggttcaggggttccactgcaggtttgttatataggtaaactcacgtcacaagggtttgctatacagattattttgtcactctggtactaagcgtagtatgcaatagttatttttttcttttttcttttttctttttcttttcttttcttttttttttttttgagacagggtctcactctgtggcccaggctgggcacaaccttggcttactayaacctctgcgtctcgggttcaagctgtgtttccaccttagcctcctgagtagctgagatcacagacatgcaccaccacacccggctaatttttgtatttttagtagagacagggtttcaccatgttgaccaggatggcctcgagcccctgatctcaagtgatctgtctgcctcagcctcccaaagtgttaggattacaggcgttagccaacgtgcccagccagtagttatttttttctgatcttttccctcctcccacgtttcaccatcaaataggccccagcgtctgcaaaatatttta

SEQ ID NO: 68120 - DNA, 601 bp, Human
caggttttagagttaatcccaaagatcattaataagtctggacaatatagcaagaccccatctctgcaaaaagtttaaaaatttagctgggcatggtggcacctgtagtcttagatactcagtgggctaaggcaggaggtttgcctgagcccacgagtttgaggctgcagtaagctgtgttcacatgactgcactccagcctaggtgacagagtctcagaaaaaaaaaaaatggtagtagatagtacagatgaagtataaaactatctatattctaaaagacatctgactaaatttttgaraagtttttttcctttcctttccttttcctctcctctccctctgctctcctttcctttcctcctgtcccatcccgtttcgttctcgttgcccaggctggagtgcaatggcatgatcttggctcactgcaacctccacctcccaagttcaagctattctcctgcctcagcctcccaagtagctgggattacgggcatgtggcaccacgcctggctaatttttttgtatttttagtagagacggggtttcaccatgttggccaggctgatcttgaactcctgacctcaggtgatccacctgcc

SEQ ID NO: 68121 - DNA, 601 bp, Human
atttaaatttgtcagaaatagactcttactactatatgttggtagaaattttactcagtttttcaaagatagaattgaaagatagaatttaaaaatcgcaaatgtaaatcacagtaataataaggaaatttaacttcctaaaataaaatcccatctataaattaaacagaagataaaattaagcaagtaagaatagtgccatttctggggatttctgtgtgaatgcctttggcatttagaatatacttatctaggtgttctttgagttatcttttaaaggcagaaatttctctgttgtcartactttttaaatcttttcgcctggttacttatttagcatttgccttctgagtatattgtatcatatgtgtcttgtggtctctggacaggattaattttccaagtgtctgaccacaattgtacactcttttctgctataaatttgttttctcttttctctcctcccctcctctcttcttttcttttctttttgatggagtcttgctctgtcgcccaggctggagtgcagtggcgggatctcagttcactgcaacctctgcctcctgggttcaagcaattgtcctgcctcagcctcccaagt

SEQ ID NO: 68122 - DNA, 601 bp, Human
gattacaggcgtgagccaccacaccgggccataaatttcatatatttcaacacgtcatatcaaatcatgagcttgatttttccctgctaatattgtagagttgattaaattgcctttttttttttgtttgagatggaggcttgctctgtcgcccaggctggagtgcagtggcgcgaccttggctcactgcaagctccacctcccgggttcacgccattctcttgcctcagcctcccaaattgagttttatggatagaaaaacattgcagtgtctgtatatttatttcattaaatgtatttrtaataatattctaaatattaatttaaatgtatttatagaataaattatttaaatgtatttataatacattttacttctttgtaatgtcatttactgtgtcttttaaatttgactgtaaacactgcttgttctcctgtttactttttctcaaggtaatacacaaacatttttacttgaaaagagttgagataatggcccaatgtgaggagtggattgcggatatccagcagtacagcagtgataagcgggtaggcaggactatgtctcaccatgcagcagctctcaaggtgagtaagcctc

SEQ ID NO: 68123 - DNA, 601 bp, Human
agatacatttttttttggtagtagattgacagttcctaaaataaaaagtgggtccaaggactgagacaacagagttttgtaaagttccttgaagataatgatgacaagatgtgctccatgaatgccttttcctttttctttttttcttttgagactggatttcattctgttgtcccagcctagagtgcagtggtggcatcatgactctctgtaaccttgaactcctgggctcaagcagtcctcccacctcagcttcccatgtagctaggactacaggtagctgccacagtgcccagttaartttttttattttcaattttgtagagatggggtctcaccctgtttcctaggctaggctcaagtgatcctcccacctcagccacccaaatcactggaattataggcatgagcaaccgtgccagacttgaaggacttcttttattcccttagtctttccctaggcctcctgccttccagaattttattacttggagtgatgagggagatttgagttgcagattctccctcagctgatggtggcagtggctgtgttaggggagaaagcagttgttttcagtttggacgttcatagaatggaaat

SEQ ID NO: 68124 - DNA, 601 bp, Human
acttacacaaaactggctcaagtccagcttcttttcattcagtgtcttgcttatatccgcattcctttatttcttctgtgtcactgtcacctggaattttccatctctgaattaatccaaatttatatcattttaactgtacatttgctgttgagtgctacacaagaaaaatacacaattggccaggcgcagtgactcacgcctataatcccaacactttgggaggccaaggcgggcagatcacttgtggtcaggagttcaagaccagcctggccaacatggtgaaaccccaactctattaaaaaaaaatacaaaaattagtcaagtgtggtggctcatgcctgtagtcccagctgctggggaggctgaggcaggaaaatcgcctgaacccgggaggtggaggttgcagtgagctgagattgcgccattgctctccagcctgggcaacgagtgtaaaattctgtcttaaaaaataaatgaaaagtatgtagttgtttagcttgactccacaataaaatcatagtatccctgtattaggctgttctttctttgctataaagaaatccttgagactgggtaatttataacaaaaagacattca

SEQ ID NO: 68125 - DNA, 601 bp, Human
cagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggtaagactttgctgtctttcctggagatggggggaagagcaatggcaaggccaaaggttaacagggttgtgaggaaagkagtaggcgtctacggggagtatgcagccttcacctcaaaaatcttctagttggcggaatttaaggggttcaggaagcatgtgttagtcttccaatatctgatggcaaattcatggcaaatgccatactaagtaaagaccatctggtgggactgggtcattagatgtgcaaaggttgagcaccctctggtcctagagtttaagtaagtggtcagcctctactggacttcaggctaaaagcaaacatcccaagcgggagttaagctgcgttcttaaaacaaggtaggaactcacagaggaac

SEQ ID NO: 68126 - DNA, 601 bp, Human
cttttttgagcggaaggctgtgattcgttctttgtgctccttgagaaaaatgctaattatccatcagtttaaagacttgtaattcttcttatagagaaaaaaaaagtcccaagaaataaaacctggtggtaatgtttctcttcatactgttactcggaggcttgcaataattcagttagtgtgtggtttgcgatgtagaatttgcagtttttttcaattgaagcatgttcaggttttgggttttttgttgtcgtttgtatcactgcccttgatccccaaaagagatttagaaaaaggctayagaattatactaatcttgcattttaaagcaatgtataggaacattcatatgtccatgtaagcagtcttttccaacaagttgcagtgcaattaatggaaagaattcaggaggtcaggtgcctataggatcttttcaggtgaactcaagctacttaaactcattaatttgaaaggaggcatttgaaggattacacatttaatttgagtaaatggtttgatagactgatgcacatgaatgcttctaggaggtgttctgtttcaacatccagtaattaaaaaaaaaacccacacgcacacagtt

SEQ ID NO: 68127 - DNA, 601 bp, Human
gttgcatttctttgttacatttaatatagctggtgcagaatttagattaaatataggaacctgctggaaaaccaattgcttctggatcagtagctgtggatgtgcttttttctcctcagataggttgctgatatttacttgcaggtacaaatgtatatacctttcagccacactctcagaaacgtacctctccttgcccaaaagcagtttagaaaacacagccaggtagcgtttcatattgcatgtattttgcttgaagtaataatgcagttgaaaataagcccacctattggtcattgamgttactgaaagatgctaagcattgatagtaaactaaaaatacgatttgccctccatctcttaatgccagcaaggagagctggagctcagcgggcaaacaggaataaaactacatggtgttgttcaaacaggagcaaagcacctttaaagtgcagtggtttggtgggatttcttcccatcttttccgttttccctgtataaggaacctcttgatgtttgtgattgattgcattgcccaaatgctgaaatattaacgaccttcttggactgaggacccaaagaaaggaaactgaaaccgatt

SEQ ID NO: 68128 - DNA, 601 bp, Human
tagattaaatataggaacctgctggaaaaccaattgcttctggatcagtagctgtggatgtgcttttttctcctcagataggttgctgatatttacttgcaggtacaaatgtatatacctttcagccacactctcagaaacgtacctctccttgcccaaaagcagtttagaaaacacagccaggtagcgtttcatattgcatgtattttgcttgaagtaataatgcagttgaaaataagcccacctattggtcattgacgttactgaaagatgctaagcattgatagtaaactaaaaataygatttgccctccatctcttaatgccagcaaggagagctggagctcagcgggcaaacaggaataaaactacatggtgttgttcaaacaggagcaaagcacctttaaagtgcagtggtttggtgggatttcttcccatcttttccgttttccctgtataaggaacctcttgatgtttgtgattgattgcattgcccaaatgctgaaatattaacgaccttcttggactgaggacccaaagaaaggaaactgaaaccgattctgtcatcacaattaaagactcccctggctttaattagcctg

SEQ ID NO: 68129 - DNA, 601 bp, Human
aattgtttgaatttggtatcccttttgggggttggaatagcactactgccgtccataaatgctttcctcagggccatgcccattctctggctaccttccccttctgagaactcccctgcggcagtggtactgcaggtgagacaccgggaggtcctcatcagtgttcctgaagtgtccagcattaggagacagcagcccagaggccccccaagctcccacatggtgtggtcctgcagctagaggtcctgacagtgtattatttcagctttctttctgtaactgttctgattctgcaagaacrtgtcaatgtgtcgtggatctcagactaattagttttgaaatggagttttgattgaactcttcaaatcgatgctgctgcaaaatttgtttctcgggcttcctattaaaagccatcttaaggggcagttttactactctccctgtcgttcagtcaatacatttaataacaacttacaggctattttcaataaagtggcgacagcaaattagtagtttgaacatgacaagcctcttctgcaagaccagattctgaaaactcaaagcaattatttttatatagaggcatgctgcaatcattcag

SEQ ID NO: 68130 - DNA, 601 bp, Human
atttttcccagattatgtaaatcactcagaaaatctgaggcttgagcctaagaattcagcctgtcaaatgcattccaaagggatgcccagagtctgggggtgtttttctttctttttctttggtttaggattattcactggtgtcaaccgttattctttgtttcaggttatttggaaatagcggtgcttgcagcgcttgcggacagtcgattcctgcgagtgaactcgtcatgagggcgcaaggcaatgtgtatcatcttaaggtagtatttgcatctctcttttttttttaaaaaaaaaatcatacctttcctacctacatgggggcaaagcatttctccttggtatgaactgttttctcaagctgcagacacttgaaggaatgattgaaattgtagcatggcagtgatggttacacatccacatgcacagaccacgcttcccctatgccacagacagaagtacacatgtatttggatttgtccccatttagcctggtccagttgatagcaatttggcttactgttttctggagatctgtcaaaggaagaaaaaacgctaaaccctaagtgtctctgtacttgacagatacctgcttaat

SEQ ID NO: 68131 - DNA, 601 bp, Human
aatagtgccattagaaattatgtatcttgattcttgatccacaacttgaaaatccttgtaccagaattaaaaattaggaaattatacaagtatacaaatcatgtagtattagaagatattccagagggaaaattggtgatcaacagttgtccagcacccccagtactggatagttttagatctattttaatctccttaataagtcctatagctatgcaagtgagtgcattttgataactgctgtgcctaatttgtaacaattactgtcaaccttcagttaagagactgttcattccacacyggcccagaaaagagtgaaatgtatgactcgtgtgcataattttattcacatcatatttcatactgattatgtattgatgacattgattcatttactctttacagcgccacttgcatggatattaaatcttattgaccacagatgaattttaatttcagattggtgatagatttttccatcagctctgatagtatgtttgactttttcatcattaacccaggcaatcacacagcactgagttattgcattgaaacaaaaagtgcacacttcacttggtaattctttatggatttacaatag

SEQ ID NO: 68132 - DNA, 601 bp, Human
tgcagggcagagttgagaacaatgaatgagcaacataaatatttggagatacctattcagaatagaggtaaagctgtttgtagttacacttggtagcaaaaaagaaaaaatatgctagaaataaaatggtagaccttctctccactccttctgatgtaaaagcttaatttttccccgagttagagcttcactttgttgctggttttataccatttctttctctgacttagcaaagtactatacaaaaaaatgattgttgcagttcaccagcatgcatggtgagaatgaaaggatgtagagrtgagatggaaaatgttgctagattgtgaagcactgaatacaggcaatagcagtgttaggtagggaccaagtataaagcacacctaagaaatatgagcaggatttcataccatcttttatagtataagatggcataaatttagaggtgttagggaggagaactgcagaaaaaccaggtttacctgttgatgagattacatgtcttatgcctttcattgaaatctgttttccacaccttttccaggatggcagtggtagggtattcattttggaacactatattttaggcaatgaataagaa

SEQ ID NO: 68133 - DNA, 601 bp, Human
agatgagatggaaaatgttgctagattgtgaagcactgaatacaggcaatagcagtgttaggtagggaccaagtataaagcacacctaagaaatatgagcaggatttcataccatcttttatagtataagatggcataaatttagaggtgttagggaggagaactgcagaaaaaccaggtttacctgttgatgagattacatgtcttatgcctttcattgaaatctgttttccacaccttttccaggatggcagtggtagggtattcattttggaacactatattttaggcaatgaataasaacctattagtgtatgttttcttaatgttggaggccaaaaaagagacaggtggccttcaaaaattaatagctcttaaaaggcataaggaaatacaacttatggaaatgttcttgtcagacattggtgagaagctgtgttttgggggtgctgttaattaagaacatttccctgttggcgtaagtgtctcacatttttgcccttggtgcccagctcaccatgagcacggtcaattcacaaggtagtttttataaataaaggttttgggcaagctgaacgtggtccagagagatattaatgag

SEQ ID NO: 68134 - DNA, 601 bp, Human
tgttccagagatgtttgttttttgacttaaaagttattttgctttattttaatatagttatcttttagctactcaaagattgtagatgggaattaggagaaaaaaatagcatgcctgcatttctttttgtgtgttggacagttaattttttttaaaaaaaagactaaatcaagaaattctgaagagttgatgtcaaaattaagtattgcaactgcatctaaatttcttgtttaaatatactttttaagaaatctctttataagtttggtttcttgtgcagtcagacgtaagcttgaaaackttggtataatggttgatatttcctccacaaaaatagagactttaacaatgtatatcaatgcagtgttgcacatttagaatcctttggtaatgcaaagctgaatttcatataattgaaaatgttgctatgtaatattttaattacagttagccttttataagcagatcttacagcataccacatttgctaaatgaatggaatttactattttattaatagtaaataatttacatgagcttttaaaatgaagatgatgtgaggcaagtcagaaatactttacattgcctggtcttgaaccat

SEQ ID NO: 68135 - DNA, 601 bp, Human
gactacaaataacattttaaaaattatttgctatatatcagacattgtacttagtgtcctatacaccttatttgatcttcacaacaatccaataaggtaggtgttatttccatgttgtggatcaggaaacaagttcaagaatgttaaggaaattgctcatggttacattgtgtgtctgagtttgaacccaggtctgtatgtttcccactacactattctttttttttttctggagacggagtctcgcactgtcacccaggctagagtgcagtggtgtgatctctgctcactgcaatctccrcctcccaggttcaagcgattctcctgcctcagcctcccaagtagctgggattacaggcacctgccaccacacccggctaattttttgtatttttagtagagacggggtttcattatgttggccaggctggtcttgaactcctgacctcgtgattcgcttgcctcggcctcccaaagtgctgggattacaggtgtgagccaccatgcccggcgccactacaccattatttaaattgccacagttctggggaactataaatgttttgcatctaatgttatagttgtatgaactttctacaaa

SEQ ID NO: 68136 - DNA, 601 bp, Human
ctcagcctcccaagtagctgggattacaggcacctgccaccacacccggctaattttttgtatttttagtagagacggggtttcattatgttggccaggctggtcttgaactcctgacctcgtgattcgcttgcctcggcctcccaaagtgctgggattacaggtgtgagccaccatgcccggcgccactacaccattatttaaattgccacagttctggggaactataaatgttttgcatctaatgttatagttgtatgaactttctacaaattggccaaaaacgtaattaaccaacattaactttacactacttgttagctccgtctgtaacaaggaaaaatgatttctacattccacttggtagtctataatttagcagtgttttattattgtagatacagtctaatatttcacaaagaataatagtacaaataatctttttacagggtttcttcattaagaattactgtttctaatgaaaggtgtcacatgcttgcccaaaacttcccaaaagatttaacattactctgtagactgtgctttgctttaaaattttatactcacatgtaacctagctctgtgtttgacacttagtagg

SEQ ID NO: 68137 - DNA, 601 bp, Human
cagaattttcattgaacaaattttatgcaacttttggatttttaaaaaatttgttaaacatcaggcacactgcattggattaatcacctatctgtctgtcaatcattttaataagtactcatggaccaccactccccctctctcaaaacaagctaggaactttaacctacgtatagttttcctctattctatccgtctatttccaccttcttgtcatctaggtcatcatttttgagtcctgtgttcattctcttccttatatagtagtccctccttatccacggtttcagttacccatggwcaactgtggtccaaaaataggtgagtacagtatagtactataagatatttataagtactaagatactttgagagaaaccacactcataactgtaattacagtatagttataattgttctattttattattagttattgttaattgcttactgtgcctaatttataaattaaactttagcataagtatgtatgttaaaggaaaagtgtaaatagagtttagtactgttcgtggttttaggcatttactgaaggtctctcggtggataaaaggagactactgtgtatagtttagttggacat

SEQ ID NO: 68138 - DNA, 601 bp, Human
gtacatttggtatagaaagggtaaagttatattaatagtttatggcctggggatttgtaaactatccaaatgaacagccataggaagttgtataaaatattgtattgcttcacacatgctaggcacccaaatgctaggttgatttagttaatgagtaaattcagaagcaaagaaatagcaaaaattatacatacacttcatcagttgcttattttccaattccatacctctctgttgcaaactacttattattagtcattaataatattttattcttttgtttaaagggcagtatattccrtaagattatgtgagtcagttatttaggtattttcatagcttgccattaaaatgctggagttgatcagatttaatactggatataaagcaaaatattaatcttctgaacagtttactagttcagaagtttacaaactcggaatcctaaatacagtttttgtcattgctgtgcatcttttgataaaaaaaattcttaagtcaaatttgtccattgtttatcatacagtaagtcctcacttaatgtcattgacgggttcttggaaactgactttaagcaaaataacttataatgaaaccagtt

SEQ ID NO: 68139 - DNA, 601 bp, Human
taggcacccaaatgctaggttgatttagttaatgagtaaattcagaagcaaagaaatagcaaaaattatacatacacttcatcagttgcttattttccaattccatacctctctgttgcaaactacttattattagtcattaataatattttattcttttgtttaaagggcagtatattccgtaagattatgtgagtcagttatttaggtattttcatagcttgccattaaaatgctggagttgatcagatttaatactggatataaagcaaaatattaatcttctgaacagtttactagytcagaagtttacaaactcggaatcctaaatacagtttttgtcattgctgtgcatcttttgataaaaaaaattcttaagtcaaatttgtccattgtttatcatacagtaagtcctcacttaatgtcattgacgggttcttggaaactgactttaagcaaaataacttataatgaaaccagtttcttttttctcatcagtgttctaaggaaatgatattataaacaatgaaacattagccagaagtggtgatgcacacctgtagtcccagctactttggaggtggaggtgagagaatgactt

SEQ ID NO: 68140 - DNA, 601 bp, Human
acttcatattttaaagcagttttaggtccacagcaaaatcgagaggaaggtctagagatttctcaaataactgcgtccctacatatgtacatatgcattatcgacatcctccacaagagtacatttgttgcagttgatgaacctatattgacacatcatcatcatccagagcccagagtgcacacatcttggtgttgtgcattctatgggtttgtacaaatgtataatgacatgtatccagcattatagtatacagaatagtgtccctgcactaagcttattctctgtgttctacctattyatccttccctctcctccatcccctggcaaccactgatctttttacagtttccatagttgtgcgtttgggaaaatctcatgcggttggaatcatacagtgtgtagccattttacatgggtttctttcacttagaaataagcatttaattttcctccatgtcttttcatagcttgatagcttatttctttttagtactgaataatatcccattgtctgtatgtaccttagtttattcattcacctactgaaggacatcttggttgcttctgttttggcagttatgaataaaatgctatagac

SEQ ID NO: 68141 - DNA, 601 bp, Human
gtacatttgttgcagttgatgaacctatattgacacatcatcatcatccagagcccagagtgcacacatcttggtgttgtgcattctatgggtttgtacaaatgtataatgacatgtatccagcattatagtatacagaatagtgtccctgcactaagcttattctctgtgttctacctattcatccttccctctcctccatcccctggcaaccactgatctttttacagtttccatagttgtgcgtttgggaaaatctcatgcggttggaatcatacagtgtgtagccattttacatggrtttctttcacttagaaataagcatttaattttcctccatgtcttttcatagcttgatagcttatttctttttagtactgaataatatcccattgtctgtatgtaccttagtttattcattcacctactgaaggacatcttggttgcttctgttttggcagttatgaataaaatgctatagacatcctatgcaagtttttgtgtggatgcaacttttcaactcctttggttaaataccagggtgtccaattgtatggtaagaatatatttagatttgtaagaaactcccaaactgccctcc

SEQ ID NO: 68142 - DNA, 601 bp, Human
tatttgactgttgcttcagtctcttcagttgtttcttctacttctgtatcttgagttcattcattactttgccattgtttaagtgtgggccttcattatcatttggatgattataatatcttgatattttacctccacctcttttgccttgttctgctgttatttaaactatgtacaattgctagattcagaatttgtccttagcattcagtgactccttaatgcctgtgggatatagtcctaattccttagctaggcaatccaagctgtcattgttgtagccccaaaatgcttttcattyttaagtcttactcatgtaagcagcttattttttcaggcatactatgattagtgatttttcctcacctgtatttttactacattctgtcagctggaatacttcaaggccaaattcaaattttgcatatttatttttttccttattttcccctactcatgttcagtctctcctcaaaacttaagaatattttctatctcatgacatttattatatattgcattgtactgtagttgtttgtatcctacttcattttctcttctaggcttaatgcttaaaatctttgaaggaaaggactatatt

SEQ ID NO: 68143 - DNA, 601 bp, Human
ggtttatatttctattatattctttccttccttccttctttcctgtttctctctttctttttctccctgacccctcttctgcatagttcctacaacatctttcttaaacgctttatgaacatagttggatcacctggactgttttctatgtctttaaacttaccttcgtatttcctatttctttaaattttctctgttttgggagattgcctttatttttctttcggctcactaacttcagatgtatatatttcattgtgcagcccattcactgcctttttgcaaatgtatttttaattayataagtatcttgttttttttgcgtataggctagaattatttaatgtaattttaattttttccccttttttaaaaatttccaactttcaagttctggggtgcgtgtgcaagatgtgcaggtttgttacataggtaaacatgtgccatggtggtttgctgcgcagatcatcccatcacctgggtattaagcccagcatccattagctattcttcctgatgctctccctgctgtcatcccccaccctccagtaggccccattgtgtggtgtttccctcgatgagtccatgtgttctcatcatt

SEQ ID NO: 68144 - DNA, 601 bp, Human
ttgctctacattcttaccaatacttggtacagttaatagttttaattttagctattctagtagatttatagcgacatcatactggttttaatttgcatatttgcatttattgaatgatgttgaaccatcttttcatgatcgtatctgctatctgtatatcctctttggtgaagtatctattcaaatcttttgtctatttttaaaaattgagttattttcttattgaatgttgagagtctttatatattctgaatttaatacctttatcagatgtgtgagttgcaaatattttcaattctgkagcttatcttttcttttcttttctttttttttttaaacagtatctttccaggagcagaagttcttaattctgatggatccagtttatcaacatttttcttttgcacactgtgtttttggtttggtatccaagataaagctattctcctgttttcttctagaattttagttttaggttttacatttagttttatgatccattgtgaggtaatttttgtttatggtgccaggtgttgatcaaagttcatatttttcatatggacatatttgtttcagcaacatttatttaaaaaatatattc

SEQ ID NO: 68145 - DNA, 601 bp, Human
tatctttccaggagcagaagttcttaattctgatggatccagtttatcaacatttttcttttgcacactgtgtttttggtttggtatccaagataaagctattctcctgttttcttctagaattttagttttaggttttacatttagttttatgatccattgtgaggtaatttttgtttatggtgccaggtgttgatcaaagttcatatttttcatatggacatatttgtttcagcaacatttatttaaaaaatatattcttggctgggcacggtggtgcacacctgtaatcccagcactytgggaggccgaggcaggcagatcacgaggtcaggagatcgagaccatcctgctaacacagtgaaaccccgtctctactaaaaatacaaaaaaaaaaattagccggttgtggtggcaggcattgtagtcccagctacttgagaggctgaggcaggagaatggcgtgaacctgggaggcagagcttgcagtgagccgagattgtgcccctgcactccagcctgggtgacagagtgagactcggtctgcaaaaatatatatatatatattctttctccactgaattgcctttatatctttgtc

SEQ ID NO: 68146 - DNA, 601 bp, Human
tattaactggttctctataggtttttgttgtctaacccttgctcataatgaaataagtcattttataaactttattccatttagtagtaaagtataagatatttcaaagtcttgtgactatttgtgtttcttcggggtactgcttatatccatggaaaaaaaatgtttctttgttttggaatatatgacttgatgatacaataagtcatacttcaacattactaatcctaaattgtgattaaaatgtagtttagttttattatattcaacataatgtagtgcctcattgatgagaaatgawgtgtatttcgcaaataaattaatcttaggccttcaaacacataaaacttttttttttttttttttttttaaagtagagatggggtttcaccatattggccaggatgatcttgaactcctgatctcaggtaatctacctgtctcggcctcccacagtgctggcattgcaggcgtgagccaccatgcccggcccctaaaacactgatttttaacattgtttttggagattacatttatgtaatatatgtcacattttgctgcctgatttacagaatataggcagataattttacttgttctt

SEQ ID NO: 68147 - DNA, 601 bp, Human
tcttttttttttcttttctcccagttgtattttgacattgagcagctgtctttccattcattcagcaagtattcactgagctcctgctatattcaaagcattattctggggcctgtttatataataataatcaattttttttttttgagacagagttttgttctgccacccaggatggagtacagtggcgtgatcttggctcactgcaacctccgcttcccgggtacaagtgattctcctgcctcagcctcccgagtagctgggattacaggtgcacaccatcatacaccgctaatttttwatttttttagtagagatggggtttcaccatgttggccaggctggtttcaaattcctgacctctagtaatccacctgccttagcctcccaaactgctgggattacagtgagccactgcacccggcccatcaaaatatttaagagtaatcaaatacactttcttctctcatgaaccttaaaatatggcaggggaagatagacattaagtgatgaagcaaagatactgagactctctggggcgagaggatcacacgttgagaactgctgaattgggataatgaagggaaggaagcatacaatc

SEQ ID NO: 68148 - DNA, 601 bp, Human
ttcaaagctggagggataaaatgatgcttggggaatggcagtcaaaatttcaggaggaaggaactgtattttatgtaattttcttatattgtcctctacagttctaatataaacatatatgattggatcataaattatacttagtatgtgtatgtgagtgtatgtatacatgtatatatattgaactggcaagagaaatagaaacattatttttaatgtgggaaaattatttttaacttacttttttccctctaagccttcataatctagtgctaaggtgaataaactttagtgatacatyattggtttaaaaaattatttttgttttacatatgatattttaggaatatattatgggcttaaaagtcacaactgttttccaatatgatctgaatacatttttaaagcaagttatattaaatatgtttctgtaaactgagagctaagccaccaacttatggaaagagtagcttgctctttatatcaccactgactagaataggatggcgcatataataggtatttaattaatttttgctaaatgagataattttttagaaaaaaaacctgtattctaagtataggatagatgatgtatcaa

SEQ ID NO: 68149 - DNA, 601 bp, Human
ttcataatctagtgctaaggtgaataaactttagtgatacattattggtttaaaaaattatttttgttttacatatgatattttaggaatatattatgggcttaaaagtcacaactgttttccaatatgatctgaatacatttttaaagcaagttatattaaatatgtttctgtaaactgagagctaagccaccaacttatggaaagagtagcttgctctttatatcaccactgactagaataggatggcgcatataataggtatttaattaatttttgctaaatgagataattttttagraaaaaaacctgtattctaagtataggatagatgatgtatcaaaatacctatatgccaaaaactgaattgtaatttatatctgatcagactgttttaggccactggtaccccttcccaggtttgcttttatactacctatggtggaatatgacttctgtaggaggagtgtactttcaattatgattttgcatactactaaaatttcttcaagacagtgaagcatactgtattctgaattattaagaatgtaatgatgtatgtgattctttcagacagaaaatactcagggtgtgttataaa

SEQ ID NO: 68150 - DNA, 601 bp, Human
tacatatgatattttaggaatatattatgggcttaaaagtcacaactgttttccaatatgatctgaatacatttttaaagcaagttatattaaatatgtttctgtaaactgagagctaagccaccaacttatggaaagagtagcttgctctttatatcaccactgactagaataggatggcgcatataataggtatttaattaatttttgctaaatgagataattttttagaaaaaaaacctgtattctaagtataggatagatgatgtatcaaaatacctatatgccaaaaactgaattrtaatttatatctgatcagactgttttaggccactggtaccccttcccaggtttgcttttatactacctatggtggaatatgacttctgtaggaggagtgtactttcaattatgattttgcatactactaaaatttcttcaagacagtgaagcatactgtattctgaattattaagaatgtaatgatgtatgtgattctttcagacagaaaatactcagggtgtgttataaattattaaaaacattaacaatataccataaaatgtaaagtattttaaattaaggttgtaaatgagaatcc

SEQ ID NO: 68151 - DNA, 601 bp, Human
tgccatgttggtgtgctgcacccattaactcatcatttacattaggtatttctcctaatactatccctcccacctacccccaccccacaacaggcccagtgtgtgatgttccccaccctgtgtccaagtgttctcattgttcagttcccacctatgagtgagaacatgcaatgtttggttttctgtccttgcgatagtttgctcagaatgatggtttccagcttcatccatgtccctacaaaggaagtgaactcatccttttttatggctgtatagtattccatggtgtatatgtgccacrctttcttaatccagtctattgttgatggacatttgggttagttccaagtctttgctattgtgaatagtgctgcaataaacatacatgtgcatatgtctttatagtagcatgatttataatcctttgggtatatacccagttaatgggattgctgggtcaaatggtatttctagttctagatccttgaggaattgccactcttctcttccacaatggttgaactagtttacactcccaccaacagtgtaaaagtgttcctatttctccacatcctctccagcatctgttgtttccctactt

SEQ ID NO: 68152 - DNA, 601 bp, Human
acaatttagtttcatcttttcaacattcttatgtttcatcttttcaacattcttattcttactgtccattggccactttttggctatatttagtaataatgatgataatgttatctctcttgataattgcataagtgataagtaacagatactgtgactaagatatatataaatttaatcattttaataattctttgaggtaagaaaaatctgagattattgagtgtgtagtgtgccaaaattcacacaagtagtaagtgatagagctgggattttgaactaggagtcaaaatgttttttkttgttgttgttgttgttgtttttaagacaaggtctcactctgttgctcagggtggagtgcagtggcaccaatcacggcttactgcagcctcaacctctggggttcagctgatcctctcacctcagcctcccgagtagctgggactataggtgcacgctaatttttgcaatttttgtagagacgaggtttcaccatgttgcccaggctggtcttgaactcctgggctcaagcaatcctcctgccttgcctcccaaagccttaggattacaggtgtgagccaccgcgcctgaccaaaacttg

SEQ ID NO: 68153 - DNA, 601 bp, Human
ttcaacattcttatgtttcatcttttcaacattcttattcttactgtccattggccactttttggctatatttagtaataatgatgataatgttatctctcttgataattgcataagtgataagtaacagatactgtgactaagatatatataaatttaatcattttaataattctttgaggtaagaaaaatctgagattattgagtgtgtagtgtgccaaaattcacacaagtagtaagtgatagagctgggattttgaactaggagtcaaaatgttttttgttgttgttgttgttgttttttttaagacaaggtctcactctgttgctcagggtggagtgcagtggcaccaatcacggcttactgcagcctcaacctctggggttcagctgatcctctcacctcagcctcccgagtagctgggactataggtgcacgctaatttttgcaatttttgtagagacgaggtttcaccatgttgcccaggctggtcttgaactcctgggctcaagcaatcctcctgccttgcctcccaaagccttaggattacaggtgtgagccaccgcgcctgaccaaaacttgttcttaattgttctgata

SEQ ID NO: 68154 - DNA, 601 bp, Human
ggctatatttagtaataatgatgataatgttatctctcttgataattgcataagtgataagtaacagatactgtgactaagatatatataaatttaatcattttaataattctttgaggtaagaaaaatctgagattattgagtgtgtagtgtgccaaaattcacacaagtagtaagtgatagagctgggattttgaactaggagtcaaaatgttttttgttgttgttgttgttgttgtttttaagacaaggtctcactctgttgctcagggtggagtgcagtggcaccaatcacggcttrctgcagcctcaacctctggggttcagctgatcctctcacctcagcctcccgagtagctgggactataggtgcacgctaatttttgcaatttttgtagagacgaggtttcaccatgttgcccaggctggtcttgaactcctgggctcaagcaatcctcctgccttgcctcccaaagccttaggattacaggtgtgagccaccgcgcctgaccaaaacttgttcttaattgttctgatatactcgtaggcttcatgatttcttaagagttgtttagatttctgttgcactgagtctctgcct

SEQ ID NO: 68155 - DNA, 601 bp, Human
caactccatatacatgcaacagattaaggaacagtactagacgaaagttgatagaattgatcagtggcatggtgatcagatgctctagagtcattggtaggctctagtacttgtctcatgataatgagccctcttgtttaaagtactcataaagtaaaattatttctgtttcaagcacataagattataagaatgtggaatgtgcagataagacagggaaattagtctgttaagtaatcattaagaggacaattattaataaagttcagattttactcactgtataatattcttttatgcytgaatatgtatgcgacctaatggaaaggaacaatgacttgtgactgaaagccctttccatattataaacatgaggtctgtctttatttctgattctacctgtttatgtttcccaatacatatgttttctttttgcctaaaacgttttctataactagacctttggaggcagggaggggtggagattggatttggatatgagggattgctatttctcccataaaatgtaaaaaattgccttaaaaatatcactttgagaggctaaggcaggagaatcgcttgagccaggagttcaagacca

SEQ ID NO: 68156 - DNA, 601 bp, Human
gctaattcttgtattttttagtagaggtgaggtttcactatgttggccagactggtcttgaactcctggtgtcaagtaatccagctgccttggcctcccaaagtgtaaatccaggtatcctttttatgttttcatttcaatgtacttttgcctcatttcaggtggcataatatttttagttatcaaaattctattttaagcagtattggtggagttttaaaatctaaaaggcatgtatttgtccattcattttaaaacacaggatactgagcatatacacccccttcttatataatatttygccttctcatctattttttctcttttggttctcataataatattgagacgtaggcattttttcaattttagagataaggagatactcaagtcactttaagttagagatgagattttagagataaggagatagagatttagagatttgagagagaaggagatactcaagtcacttgctttaagttaggtaactatttagttaagttagataactatttagttaaggaaagctcaaatcacttgctttaagttagataactatttacttaaggaaagctcaactcacttgctttaagttaaa

SEQ ID NO: 68157 - DNA, 601 bp, Human
ggttttaacttgcagttccctaatagctaatgatgttggcaatctttttatgtgcttgtttgccgttatatatcctctttggtgaagtatctgttcaagcctattttctaaattggttgtttcattactgttgagtatagttatttatatattccacatatgaatctcctgttacatatgtgatttgcaaatattttcttctattatggtatgcacttagcaccttttgaagagcaaaagttttacattttgataagtccaattgatcttttttgtttgtttgcttattttatggatcatrctattggtgtcctacgaactcttcacttaaccccaggttatgattttctcctacatttttttctaaaagataaaggggaaaacacagattttctcatggtttttacacttagatctatgactcatttgagcataccaattctatacatattttgttaggtttttatctatgttttaattttttagacagattgtaactggtattgtgtttttaactttgttgtctacacagtcattgttagtatatagaagaatgattatttttgtatatggctcttgtattctgtgattttgcgaactc

SEQ ID NO: 68158 - DNA, 601 bp, Human
atattgatggatttttgcatattgaaccagtcctatatacttggagtaaaccctactgtgttgtattgtataattctttttcttcggtactatattcaatttgagtatattttgttgaggattattacatctaaattcatgagagaaattagtttttgtgtgtatttcttctgtcagggtaacaccaacctcataagagcaattgggaagtatttcctctgattttctggagaatattgtataatataggactgtgcagattatgtatttcatattgggtgagttttggtggtttttttttgaagaattggttcatttcatctaagttattgattcatactctgtatgcttatgtttcttcacatttctttaggttttatgatgcaggctgtggtctatcatggtgagcattttgtgggtgcttgcaaagaatatgtattctgttcttgttaggtggaacatttctataaatgttgcttaagttccctttttgatggtagtgttctttctattcttcctggttttctattactacttctatctgtctgagaaagggatgttgaagtccccaactataattgtctatttttcaatttctcct

SEQ ID NO: 68159 - DNA, 601 bp, Human
tctatctgtctgagaaagggatgttgaagtccccaactataattgtctatttttcaatttctccttatcagtttttgcttcctgtgttttgaagctgtgttgtttccagaattgtattgttaatgtcatcttggtggatagacttttttatcatttttaatgacgctctttttttttttcattttcttttctttgaagtctgctttttcctggtattaatatggttactttttttattaatgtttatatggtatattctttcctatcctttttagcctacctgtgtcatgatacattgaamcagcattcctttaggtaacatatgggtttttgtttttgttttttaagagatggggtctcactgtattgcccagtctggtcttaaactcctgagctcaagcagtccttccaccttggcctcccaaaatgctgggattacaggcaggagccactgcacccggcccaaggccacatttttttaatccactgtaccaacctgtgttttaaatttttgtgtgtagaccatttgtatttaaagtgattattggtatgtgagggcttaagtttgctattttattgttttctgttcattcccatttcc

SEQ ID NO: 68160 - DNA, 601 bp, Human
atctgtctgagaaagggatgttgaagtccccaactataattgtctatttttcaatttctccttatcagtttttgcttcctgtgttttgaagctgtgttgtttccagaattgtattgttaatgtcatcttggtggatagacttttttatcatttttaatgacgctctttttttttttcattttcttttctttgaagtctgctttttcctggtattaatatggttactttttttattaatgtttatatggtatattctttcctatcctttttagcctacctgtgtcatgatacattgaaacarcattcctttaggtaacatatgggtttttgtttttgttttttaagagatggggtctcactgtattgcccagtctggtcttaaactcctgagctcaagcagtccttccaccttggcctcccaaaatgctgggattacaggcaggagccactgcacccggcccaaggccacatttttttaatccactgtaccaacctgtgttttaaatttttgtgtgtagaccatttgtatttaaagtgattattggtatgtgagggcttaagtttgctattttattgttttctgttcattcccatttccctt

SEQ ID NO: 68161 - DNA, 601 bp, Human
actacttttcttgatattttaacctaaattacaagcaggtttttcattctttgctgttatcaaaatttttaattgtggtttgcttatctaatgtctttcttctcactagacatacactcctgagtgtaagggttattttgtttttgtttttttaatggactttattcttgaacaggtttagatttacagaaaaatagataaccatataactactgtactttcgttgataaagttgtttcccatgggggcatgggttaacagttctgatcctgctatacgttttactggaattgaatgattyagtaaatggatggtagatggtaggagccaggtttctcactgttggagttgggatttacagataatcaacgggaggaggctagagtgatctgtgttttgatagattcaagttggagacgtcattatgaactcatatttagcttaatatagatcatgtctttttccccccacaagtctatagccaatgtccagtgatgttattaacatccccatctttttttttttttttttttagatggagtttcgctcttgtgcccaggctggagtgcaatgacacgatctcggctcaccacaatctctg

SEQ ID NO: 68162 - DNA, 601 bp, Human
catcaaaatcctggatttagttctctttgatgaaacttggtaatgtggttacttctggctgcaggagagcctggtgaaatgagaattttagctgtagacattgtttcatctaacaaaatgggaggttttcttttttattattgttttttaagtgaggataataggaggatgctattatgtaggcacccagcactatctgcttcagtaccaactatgtgccagaaactgtactgttgctatgaaagcatattttttcagtgggcatggccgttatgagacttaaaaataatatggtcaggcmgttataataattccatttcacagatgaggaaatcgaagctttagcatgattgcagtatcagaatttatacatggtcattctgatgccaaatgcttcattatttccataacacaacattctaactgagccttctgttcaaaacaaacaaacaaaaaacacaatatggcctacatttgtgtgaagcctttgctgctctttcaaattatatttggttttcatgtctgtcttctttaataaattgaataccagaaagaaagaaggatcaggtcatttttatctttatatttcattacctagaac

SEQ ID NO: 68163 - DNA, 601 bp, Human
ttttagctgtagacattgtttcatctaacaaaatgggaggttttcttttttattattgttttttaagtgaggataataggaggatgctattatgtaggcacccagcactatctgcttcagtaccaactatgtgccagaaactgtactgttgctatgaaagcatattttttcagtgggcatggccgttatgagacttaaaaataatatggtcaggcagttataataattccatttcacagatgaggaaatcgaagctttagcatgattgcagtatcagaatttatacatggtcattctgatrccaaatgcttcattatttccataacacaacattctaactgagccttctgttcaaaacaaacaaacaaaaaacacaatatggcctacatttgtgtgaagcctttgctgctctttcaaattatatttggttttcatgtctgtcttctttaataaattgaataccagaaagaaagaaggatcaggtcatttttatctttatatttcattacctagaactcaatgcatgttttgaataaagtttttttttaaaccttgtatgatagggaaaccgaaagatagataagcaaacaggtacagataa

SEQ ID NO: 68164 - DNA, 601 bp, Human
tttaataaattgaataccagaaagaaagaaggatcaggtcatttttatctttatatttcattacctagaactcaatgcatgttttgaataaagtttttttttaaaccttgtatgatagggaaaccgaaagatagataagcaaacaggtacagataagtaggataatacgcttgaattggatagccagtacactgggcttgtgtttgaactggtttcttgctttctagttgagagcactttccttttgaggcacagaatgttggattaggatgaaattagagaagaagaaatgtgttctgcyaatatccctggcttaaggcaggtaatatctattaatgcaaatcaatctggtcaagatgtagttcaaatatagataaacgggtatttcagagggcccctggaagaagatggtatggagtaaataaaaacgcaatttaccaggagtcagaaggactagtaagctgaacccagccaggtctctgacagctggttgcttagctgctttaagcatgctttccccaagactaaaatcaagaaagttagactaaatggtttttgaaattccttctagctaacatagtatatgaatcattgtatccag

SEQ ID NO: 68165 - DNA, 601 bp, Human
caggtcagactgttttatatttctgaaatgtagagagagtaacagctttttcactactctgggaactgggccagtgaggagtaaacatcctctcctgtctctccctaaatgaagtacttggtcacgagtgacagtccattttcattttgttctttgaatctggtcttgttcttatttcagtgtttttcttaactttactgtgagtttgttgaagtatattaaattgaaaatgtcagtttatgtttgagtctaaaaataagaatttcattattgtacaaagtaaaagtcattgtatttaccraatacatattatcacatttgtgtatttgaaatacttgactggcacatgaggtaatttaattacaatgtactgtgtagtctgtagtttggtcccttgtagtagaattgtgttgaatgaaagtggcaaggttaagtagcagatataatgtagtataagatatgattataagcttttacattttccacaattgaaataaagttaatattacttttggttcttttggtttcttttaaataatgtcttttccttattagacaaggttaaaaaaagaagtggagaaaattttattgtcaaaaaaat

SEQ ID NO: 68166 - DNA, 601 bp, Human
tgaaatcttgtcatttcagacaacgtgaatgtacctagaggacactaagccaggcacagaaagacaaataccacatgatctcattcataggtggaatctaaaaggttgttctcatagaggtagagagtagaatggtagttatgagaggacgagaggggagcagggaaaaacgggtagggaaggatgggttaatgggtacaaaaaagttgggaatatgtaacaagaaacataaaaatagttattctctttgatagacatttaggttgattccatatcttggctattgtgaataatgctgtartaaacataggagtgcagatatctgtaaaacatactgatttcattttctttggatatatatacccagtagtgggatttatcggatcatgtggtagttctgtttaaaattttttgagtagccttcatgctgttttccataatggctatacattcccaccaacagtgtataagggttcccttttatccataccctcatcaacacctgctatcttttgattttttgagagtacctattctaactagagtgatgtgatatctcattatagttttgacttgcattttttgatgattagtgatgttg

SEQ ID NO: 68167 - DNA, 601 bp, Human
acaatttgggggggtcaaggcaggaggatcacttgatgccatcagttcaagaccagcctgggcaatgtagcaagaccctgtctttacaaaagataaaaattagctaggcatagtggagcccacctgtagtcttagctacttgggaggctaaggtgggaggatcacttgagctcaatgtttcaaggttgctaatgagcaatgattgtaccactgcactccagcctgggtaacagagtgagaccctatctttaaaaaaaaaaaaaaaaaatttggagcgttttagagttttggatttagaatrctcaaactgtttttgcttttgttgcccatgcttttcaggttttgtccaaaatattcttgcctagaccagtgacatggagctttcccctatatttcctccatattttcttcttgtgattttgtagtttggggtcttacatttaagtctttaatccattttgagttgagttttgtctgtggtgagagataagaatctaatttcattctctcatgtggatatccagttttcccaacaccacttgttgcccttttcccattgagtgtacttggcccctttgtcaagaattaataaactgtagat

SEQ ID NO: 68168 - DNA, 601 bp, Human
caatttgggggggtcaaggcaggaggatcacttgatgccatcagttcaagaccagcctgggcaatgtagcaagaccctgtctttacaaaagataaaaattagctaggcatagtggagcccacctgtagtcttagctacttgggaggctaaggtgggaggatcacttgagctcaatgtttcaaggttgctaatgagcaatgattgtaccactgcactccagcctgggtaacagagtgagaccctatctttaaaaaaaaaaaaaaaaaatttggagcgttttagagttttggatttagaatgytcaaactgtttttgcttttgttgcccatgcttttcaggttttgtccaaaatattcttgcctagaccagtgacatggagctttcccctatatttcctccatattttcttcttgtgattttgtagtttggggtcttacatttaagtctttaatccattttgagttgagttttgtctgtggtgagagataagaatctaatttcattctctcatgtggatatccagttttcccaacaccacttgttgcccttttcccattgagtgtacttggcccctttgtcaagaattaataaactgtagata

SEQ ID NO: 68169 - DNA, 601 bp, Human
ttaaacattttaaatccaatggtattatagtaatggactttgaaacagtaaatgatatagaaatagctagaacataactttagttgttgtaaatatagattagctgtgcttaactgattggattttcattttaaggtgactgtactgtgtattgtcttagcttccatcaatagaacacaatttagaggtgttctcaagtaatgatgcttttgtactgagtcaaccaaattaccaattggagtacttagccttgaagtatacagttggccattcatatctgtggattcaacatctgcagatwcaaccaattgcagattgaaagtattaggggaaaaaaaaaataaaaaataatacaaataatacagcatagcaactatttacataccacttgtattgtgtattataaataactagagattaaagtatggggtgtgtatttagattatatgcaaataccacaccgttttatataagtgacttggtcatctttagattgtggtatatgtgggatcctggaaccaacctcccacacataccaaagaacaactgtataaatggagttctgaatatagttttcccaagccctagtacatttaattca

SEQ ID NO: 68170 - DNA, 601 bp, Human
ttaagtttaagccaaggcctcaagacattatcaatctctgtaactgtcaatttttttatttgcaaagaaaaagagtgtgagagtgtatagagtaatacacctatagcatggtagaaaatttagaagaacgtgtgtgattagctaataaataatagatgtaagtaattttaattttgattaagaaaatacataaatttggctaagaaccttaaatttttaccatctcaaaagttgcagaaaacactactgatatttagtgttcttgttaaaacttgtttttcgacatcactttcaacatctrggatttagggcttttattaggaggctctctgtgtagagatttcaaccttgtaagaataatcgaaactttaaaatgaaagaaataataggaaatccaccttctaattttagattgaaataatcccaaagatgcaaattagttttttcagaatcaccaatctagttaaaaagaacgcttcagctcttcatctagtattcttacacactctataattatgttataaatggaaataatgtattatgaaaatgctgttttttggtaatattatataaacttagaaatagcctgttccatggaact

SEQ ID NO: 68171 - DNA, 601 bp, Human
tttgtaaaataaatgtattcatttattcttaagagtagtaggaaatgaattttttattttctcatcatgcccatgatactctgagcttcttgttcatcttctaaatactttaaagatgatcatatgatttttgcccataagagtatccccataggagcagaaaaagcatttaagaaaattcaacattttttcgtgataaaaattctatgaacaaattaggtatagaagaaatgtttctcaacacaagaaggtctatatatgacaggcccacaactaacattgtacttaatggtgaaaagcygaaagcttttcttttaagatcaggaacaagatcaggatgctcactctcaacacttcttttcagcatagtactgttaagccctagctagagcacttaggcaagaaaaagaaataaaagatatacagataggaaaggaagaagtgaaattgtctgtttgtgaacaacacaatcttacatatatgtataaaattctaaagactccaccataaagctgttaggactaataaaggaattcagtcaagttgcaagatacaaaatcagcatacaaaagtcagtatcatttctatatactaactatat

SEQ ID NO: 68172 - DNA, 601 bp, Human
cattcacaaagaacgttagggtggttttccaatttttggcaattatcagtaaagctcctataaatattcacgtacagatttttgtgtgaataaagttttcagttcactttggtaaatactgaagagtagggttgctgagtcatgtggtaacatatgtttaacattataagaagatggctgggcacagtggctcatgtctaaaatctcagcactttgggaggtggaggtggggggatcgtttgagctcaggagtttgagaccagcctgagcaacatagtgaaacttcatctccacaaaaaaatttaaaaattagccaagtatggtggtgtgcacctgtaatcccagctacttgggaggctgaggtgggagtattacttgagcctgagagtttgaggctacattgagccatgatcatgccactccagcctgggcagcagagcaagacctggtctttaaaaagaaggaaataaactgccaaatatattctagagtagtgatatttttcattcccactatcagtgaatgagaattctagttgttccacattctctccagcacttggtattgttaatatattttattaaccagtctaacaagtatg

SEQ ID NO: 68173 - DNA, 601 bp, Human
tctgctactaatcccagctctaatttttttcccctatccctatgttttctttttttacctctctttttacctctctatacttaggcacgtgtgtgtgtgtagattagcagaatctaggtgatgggtatataggtgctcagtgtaaaattcaactttgcagtatgtttgaaaatgttcatatatacacacatacactctggtatgtgtagacacacatacatacaggtacatacaaggtgtcccttttatatatacatacattatatatttacacatacacacacacacacacacacacacccctgactctaacctctttgagaagaggaattctgccacttgtacacagggttgtcctttgcatgatgcttggctgtatatgatataactagttccctgtattaagttccctctgtccaaaataacttgtatagtttgtttgtcaactagattcttgaatggcaaatcacctttctatattatgtaataaacttagaatacttacatgctattgttggccatgttctatttatatcattttagcttcaattccacaaattagatctaaacattctatacagtcattgttggtttataatta

SEQ ID NO: 68174 - DNA, 601 bp, Human
aagtggacagctttcatagacaaatatttaaatgtttagacaggaatcatttatccttctcatcctaggctaaatacaccatcaactgttttacagacaacacattttcatactcttctcaactaggggccttctattctgaatgcattccagttctgtaaaaaatgtgcttactataagctatctttatataccaaattctgtgtaatttacacttcttacaagattctgatatcatttatccaaaaagagaaaagaaagaaaattaaaatgttcccagatctgaactgttcagtcattrttataatgcgtagttcaattatggacttaacggagatacactttctacagtgggtactgctggttaatatttattgcatatttactatgtaccacacctgtttctaagctctgtacacataatttatttaatcttcactataatcctgtgaggtacatgatgttttcactatttaacacatgaagaaaataaggcacagagctgtgaagtaccttaccctgtattacatggtttgtactgaatctcagtaccaaaactgagactcaaacctgggcagcctcaaccactatactagatata

SEQ ID NO: 68175 - DNA, 601 bp, Human
ggattatccggaataactagatggttctttctgaagttttatttatttatttttgcaaaatgaaaattatttacttggaaaatgataattttcaaaatctgcaggcattgatttataaatgatttatgtattaatagttcccatttttattttactctaggacaaatttatttccatgaaattcatctttaaatggcacatgttttgaatttttagggactttactaacacagattttgaaaatattcccattcctaaaatcatagaaacctataaaacaacatattatgcttttttttttaacttttattttaagtttaagggtacctgtgaagatttgttatataagtaaacttgtgtcttggggttttattatacagattattttgtcacccaggtattaagcctagtactccatagttgtttttcatgttcctctccctcctcccaccctccacactccaataggcccccagtgactgttgttctcctctatgtgtccatgtgttcccatcatttagctcccacttataagaaagaacatgtggtatttggttttgtgttcctgcattagtttgctaaggataatagcctccagctc

SEQ ID NO: 68176 - DNA, 601 bp, Human
tttatattttaagtggaatctaccctgggaagtagtcttgcaactcagatacgtgtttttttttttttgcatgaattggttgaattcatggattatctataagtataaggagatttcatttaggctcatctcaaagtttgaaaaatgctgtttatttgaaaaatattaacttccaattttaagcagcaattcattctaataagtaattttaacaatattttatttacagattgcccaaggactccagatactccaaataatgaccctcgttgttctactagcaacaatagattgaaggccytacaaaaacaattggatatagaacttaaagtaaaacaaggtgcagagaatatgatacagatgtattcaaatggatcttcaaaggtaagtgtagttaataaatgtaactatatagtcagtcattatttgcagattccatagttataaatttacctattcaataaaatttattagtaactccaacatcagtactggtggcatggcactttggcagtcatttgtgtacatgcatggagcaggggaaatttgaattatatgacatgcttgtttccagctgagttcgaacaaggtgattttgcct

SEQ ID NO: 68177 - DNA, 601 bp, Human
attatcctcaaggttctcttcagcctaaggttctatagttttaataatttccagaaattctgagaaagatataaagttataaaatgtacctttgtactttcaactcatgtattttaaatatttttatctctggaaatcaatttttttattttagtagatattttttaaataatttcttaataaaagttcttacatatttctttttttgtttcagtttagaaagaatttgaaatcagagggaaatattttttttcttaatcatgcatcctaactactcaccccaaatgaaatttgagactargcctggtggctcacacctgtatacctagaactctgggaggctgaggcaggaggattccttgaggccaggagttcgaaaccagcctggtcaatatagcaagaccctgtctctttaaaaaaaaaaaaaaaaaaaaaagacattagggaagttaccaaaaagagagaaatgtgtactgtctataaatgttttaaggttaattatgaacattagattttatgttatatttcaaaagaattttttgttacttttagagaaatgtatttgttcctatttacttatgatgtgatatttgataggata

SEQ ID NO: 68178 - DNA, 601 bp, Human
ggccacatgtggtgactcacgcctgtaatcccagcactttggaaggccgaggcaggtggatcagctgaggtcgggagttagagaccagcctgaccaacatggagaaatcctgtctctactaaaaatacaaaattagctgggcatggtggtgcatgcctgtaatcccagctacttgggagactgaggcaagagaatcacttgaacctgggaggcagaggttgtggtgagccaagatcgtgccattgcactccagcctgggcaacaaaagcaaaactccatctcaaaaaaaaaaaaaaaaaaagaaagttcacatccatcctcctcagacttaaagaattaaagaaggtcatttatgcaagcagtaagtttaagtagttttttgcagtagtccaggttaaatagcttcctttctcttgtaacagcagtgaaaacagtgaagataagagtcatacttttggtatcttggatatgaggaaggaggcagagtcaaagattattcttagatcggttatgtggatagactgatgaattatggtgccctttataatgatagagaattcatgagggggagcaaatttagggacagggatgattaattcag

SEQ ID NO: 68179 - DNA, 601 bp, Human
aaattgattccacttttttgtttgtttgtttttggagacagggtctcactctgtcgcccaggttgtcacccaggctggagtgcagtggtgtaatcttggctcactcactgcagcctccacctcccaggttcaagtgattctcgtgcctcagcctcctgagtagctgggattacaggtgggcaccaccatgcctgggtaattttttgtatttttggtagaggcagggtttcaccgtgttggctgggctggtctcgaactcctgaccttagatgatcccccagccttggcctcccaaagtgcwgggattacaggcatgagccaccatccctggcctgattccacatttctttggaattttcttcagctacttttaacttcctagtgcatataataatcatctatatgtcttctagcaaattataagcttcataggataacattctgattgattaatatttgtgttttcactgggtctggcatgtaatttatggcttacttcctatatgttactttaacataaatacatgatgaaaaaaataagaatgactggcctatttattacctagatggtactaataagaacaatgattggcttatttga

SEQ ID NO: 68180 - DNA, 601 bp, Human
aataagaacaatgattggcttatttgaaagttttctgtgtgatgtaatgtgttgtaatgtcccactatagcttgcaaaacagtgttatttttttgtaaaataaaaaacataatttgaaagtcgtataattttttagttattcttataattgtaaaatatttattccaaatacaattaccagcattatagagtgccaattactaatagttcattactttagtgtgttaggttgagccatataaaattgctgtttttttagttcaaaatcagacactggcattttcatgtagttctacctaakgtatgtaaaaactttcccaaaatttgtattaacataaaagtcagatttctccaatatgtaaaccagtccgtgtactccagccttatctcttcccttgtacatattatgtgcttaataaaaattccattgaatgcctgaaaacataaaactgatatgtaataactgtatattgcctgtgatagataatatccaaaatccattttaaaagtttcatcatactttgacatcctgcagatcctccagaaatttctgtgggaaaattcacctatttttaaaataaaatacaagtgctgtttcttg

SEQ ID NO: 68181 - DNA, 601 bp, Human
agcttgtcatctggtgagagggagcaagagagagaggaggaagtgccaggctcttttgaacaaacagctcaacaaccagcgtgaactcatagaatgagaacttactcatactgtgagggtggcaccaaacaattcatgagggatctgtccccgtgacctaaataccttccagtaggcctcgcttcagacactgaggaattacatttcaaaatgagatttagagggacaaacatccaaaccatatcaggcattaacattatttcacttaattcagagcttttttttgaaatcttaagatatracagaagtgttctccagctttattaagaaggtctcattttttgacattaaagtgtttctagggacctttctcattgtcaccagggttgacaaatgctgttttctacctttcttagcataattaattggaacacaattgctatctgtgattaggtttttagtttaggtttaatcatggaggcatttatttcatactatgtttctgagtcttagagttattgatcatagtaaaggaaaattctttatgttttgtgtaaagcaaaaataagaaaattacaaatgtgaatttggattttgattt

SEQ ID NO: 68182 - DNA, 601 bp, Human
ccaaaacatcatgtacactgcaagtatatacaataaaaaataaattttaaaaatacacagccataataagatttccttttctcccaaattgtcttaactaatggagttgtttttcacaattatcaccctgtaagtttgatggctcttttttagtaaatgtatctataagatatactatagcgccaacagcattcttttaactctgtttttcacttgctgatatatcacttgatctgtttagaagataggaaaatgtttcatttttccctttatttgcttaatttttcaaacttattttttwaataggatcggaaactccatggtacagctcagcaactgctccaggacagcaagacaaaaatagaagtcatacgaatgcagattcttcaggcagtccagactaatgaattggcttttgataatggtgatggaataaattgtcctccttcttatgagcataatggtgctaaataatcttatgcaggaacagggcagtggttcaaagttaagagggaggaagcattactattacttttttttttttttctttttttttttgagacggagtctcgctctgtcgcccaggctggagtgcagtggc

SEQ ID NO: 68183 - DNA, 601 bp, Human
aagtagctgggactacaggcgtccgccactacgcccggctaattttttgtatttttagtagagacggggtttcaccgttttagccgggatggtctcgatctcctgacctcgtgatccgcccgcctcggccccccaaagtgctgggattacaggcgtgagccaccgcgcccggcccttttttttttttttaatcttgagttttagactcttcacttggatagatgcttttagatatttggcccttatgtttcaagaagatattgatctagaatgtatctcttcatttaaatagattatcaartacttacaatcagtcttcatttaaaaaaaaatctgttacctgtttaagagtatggctttgttttcttttgtttttttgttttgttttatttattttttaattccagaagaaatctttaaagctagttgctaagagtaggagtagaaactttcggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaag

SEQ ID NO: 68184 - DNA, 601 bp, Human
ttttatttattttttaattccagaagaaatctttaaagctagttgctaagagtaggagtagaaactttcggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaaggactaagttattgtaatgttataggaattcatttcttttcatgattttaatcactgcaaattggaaagtcagataaatggtgcrattaaaatttttttttcctttctagcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaag

SEQ ID NO: 68185 - DNA, 601 bp, Human
ttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcaytaacaggtatgtagtgtatagccattgttttttgtgtgtatttttgtctataactggttctgatttaataattgaaagaaaaacctgtgcatagatttttaaaattatgataagatacacatagaataaaatttgttgtattaaccattttaattttattcaatttggaagcatttgctatattcacaatattgtgtgaccatcaccactacctagtttcaaagcattttcatcaccccaaaaggaaacgcatacctgttaagcagtcactccccattcccccttcctcccagctgctag

SEQ ID NO: 68186 - DNA, 601 bp, Human
accttttttgcctggcttcttttacttagcatattgttgtcaaggttcattcatgttgtagtatgtatgagtacttcactcacttttaatgtctgaatagtattccacttgtgggaatattctaaaattcaaaactttttgtgcacccaacatgatgctcaaaggaaattctcattggagcattttggatttgggatttcagatttccagattagggatgcttaaccagtaagtataatataatataaacattccaaaatctgagatacttctggtcccaaggatttcagataaggaataytcaacctatactatatttgattgacctatttgtcagagcatatgagttctttttaccttttgactgttgtgagtagactgctatgaacatttacgtgcaggtttttgcttgaacatctgttttcaatttgggggtatattcctaggaatataattgctaggtcatatggtagctatatctaagattttgaggaactgtcaaactgttcttctcagcatttacattattttatacttctaacagtaatgtataaagtgggtttcagtatctccagatcctcaccaacagttaatatttttt

SEQ ID NO: 68187 - DNA, 601 bp, Human
tcccttcagttatgtaaatttttgtttcctatattgtgggctgttttgctaggttcatgtatgtttacaatttttatatcttctagacggattgactcctttacctttaccttaactcctttataatgtccttctttgtctcctataacaatatttaatttaaaatctgttttgtctgattttataacagctacccctactttgttttggttttgtctttgggttcaaatgagtctcttttagattatatattattgtattctgttttataagatccattctgtcagtcttttttttttttaattcatttttattgagacagagtctcactctcattgcagcctcccactcccaggttcaagcaattcttgtgcctcagcctcccgagtagctgggattacaggcatgtgctactgcacctggctagtttttgtatctttagtagagacagggtttcaccatgatggccatactggtgtcaaactcctggcctcaagtgatctgcatgtgccactgcacctggctaatttctgtatttttagtagagacagggttttaccatgatggccacactggtttcaaactcctggcctcaagtgat

SEQ ID NO: 68188 - DNA, 601 bp, Human
cccccacaaaactgccatcacttcataagcaagcagcaaatttagagtttccaaggctacatgcactcctgaccaactgtctacagattccaggatttctactagcatctcagctcagtaatttgcaggaacaaatcatagaactcagggaagcactatacttaggattacgtttttattataaaggatacaaattaggaccttcatggctcactgcagcgaaaagaaaataaacataaagggggagatctgagaggatctcaaacacaaaccttatgtgtccttaggatatatcaccctsctaacacatcaatgtctgtcaccaaccaggaagttcacttgagcattgggtgtgcagaattttcattggggctttgttaacataggtgtgattgagtgaatcattggccacatgattgaattcaatctccagccttgtgcccctccctaggtcaggaggtcagactgataatgtggctcaaagcctcaacctcctgaagatatgatcattctttctggcatggccagcccccatcctgaaactgtctagaggcccaccatgagtcaccttaccaggtgtggtctaaggtatccactatga

SEQ ID NO: 68189 - DNA, 601 bp, Human
gattgaatttttctactctgtttttatttacttatttttgagacaggatctctctttgttgcccaggctggagtacagtggtatgatcatagctcactgtaacctcaaacatctgggctcaagcaatcctcctgcctcaacctcctgagtagctaggagtacgggaacgtgccaccacacctagctaatttttagttttttgctagcaatggcgtctcactgtgttgctcaggcttgtctcaaactcccggcctcaagtcatcttcccacctcagacttccaaagtgttgggattataggygtgagccactatgcccagcctctattcttacttttcttattcccttcttgctcccttttatgagatagatagatatatatattctcccacctcagcctccctagtagctgggagtacaggtgcacaccaccacgctcagcttattttattttttttgtagagatggggtttctctgtgttgcccaggctggtcttcaactcctgggctcgagcaatctgtccaccttggcctcccaaagtgctaggattacaggcatgagctacttatgcctggtctttcactaaatcttgaactcctcg

SEQ ID NO: 68190 - DNA, 601 bp, Human
ctcagcctccctagtagctgggagtacaggtgcacaccaccacgctcagcttattttattttttttgtagagatggggtttctctgtgttgcccaggctggtcttcaactcctgggctcgagcaatctgtccaccttggcctcccaaagtgctaggattacaggcatgagctacttatgcctggtctttcactaaatcttgaactcctcgcaaccactcacctcacttcctccgtagttttgccttttccacaatggtcatacagttggaatcttaacagtatgtagccttttcacattgstttctttcacttagtaatatgcatttaagtttcctctatgtctttccatgctttgatagctcatttttggttttgtgctgaataatactctattgtgtggatgtaccataatttatttattcattcatttaccgaaggacttcttggttgcttccaggttttggcagttatgtatcaagctgttataaacatccatgtgcgggtttattattttcttagtgattaccccaatgattataactaatgtcctaaatttattataatcttatctttagtagcctacaaaaaactctttgactg

SEQ ID NO: 68191 - DNA, 601 bp, Human
catcagatttgggaagtttccaatcatttcttcaaatgttctttcttctccctctgagactttgatttttgcctacattggtgtgctttatggtatttctcttagactctgattttcttcattattttttctttctgctcttaagactagacaagtgcaattgatctaccttcaaattggctcactttttcttctgcctgctcaaatcttgtattgaacctctctagcaaattttttcatttttgttatacttttcaattccagaatttctgtttggttcttttttataatttttaaatcyatattgatgttctctatttgtagacacatcacttttcttgtttcccctagatatttgtccatggtttcttttagatttttgagcatcttaatttagtaagtccaacatgtcttgacttccccagggtcagtttctgttaatttcttttttctgtgaactgaccgtattctgttactgtgcttgcttcataattcaagtacttcatttccttagtatacttactcacaaatcagattttactctttccaaagatttcatttttctgctatatgttgaatgtagttgtttgcctagtaactt

SEQ ID NO: 68192 - DNA, 601 bp, Human
atttttgagcatcttaatttagtaagtccaacatgtcttgacttccccagggtcagtttctgttaatttcttttttctgtgaactgaccgtattctgttactgtgcttgcttcataattcaagtacttcatttccttagtatacttactcacaaatcagattttactctttccaaagatttcatttttctgctatatgttgaatgtagttgtttgcctagtaacttttataatctattttgtagagactattctttctcatgtattacccctgaggtgtctatttcattaatatattgtamaccaaaataaaattctaagccacccaactaaatgaatggaccccctcctctcagccaatggcattctaaagtaaacctgaaacactagttcaggtcgtgctgggaatgggtggtttggacatgcctcattatgccttcctccctttggaattcaggtactgcagaccagcattaacatcaaaacagagaccttaagactgactgaacagactctttcagtagataagaaacatttacagtctcttctttctgaagcctgctatctggaggtttcatctacaaaatgagaacctgggtctc

SEQ ID NO: 68193 - DNA, 601 bp, Human
tggtttggacatgcctcattatgccttcctccctttggaattcaggtactgcagaccagcattaacatcaaaacagagaccttaagactgactgaacagactctttcagtagataagaaacatttacagtctcttctttctgaagcctgctatctggaggtttcatctacaaaatgagaacctgggtctccacaaccccttatcttaacagcactcttacaatactcccttgtattgattccaggtctttagataaactctttctaccagttgccaatcagaagatctctgaatccacccrtgacctgaaaatccctacttcgagttgtccatcttttctggacccaactaatgtaccttttacatgtattgatagatggcttatgtctccctaaaatgtacaaaaccaagctgtaacccaaccaccttgggcacgtgttgtcaggacctcctgaggctgtgtcacgtatatccttaatcttggcaaaataaacttctaaattgagacctgtctcagatactttttggtttactatatagtcatctggtgtttcaacagacatttcctttaattcctgaagaagaaaagattgcctagtct

SEQ ID NO: 68194 - DNA, 601 bp, Human
acatgaaggacaaatttacagttaaacttcgctgttgccactaattaggatcagtctaaatgtgcagttcacaaattgagtgcttaaatctgaggcaacctgggataccaaagtgaattcacagggccacatcaggattttgtttttgagggatgcacagcattatctgtacttcatgtagtcaccattcagactactagctcaaggtagttacagtttcagggttaggtggagctacattcctttcagtgatgttgtgtatttatgaagctgggttttcctcaattgctgtgattttggtttttttaaagtgctgtgtgaaatcagtgtggaataggaaatcagtgtggtagtttccaaactgattccaaagctttagagttatacagtgcccaaaaagaagtaatcttgcttaagaatgaaatgaaaatactttttcttttagttatatgtattttttttcaaatagctattaatttgttaggaaagcaatcatatcctatgtttggacctaactgtttaatcaacaaaactataaggtatatcttttggcctagggacacagttaaaaaatagtttaataaaacattagggcaccatg

SEQ ID NO: 68195 - DNA, 601 bp, Human
cttagtattcatcttcttatatgtatttttaaatcaaaactggaatatagacctgtaaagagcaaagaccttgtcatctacctacatataatcctagcctccagcacaggatatttgatacattcaacaagtacttggtaaatagtatctgacaattaggcagggactatactgcaggcaaggactgtacttattgtctgctaagtttcaccaccttttggctcaatgctgaacacattgttgatactcaagcatttctgaatgatccattgattaaaataaggttgtcaaatattttgaataacaatatttctagaaaagtaataaaatcacattttagaaactcagctgataatgactggaaatttttttccttttctattctagtctcctgttccctcctttcagttccttcttcccctgttcctcattccattactgaactttactcaaagttatataagtcaccaacctaaaaagaagtatcttacaattcttaagacatttttaaaaaattctttaagctcctactggaccataaactaaattttaagtaactagggagagaaatactactgacattaatagaagactacacatg

SEQ ID NO: 68196 - DNA, 601 bp, Human
gtggttcgtctcatactccagtttcttttgtggttgtatgattatactactgaaatttgccagtttgttgctactttgaataaggtataattgtttttttgttgttttttctccatgttttgagaaatttactagttttttataagaggatatttctgcagaattaaaaaaagttgcctaatcataccatgatgaaatactgaattagtgaaataggtataaaatagttttccagacagttgaaagaaaatttttaaagcatttacttgttctaatgcaattcatagttattacttctgawtaccaacatttacttcttggatttgcttgttttaaaaatttcatattgtgctttatgaatgtagttttaagctatttctaatgtgtttatatgcaattgtgtcacctcataaagaaacttctagatgtttaataaagaactccctctagatttttttcctaaatgaaagcaggtgttgagcattgtcatgttctgatgtattgaaattgctaaaatatttaataagctaccatagtttgaagtagtagccagatgttttcagtttccccaggatgcattttacagttgagcatttacagt

SEQ ID NO: 68197 - DNA, 601 bp, Human
gttattacttctgaataccaacatttacttcttggatttgcttgttttaaaaatttcatattgtgctttatgaatgtagttttaagctatttctaatgtgtttatatgcaattgtgtcacctcataaagaaacttctagatgtttaataaagaactccctctagatttttttcctaaatgaaagcaggtgttgagcattgtcatgttctgatgtattgaaattgctaaaatatttaataagctaccatagtttgaagtagtagccagatgttttcagtttccccaggatgcattttacagytgagcatttacagtggaagttagctaaatttgccagtttaacaacaacaaaacaaataagaaacacaaattttttaactcaaaatgatataattaatgtgttatcactgtacagtaagataagatttccacagtctagcaaaacattattgacactccacctcccaacgttaatagccttattgaggtatagtttacataccatagaattcactcattttaaacatacacagtatgatttttttagtaaatgtatatgcctatttcaccatcatcagtaatccagtttttagggcagttt

SEQ ID NO: 68198 - DNA, 601 bp, Human
gactcttctggatattttcttcagtgcctcatgaattgagattttcaagcctggctggtggtaacaaacactattcctacctatatgcactgagtattgttctttctaactttttcagtgggttctttcccctgcctcagatattttcttcataggcaggtgctgattagtactttgatgaatacttgaaaaccctctgaccatctcaggagttctttctatgaacagctttaactgccttgtgaactctagctgctttggtttccttgtactcttatttctgtctcttcaacttggctcygcctgagtttccccctccctgcactgtgtcctagaaacccttaagacagtaagctggagcaatcttagggcttatctcatttgtttcccatctctcagggatcactattcgtctttaacctttttcatatattttgtctgattttctttttttggtagtttgaattgggaagctttgtttgttactacttggatagaaatatataagtacttcagtgttattaaaaacaatttaaaactttaagtaaaattaagtagttatttaaattaatgggacaacttttaccagaaatattcctcc

SEQ ID NO: 68199 - DNA, 601 bp, Human
tttcccctgcctcagatattttcttcataggcaggtgctgattagtactttgatgaatacttgaaaaccctctgaccatctcaggagttctttctatgaacagctttaactgccttgtgaactctagctgctttggtttccttgtactcttatttctgtctcttcaacttggctccgcctgagtttccccctccctgcactgtgtcctagaaacccttaagacagtaagctggagcaatcttagggcttatctcatttgtttcccatctctcagggatcactattcgtctttaacctttttcatatattttgtctgattttctttttttggtagtttgaattgggaagctttgtttgttactacttggatagaaatatataagtacttcagtgttattaaaaacaatttaaaactttaagtaaaattaagtagttatttaaattaatgggacaacttttaccagaaatattcctcctaaaatgttattcattgtacagtatctaaaatgttaatacggaagcattatttaaattctagtatactgtgtctagcccaaataatgacaaagccatatatccagaggacctaactcatagttct

SEQ ID NO: 68200 - DNA, 601 bp, Human
tcttagggcttatctcatttgtttcccatctctcagggatcactattcgtctttaacctttttcatatattttgtctgattttctttttttggtagtttgaattgggaagctttgtttgttactacttggatagaaatatataagtacttcagtgttattaaaaacaatttaaaactttaagtaaaattaagtagttatttaaattaatgggacaacttttaccagaaatattcctcctaaaatgttattcattgtacagtatctaaaatgttaatacggaagcattatttaaattctagtatactgtgtctagcccaaataatgacaaagccatatatccagaggacctaactcatagttctttattttcattttgaacacctttagtatttatttgcctaaataaattgaagttattttatgtttaattacaacccatgattttttggctaattaaactaacagaatggaaagataatgtcattttacatcaaatagaacacatttatttagttatacaaaaaccctgtaaagttcttttctgtgttaactacgtaactattaaacatagttggtattcacatagtgagacttccttat

SEQ ID NO: 68201 - DNA, 601 bp, Human
ggtggaatgcagtggtgcaatcttggctcactgcaacctctgcctcttgggttcaagcaattcttgtgccccagcctcccggatagctgggactacaggcgcacaccgcctcgcccagctaattttttgtatttttagtatacagggtcttgccatgttgcccaggctggtctcaaactcctaaattcaggcaatccacccaaagtgctaggattacaggcgagagagctactgtgcccagccaggaggtgctgttcttttctataaaatttcttatagttgtctaaagaatttgtaatgrtttctctaattaaaataggaaagatgatagctacctcatagatcctctgggagaagagtttttgttaccagattttttttttctttttttgaataggtaagagatttagattaaggattccatagattaagggttgatgttcttatctgatatttatgtttgccaacaggtactttggaagttcgtcttatgggctgccaagatatcctagagaatgtccctggacggtcaaaagcaacatcagttgcactgcctggttggagtccaagtgaaaccagatcatctttcatgagcagaacg

SEQ ID NO: 68202 - DNA, 601 bp, Human
ctggttggagtccaagtgaaaccagatcatctttcatgagcagaacgagtaaaagtaaaagcggaagtagtcgaaatcttctaaaaaccgatgacttgtccagttcagtaaccagatttttaaaaatcatgtaacaaactaaagtgcttatacaagggatttatgaagtgttcaagttggacaaaacactttaaaattatggtttttataatttaattaaaaaatattaaaacctgtgatgtcaggaaacaaaaaggcaacaaattctgttttgttgaagatacattagaaaacttaatgrcaaatgacattagttcttttggaagaatgaaatattgagcatcactcttatgccaaactgaaggtatacagaagctatgagactggtccttcttgtagaatcgtatcttgattcttttatttttctttattttttgagacagtgttttgctctgttgcccaggctgggtgcagtggtgcaatcaggtctcaacctgctgggtttaagtgatcctcctacctcagcatcctaagtagctgggactataggcatatgccaccatgcctggctaatttttttttctagaggcagggtctcact

SEQ ID NO: 68203 - DNA, 601 bp, Human
aagttttatattgaaaagagaaattacaagtaatttagaatcttgccattattttgtagttgaggaaaccaagatccaggttagttacataccagtaaatttcaggactggtactagaccttcagtgtcttaacttttaaatggatgctctttttctctctggtgatttgaatgagatagaaagataacagtagcacagaggaggaaacagcagaagatgaagagtgcctggaagagataatatggttttaaattacctaaactacaagcttagaacaataaaagactgtgataactgttrtttgttctttccctgccattgtaatcttcacctgaaaatgtttttcgcctcaatggcatcaggcatttttcccactttggaataatgctccttttaaaatttggaagacattgtgcatgttaagcaggtcctctaggttcttgagaggcatctttcttatccctaatttgattataaacttttccttggcagaaaccacattccctattaaaataggtccttctgtttacatagtatattttacattttcatgtgctttctattcttttatcctttgtatttatagactataaaaaatgt

SEQ ID NO: 68204 - DNA, 601 bp, Human
acagagaagagccctgtccttagaaccaaagcttagaacaattttagcagatttcagtgttgttaagagcagaactatagaaaatgtcgaccgatcactgggaaaggagggaaagagagtatagaagcagttaggacaagtaaaaaggtggtaggattcatggattgggactaacagtgggattgtcatatcagtggatgttgaagtattagagagagtgaactagaatattaggagataatgttcagagagaaagatgcagacagttgagattgtggaaggattatagttactggtatgwcagtatgatgacaggagtgaaacggcaaggtaaggtaagtcacaagattataagaagttagccgtgtgcagtagcttatgcttgtaatcccagcactttggggaggccgaggcgggcggatctcctgagttcaggagttcaagaccatcctgaccaacatagtgaaaccctatctctattaaaaatacaaaaattagctgggtgcagtggcagacgcctgtaatcccagctacttgggcggctgaggctgagactctgcttaaaccccggaggcagaggttgcagtgagctgagatcacg

SEQ ID NO: 68205 - DNA, 601 bp, Human
aacaattttagcagatttcagtgttgttaagagcagaactatagaaaatgtcgaccgatcactgggaaaggagggaaagagagtatagaagcagttaggacaagtaaaaaggtggtaggattcatggattgggactaacagtgggattgtcatatcagtggatgttgaagtattagagagagtgaactagaatattaggagataatgttcagagagaaagatgcagacagttgagattgtggaaggattatagttactggtatgacagtatgatgacaggagtgaaacggcaaggtaaggyaagtcacaagattataagaagttagccgtgtgcagtagcttatgcttgtaatcccagcactttggggaggccgaggcgggcggatctcctgagttcaggagttcaagaccatcctgaccaacatagtgaaaccctatctctattaaaaatacaaaaattagctgggtgcagtggcagacgcctgtaatcccagctacttgggcggctgaggctgagactctgcttaaaccccggaggcagaggttgcagtgagctgagatcacgccactgcactccagcctgggcgacagagcaagactc

SEQ ID NO: 68206 - DNA, 601 bp, Human
atttcagtgttgttaagagcagaactatagaaaatgtcgaccgatcactgggaaaggagggaaagagagtatagaagcagttaggacaagtaaaaaggtggtaggattcatggattgggactaacagtgggattgtcatatcagtggatgttgaagtattagagagagtgaactagaatattaggagataatgttcagagagaaagatgcagacagttgagattgtggaaggattatagttactggtatgacagtatgatgacaggagtgaaacggcaaggtaaggtaagtcacaagattwtaagaagttagccgtgtgcagtagcttatgcttgtaatcccagcactttggggaggccgaggcgggcggatctcctgagttcaggagttcaagaccatcctgaccaacatagtgaaaccctatctctattaaaaatacaaaaattagctgggtgcagtggcagacgcctgtaatcccagctacttgggcggctgaggctgagactctgcttaaaccccggaggcagaggttgcagtgagctgagatcacgccactgcactccagcctgggcgacagagcaagactctatctcataataat

SEQ ID NO: 68207 - DNA, 601 bp, Human
agtagcttatgcttgtaatcccagcactttggggaggccgaggcgggcggatctcctgagttcaggagttcaagaccatcctgaccaacatagtgaaaccctatctctattaaaaatacaaaaattagctgggtgcagtggcagacgcctgtaatcccagctacttgggcggctgaggctgagactctgcttaaaccccggaggcagaggttgcagtgagctgagatcacgccactgcactccagcctgggcgacagagcaagactctatctcataataataataataataataataatatcaacaacaaaataagattataagaacccaagggacttttcatttattggtttctaattttcagaaatttttgactcacactacatgaaagaagattggaatttaacttttaaaccaccgcactcctattctcattctcccaaataattatgttaaatcagtaatctagtgtttattataactataaagattgtccatagatgaaccaagttctgtatggtgattatatttcctttttaataccttttcctcccttagggccactaaatacctctttgttttgttttgcttagttttctgc

SEQ ID NO: 68208 - DNA, 601 bp, Human
ttattccccaaatattttcagtcgtggttggtttaatccacagataaggaacccacagatacagagggtggactgtatatgtaaacaacccatataatataccactatttaaacttctttgaactcctgaactctggtatacctttactcctttgtcattttaaatgaactgtgctacacaaattgaaatcttaaattcgatatacctgttgggcacggtggctcacgcctgtaatcccagcactttgggaggctgaggcaggcagatcacctgaggttgggagttcaagaccagcctgaygaacatggagaaaccccatgtctactaaaaatacagaattagccaggcatggtggcacatgcctgtagtcccagctacttgggaggcttaggcaggagaatcacttgaacccgagaggcggaggttgcggtgagccgagatcatgccattgcactccagcctgggcaacaagagcgaaattctgtctcaaaaaaaaaaaaaaaaaatcaatatgccagcctttcaccaattctcttgttgtcctgaatgataaactacagaaagcacctagaataattagccaagtttggggcacaagcc

SEQ ID NO: 68209 - DNA, 601 bp, Human
aacccacagatacagagggtggactgtatatgtaaacaacccatataatataccactatttaaacttctttgaactcctgaactctggtatacctttactcctttgtcattttaaatgaactgtgctacacaaattgaaatcttaaattcgatatacctgttgggcacggtggctcacgcctgtaatcccagcactttgggaggctgaggcaggcagatcacctgaggttgggagttcaagaccagcctgacgaacatggagaaaccccatgtctactaaaaatacagaattagccaggcrtggtggcacatgcctgtagtcccagctacttgggaggcttaggcaggagaatcacttgaacccgagaggcggaggttgcggtgagccgagatcatgccattgcactccagcctgggcaacaagagcgaaattctgtctcaaaaaaaaaaaaaaaaaatcaatatgccagcctttcaccaattctcttgttgtcctgaatgataaactacagaaagcacctagaataattagccaagtttggggcacaagcctgtagtcctagctactggggagactgaggcaagattacttgagcccagg

SEQ ID NO: 68210 - DNA, 601 bp, Human
ctgtaatcccagcactttgggaggctgaggcaggcagatcacctgaggttgggagttcaagaccagcctgacgaacatggagaaaccccatgtctactaaaaatacagaattagccaggcatggtggcacatgcctgtagtcccagctacttgggaggcttaggcaggagaatcacttgaacccgagaggcggaggttgcggtgagccgagatcatgccattgcactccagcctgggcaacaagagcgaaattctgtctcaaaaaaaaaaaaaaaaaatcaatatgccagcctttcaccarttctcttgttgtcctgaatgataaactacagaaagcacctagaataattagccaagtttggggcacaagcctgtagtcctagctactggggagactgaggcaagattacttgagcccaggagttgaatacagcagtgagctgagaccatgccactgcattccaggctgggcaacagagtgaaaccctttcattaattagctaactaattaatgcacctaggataataccttgtacataatggtattcagtaaacgatagctcttgttattgtttttcttctagctgttttttttattatc

SEQ ID NO: 68211 - DNA, 601 bp, Human
tttgttctacaaacatttattgagtgtgcatgcatacgcaaggcagtttgatcccagtgcttttctttttagcaactatacaggttgaatatcctttatctgaaatacttgggaccagaagtattttagattccaaattttttttcagatcttagaatctttgcatttaaaaatgcaaactgattgagcatctgaaaaatttgaaatcccaaatcctccaatgagcattgcctttcattgtcatatttgtgctcagaaagtttcagattttgtagcttttcaggttagggatactcagccygtactgcctgatgtgatccaatccctacccctccttacaccgaaaccctttagtaccagcctgtaacttcaagttaaagaccaaattctactccaagtcatgctaagctcctcatgacttatctctgcccatgttttcattcttatttctcacagcatttctacttatattctaggctttaactatatgaaactgtttcctatccctatgatgtactatatacttccttacctttgtatgttttttcccctctgatgactttgtcctctcctttaatctttagatatagctctcaaaacc

SEQ ID NO: 68212 - DNA, 601 bp, Human
gtgtcattgtgcatattgtatatgccactgtattgccagtattgatttacatttctgtctcccagaatttccgtcttccaaagcaaaactgtgaactatttgagagcaggaccatatgttacttatctttgtatctctatcacagaagacacttagtatacatattcactaagtattaatgggatgaatgaaaataattaaaactgaaaaggaggtttgctcaacctttttttttttttttgctgcagcatacccaaagaatacaacacactctagtcaatacagtgattcccaaatagayacaggtcagaatctgagaagggagggcaggtataaatttgaaaatgtcagggccaggcacagtggctcacgcctgtaatcccagcactttgagaggctgaggcgggcggatcacctgaggtcaggagttcaagaccagcctggccaacatggtgaaaccccatctctactaaaaatccaaaaatcagccatgtgtggtggcaagcgcctgtaatcctagctactcaggaggctgaggcaggagaatcacttgaacctgggaggcggaggttgcggtgagctgaggttgcaccattgcact

SEQ ID NO: 68213 - DNA, 601 bp, Human
gaaaatgtcttccaggtgcagtggctcatgcctataatcccagcactttgggaggctcaggtgggcggatcacgaggtcaagagatcaagaccatccttgccaacatggtgaaaccctgtctctactaaatatacaaaaattagctggatgtggtggtgcacacctgtagtcccagctactcaggaggctgaggcaggagaatctcttgaatctgggaggcagaagttgcagtgagcggagattgcgccactgcgctccagcctggcgacagagactccgtctcaaaaaaaaaaaaaaaaragagagaatgtcttccttacctactctcatctggctccacacaactgaatctgatttaattatctgtgcctcacttgttattaggaaatcactgctctacaacatagtgtagacattttagctttttcttacctctctgatctgtaaattaatactcaaggcctccatttagcactgtgagaaatgtaatagagaccaggcacagtggttcatgcctgtaatcccagcactttgggaggctgacatgggagaatggtttgagactagcctgggcaacacagcaagacttcatctctattc

SEQ ID NO: 68214 - DNA, 601 bp, Human
ataatcccagcactttgggaggctcaggtgggcggatcacgaggtcaagagatcaagaccatccttgccaacatggtgaaaccctgtctctactaaatatacaaaaattagctggatgtggtggtgcacacctgtagtcccagctactcaggaggctgaggcaggagaatctcttgaatctgggaggcagaagttgcagtgagcggagattgcgccactgcgctccagcctggcgacagagactccgtctcaaaaaaaaaaaaaaaaaagagagaatgtcttccttacctactctcatctsgctccacacaactgaatctgatttaattatctgtgcctcacttgttattaggaaatcactgctctacaacatagtgtagacattttagctttttcttacctctctgatctgtaaattaatactcaaggcctccatttagcactgtgagaaatgtaatagagaccaggcacagtggttcatgcctgtaatcccagcactttgggaggctgacatgggagaatggtttgagactagcctgggcaacacagcaagacttcatctctattctataaataaatgcacacaaaaaagaaaacaatt

SEQ ID NO: 68215 - DNA, 601 bp, Human
ggctccacacaactgaatctgatttaattatctgtgcctcacttgttattaggaaatcactgctctacaacatagtgtagacattttagctttttcttacctctctgatctgtaaattaatactcaaggcctccatttagcactgtgagaaatgtaatagagaccaggcacagtggttcatgcctgtaatcccagcactttgggaggctgacatgggagaatggtttgagactagcctgggcaacacagcaagacttcatctctattctataaataaatgcacacaaaaaagaaaacaatytttaaaattagtgaaattttaagaagaatttttaaaaagaaatgccaaagaatgcaaaagcaccagaggtattccttccataaaggaccctaaggcctggtaggttaaaaataaattgtttgagacaaaataaaaaactattaaattgtatttcagaagcttaggggaataataattctaccaacatgagcttgcatacaaaattttaaaatacatgaggatatagccaccatgaccaagcagaagcagataatgggattattaaatatataatataaaatattttaaagtttgtgttta

SEQ ID NO: 68216 - DNA, 601 bp, Human
aatagtctccattatctctgtctcctactgttgtctctgtatttctcatcctcccatatgatcccaaagtttccctctttttgtcacatttgttccagctggagaatcactctcattggactgctgaactgaaaacatatattattgtttcttgaggtggtggttttctgtttttccccagtggattccattgtccttccttccctgtcctaccctgtttttgggctgatgactacaaagttcacttgaattacttggctctgacttacaatgagagacactgttaagagatccaagagcyaggaggaaaggaaagtcgcagtgtgtatttccctttctccttccttgccttgccttgcttttcacaacagcattcatctatggccaccaactcctgtcgggtagttccttttttaagatttagtctaaatcagattctggcaatgatttaagttcctcttgccccttcaggctaagagtgataatggatttctactgttgcttgtcctcagattcttttcattccttgttggtttaactttaatcacatctccataagtagccaatttaaaaaactctctttagttaaactctttcagtg

SEQ ID NO: 68217 - DNA, 601 bp, Human
attatctctgtctcctactgttgtctctgtatttctcatcctcccatatgatcccaaagtttccctctttttgtcacatttgttccagctggagaatcactctcattggactgctgaactgaaaacatatattattgtttcttgaggtggtggttttctgtttttccccagtggattccattgtccttccttccctgtcctaccctgtttttgggctgatgactacaaagttcacttgaattacttggctctgacttacaatgagagacactgttaagagatccaagagccaggaggaaargaaagtcgcagtgtgtatttccctttctccttccttgccttgccttgcttttcacaacagcattcatctatggccaccaactcctgtcgggtagttccttttttaagatttagtctaaatcagattctggcaatgatttaagttcctcttgccccttcaggctaagagtgataatggatttctactgttgcttgtcctcagattcttttcattccttgttggtttaactttaatcacatctccataagtagccaatttaaaaaactctctttagttaaactctttcagtgtactatctgc

SEQ ID NO: 68218 - DNA, 601 bp, Human
acataatgaaatgcataagtttataaattgaaatttgttatataaaataagtaatttattgctttgtagagccttaaaaggagaaacatttatctctttttgtggatggtgtacagaagcctgaaaaacaaaataatagaaaagtccagtactttatgattaaaatgtatatacgttaaaacatataggtagaggtcagtatatggtttggccacagcttaggaactatgttctacaggtgcatttaaacactggttattaaaaccttaaatatatttcgccacataagcattattttcartgtctactgtgtattctctcatacggctttggtataattaacttgtccctggtttttgaacattcaaattcttgctaatttgctttttaaattatgttttattgttataataaatgaatatctttctgtataaagcttggtctgaatttcccctttcttcctttcgtacgcagaatgggtcttgctacccagtggtattcttttgaaaattaaatgacctaatattcttaaagtgcttattagcacaatatgtggcacattgtgagtacagaataaatgctatttgcagaactttttctg

SEQ ID NO: 68219 - DNA, 601 bp, Human
caccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagygattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttg

SEQ ID NO: 68220 - DNA, 601 bp, Human
accaacttcttaatgttggcatgaaattgtcattagcctctggatgctcatggtccagaagagatagaataggctgcttaaactagaggtaacataggagtgtggttgatactacatgacatactgcctgaaatactattcttcttctaacttgattaacatacataataatgtgttagtttttcattgttttggttttgttttgttttgagacggagttttgctcttgttgcccaggctggagtgcaatggcatgatcttggctcactgcaacctccgcctcctgggttcaagtgattcyactgcctcagcctccctagtagctgggattacaggcatgcaccaccacgcccactagttttgtatttttagtagagatagggtttctccatgttggtcaggctgctcttgaactcctgatctcaggtgagccgcccgcctcggcctaccaaagtgctgggattacaggcatgagccaccgtgctcagcccagtttttcatattttttagataagtttaatataaaagcgatggctccagctactcgggaggctgaggtaggaggattgcttgtggctgggaattcaagacctctctaggc

SEQ ID NO: 68221 - DNA, 601 bp, Human
tttttcattgttttggttttgttttgttttgagacggagttttgctcttgttgcccaggctggagtgcaatggcatgatcttggctcactgcaacctccgcctcctgggttcaagtgattccactgcctcagcctccctagtagctgggattacaggcatgcaccaccacgcccactagttttgtatttttagtagagatagggtttctccatgttggtcaggctgctcttgaactcctgatctcaggtgagccgcccgcctcggcctaccaaagtgctgggattacaggcatgagccacygtgctcagcccagtttttcatattttttagataagtttaatataaaagcgatggctccagctactcgggaggctgaggtaggaggattgcttgtggctgggaattcaagacctctctaggcaacatagtgagacccacctctaaaaaaagaaaaaaaaatttttttaaagaatgagtatctgaattttacttttcactccaacatttatattgacttttgaaatgtttttccttaattttatcattatcaaataagttgttttctgggtatttctatggattcacgtgtatttaatattt

SEQ ID NO: 68222 - DNA, 601 bp, Human
aagtgctgggattacaggcatgagccaccgtgctcagcccagtttttcatattttttagataagtttaatataaaagcgatggctccagctactcgggaggctgaggtaggaggattgcttgtggctgggaattcaagacctctctaggcaacatagtgagacccacctctaaaaaaagaaaaaaaaatttttttaaagaatgagtatctgaattttacttttcactccaacatttatattgacttttgaaatgtttttccttaattttatcattatcaaataagttgttttctgggtatktctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgcgactacatgtttggtaccatactttattgtcttattattaattgaaatttctcttttcagatctcagcaaaggtttcagtttaatctacaagatttcaggtgttgtgctgt

SEQ ID NO: 68223 - DNA, 601 bp, Human
tttttaaagaatgagtatctgaattttacttttcactccaacatttatattgacttttgaaatgtttttccttaattttatcattatcaaataagttgttttctgggtatttctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgckactacatgtttggtaccatactttattgtcttattattaattgaaatttctcttttcagatctcagcaaaggtttcagtttaatctacaagatttcaggtgttgtgctgtcttgggaagaggacattttggaaaggtaatctttttggaattttttggaatatctacaacattaataactcaagtggaaaataattattttaattttatttcaggtgcttttagctgaatataaaaacacaaatgagatgtttgctataaaagccttaaagaaaggagatattgtggctcgagatgaagt

SEQ ID NO: 68224 - DNA, 601 bp, Human
gggtcaaatgttttcctttcctgaaggaatatttgcttttctccagattcttaaatggtaaattcatttattttctaaaataataggaaactgtttactacttctattaatcttgatttacgtgggcttctgctaccttgttacgtctttgtgctgaatctttgtaggaaaatgctttctaatgaaatctatagaaagtttggatcacaggatgatgctgtagccagaatctaggccattacctctactgaaaattaatccagtcttgtgtagagacagggtctcactgtgtcacccacastggagtgcagtagcatgatcctagttcactgcagccttgaattcctgggctcaagccatcctcctgcctcagcttcccattgggaccacaggtgcatacaactgatccatctacatttctttcccccatagtgtcagggtcttggtatgttgtccaggctggtctcaaactcctggcttcaagcgatcctccttggcctcccgaagtgttgtgattataggtgtaagccaccacacccagtcttaacttaaatctccacttttcagtaacatgaaaatttaaaaatctcaagtagaactg

SEQ ID NO: 68225 - DNA, 601 bp, Human
ttataggtgtaagccaccacacccagtcttaacttaaatctccacttttcagtaacatgaaaatttaaaaatctcaagtagaactggtataaaaagagagaaaagaaaaatccaagagtgagaaataaaacacacttttagagaaatttgaggaatgaaggtaagaaaaaggagtacttttaaatttctagcatacctgaaagaaggcaagaaaaaaatttataagtttttttttaagactagctttttttttttgagacggagttttgctcttgttgaccaaactggagtgcaatggcaygaatttggctcactgcaacctctccctttcaggttcaagtgattcttttgcctcagcctccctagtagctgggattacaggcttgcaccaccatgccctgctaattttttgtatttttagtagaaatggggtttcaccatgttagccaggctggtctcaaactcctgagctcaggtgatctgcccgcctcagcctcccaaggtgctggggttacaggcatgagccaccacacccggccaagactagcatatttttaaaagtaatgtatttcattacttgcaagtataaatagtaaataac

SEQ ID NO: 68226 - DNA, 601 bp, Human
tgggaataaggagagaagagtgatgacaatttagagggaaatgttctggacaggatgaataaggcttaaagttttaaataaagttggattgttgcatggacttttagggacaatacacagtttagataatgtgggacaagttgaagattcgtatgtaatagcttttttgtgtgctataaaatgcataaaattaaaattattttgacaatttggatctataaaagagccttgctcctttatctcgctgtcctaagacatctgtgcagatacctcatcattattgtaattcagataattcctrtgaatggcattgaaatcatttcaaggggtagtccagtcaatgggtctcaaatgttttataccacttatatgttccacccagttctaacctaacacctgttcagttgagaacagttgtttcattcataaattcacccataatgaattagtgagtcacccataaataaaaactatggacaggggctggtatggtggttcatacctgtaatctcagtactttgggaggccaaggcaggaggattgcttgagaccagaagttcaagacaagcctgggcaacatagtgagaccctgttcctatca

SEQ ID NO: 68227 - DNA, 601 bp, Human
acaagttgaagattcgtatgtaatagcttttttgtgtgctataaaatgcataaaattaaaattattttgacaatttggatctataaaagagccttgctcctttatctcgctgtcctaagacatctgtgcagatacctcatcattattgtaattcagataattcctgtgaatggcattgaaatcatttcaaggggtagtccagtcaatgggtctcaaatgttttataccacttatatgttccacccagttctaacctaacacctgttcagttgagaacagttgtttcattcataaattcacscataatgaattagtgagtcacccataaataaaaactatggacaggggctggtatggtggttcatacctgtaatctcagtactttgggaggccaaggcaggaggattgcttgagaccagaagttcaagacaagcctgggcaacatagtgagaccctgttcctatcaaaaaaataaaagccaggcatggtagtatgttcctgtagtaccagctactcaggaagctgaggcaggaggttcacttgagcctaggagttcaaggttacagggagccatgatgatatcactgcactccagctcctg

SEQ ID NO: 68228 - DNA, 601 bp, Human
gtcttatttcatctgattattttatctacatttagccaaaattcagattggcttaataaagcagatgttttagaatacatcttactgatcttgtctaaagcaatttttagtacattattttctagtaaatttaaatgatgacaaaaataaaaactgttaactttttaatcttctatgagtttatttataatagtgccttaatctgtagtaacatttagaaagtttgtcaggtatcctctttattttctagtcttttaaattaaaattttatgcagcatatctgtactgttcaacttcataycaattttatatgataaaaaattgaatactatagcttgtgaattatagatactgtctttgaaattaccttcaccacaaacttttaaatttttcaaagtacgctttaaattgctaaattctctgaccaattcctgaagaattttcatatttcacccttaattaagccttttaaaaaatcaactgtaaccactaaccatgtatgtgctatagactatcaatgtgaatgctataatcttttaaagtttctattaatatatttcaactgaagttatttattttaggtaggtcagttttcatagca

SEQ ID NO: 68229 - DNA, 601 bp, Human
ttcagatgagggacataggggttaattctaatgggtactgaagcattttaaaaggagggaaaagccagaaagtagtagaaggctacgaataattcattccctcaatatttaaggcagagcattacaattatgcctaaccttatgctgccatgggaatttgtttggttttattttttatgcttgtttttgtttttaaaataatacataaatgtagtttgccttaagaaactgttatttttgctgagaatataaattatatacaaataaaaccataaagtccagtgaaaatacaagaatacartgctgcattacagaactccaaatctgaaagtacctccctttatcattcagttctcagatcaaaggtcatttctttaaaggtaattttctgagttccctagctaaaatatcacatcactaaccaattcagttcactctattttctgtattatctttttcatatcattttatttctacatgaaatcatctgatttatttttaaaatttttattgtctatcttatttcacttaaaagagaggagcaagaaccatatctgtcctgtttattagtgaaacacctaaaagaatacctggaacatat

SEQ ID NO: 68230 - DNA, 601 bp, Human
tattagtgaaacacctaaaagaatacctggaacatattaggcaatcagtgaatttttattgattgaaaccatagaatcaaaatagcttgatttctagctttgttgtttcatagtctaactttagacaaattatgttttctgagcttcattatctgctctgtaaaatatcttaaggcttgattgaagattaaataagctaataaatgaaaataactgacacaataccggacaaacaggagcattcaataaaatatgtattttagatggtatacgcaattaatcaaggcagtctgtttacaargaaagaaatcagcggggagcggtggctccatgcctataatcccagcactttgggaggcagaggcaggcagatcacttaagctcaggagttctagaccagcctggccaacatggtgaaaccctgtctatactaaaaatacaaaaattagctgggcatggtggcaggcgcctgtaatcccagctatttgggaagctgaggcaggagaaccacttgaaccccagaggcagaggttgcagtgagccaagatcacgtcactgcactccaccctgggcgacagagtgagacccccccaaattaaaa

SEQ ID NO: 68231 - DNA, 601 bp, Human
tcccagagtgctgggattacaggcatgagccaccacacctggccatcttaagcaattttaagctcacgtttattttaataaacttcagtagatccttaaaacttctggtaagttgtttaatttttaatgtataattaagtaagtatttctaagtagttgcattttatttttgttttttatttctgtgttgggaagtctaagccctgatgaaactgcctggtggaccctgaccaccacccctgcagcacaagccccgcgtttaaaaattatagacccgtgctcacttcagcagcacatacamtaaaattggaaccttatagagaagattagcatgacccctgtgcgaggatgacacacaaattcgtgaagcattccatatttttctgaaattgaggcagtaattaatagcctaccaaccaaaaaaagcccaggaccagatggattcacagccaaattctaccacaggtacaaagaggagctggtaccattccttctgaaactattccaaacaatagaaaaagaggggctcctctctaactcactttatgaggccagcatcatcctgataccaaaacctggcagagacaccacaaaaaaagaa

SEQ ID NO: 68232 - DNA, 601 bp, Human
acacctggccatcttaagcaattttaagctcacgtttattttaataaacttcagtagatccttaaaacttctggtaagttgtttaatttttaatgtataattaagtaagtatttctaagtagttgcattttatttttgttttttatttctgtgttgggaagtctaagccctgatgaaactgcctggtggaccctgaccaccacccctgcagcacaagccccgcgtttaaaaattatagacccgtgctcacttcagcagcacatacactaaaattggaaccttatagagaagattagcatgrcccctgtgcgaggatgacacacaaattcgtgaagcattccatatttttctgaaattgaggcagtaattaatagcctaccaaccaaaaaaagcccaggaccagatggattcacagccaaattctaccacaggtacaaagaggagctggtaccattccttctgaaactattccaaacaatagaaaaagaggggctcctctctaactcactttatgaggccagcatcatcctgataccaaaacctggcagagacaccacaaaaaaagaaaatttcaggccaatatccctgatgaacatcgatg

SEQ ID NO: 68233 - DNA, 601 bp, Human
aataaaatacctaggaatacagcttacaagggatgtgaaggacctcttcaaggagaactacaaatcactgcccaaggaaataagagaggacacaaacaaatggaaaaacattccatgctcatggataggaagaatcaatatcttgaaaatggccatactgcccaaagtaatttatagattcaatgctatccccattaagctaccattgactttcttcacagaattagaaaaaactgctttaggctgggtgtggtggctcacgcctgtaatcccagcactttgggaggttgaggcgggtggrtcatttgaggtcaggagtttgagactagcctggccaacatggtgaaaccccgtctctactaaaaatacaaaaattagataggcatggtggtacacgcctgtaatcccagctactcgggagactgagtcaggagaattgcttgaacctgggaggtggaggttgcagtaagcaaagactgtgccactgcactccagcctgggcaacagagtgagactccttctcaaaaaaaaaaaaaaaagaaaaagaagaaactactttaaatttcacatggaaccaaaagagcccgtatagccaagacaa

SEQ ID NO: 68234 - DNA, 601 bp, Human
cacgtgaatacctatgtaacaaacctgtacattctgcacatgtatcccagaacttaaaagtataatttaaaagtaaataaatcaaacaaatcttttcagaaacctatatatatatatatatatatatatatatatatatatatataaatagaaaaaaataaaaatgcgaggcaccatggctcatgcctgtaatcccagcactttgggaggccgaggcgggcagatcacctgaggtcggaagttcgagaccagcctgaccacatggagaaaccccgtctccactaaaaatacaaaattagcygggcgtggtggcacatgcctataatcccagctactcaggaggctgaggcaagaaaatcacttgaactggggaggtgggggttgcggtgagctgagattgtgcaattgcactccagcttgggcaacaagagcaaaactccatctcaaaaaaaaaataaataaaataaataaataaaaattattgacccatttttaataaaaataggtaaatataaaacatagctatattatctacatgtgaatgtaaatatattctgaaagtttggaataacattaaagtgacaagaattgttatctgtat

SEQ ID NO: 68235 - DNA, 601 bp, Human
ataaataaataaaaattattgacccatttttaataaaaataggtaaatataaaacatagctatattatctacatgtgaatgtaaatatattctgaaagtttggaataacattaaagtgacaagaattgttatctgtatgaacggcagtggaatgaggtgagatggagatagatggattaaatagtgtactttggagaagcatattacgttttatagagaaaatattcatgttattacttttataattaaaaactaattatcctaagggtctgttcataggctattctacactgaagacatwtgcatttttaaatctattcatttatttcctccttgttcaataagcctatcatgtatattaggcattatgctaatgcatttaggataaaaattgaaaaagtcaaacatggtcctgcgcctcaagaattattctctctcaacccaggttttttgagatccaaacctgcatacccagcttttacatatcatcacctgccccacagacaaagtcaacctgtcaaatgccaaacttagttttgtcacacaaccttggctacctctatgtttctttatctgttcattctaagatggaaaccttgaa

SEQ ID NO: 68236 - DNA, 601 bp, Human
ataggtaagttaatttttaattttttctaatggcttgctttggtatgatttagaattaaagatagtattttgtttttcttaaacattttatgtttaaccagtttcttagttttctccttcacctgtaagtcaaaccccaatgttgaaagacgtggttagcactatgattatatgatgaactttttgtttcctaatccatagcacattttctaattaaaatagtcaaattatgagttggtctatgatagtgcatttctcaacaatattcatcctagtgaatattttgcattcaaacgactcrttgcagaaaacctctatagaccaatactactaaaaacgtgtccatgatgagacaagtagcttgtgttagagtgtaaaacatcacactgcttccctcattaagaagccttattgtcaactgaactaaatagtgtattggtgatgtagctgatctctgtaattcgtggcccagcagctagtttgtgaaccacaccttgactaacactcactgcccaggaccaagcagattatgagaaggctagtcagaattagaagactataaacattggattatttaagctttttttttttttttttgaga

SEQ ID NO: 68237 - DNA, 601 bp, Human
gggtgacaaagtgagactctgtctcaaaaaaaaaaaaaaaaaaaggattaaattagattatcacaaataacaaattaaatacatttttccttttttatgtaacaggagaagaatttctcatgagctaccttatatagagtaataaacttaccaaaaggaagaaaactgaatgtttgtgttatagtatttaaatctcaaatcataacttggaaatcccatttttaataaagagaaaacacagttccaattgcaattatttttttaactgtataacctactgatttctttgatttttttttttcatgctgtatctttttatcctgaacagagatttgaaattggataacttattgctagatacagagggctttgtgaaaattgctgattttggtctttgcaaagaaggtaatcgaatgtttttaagtttcttttctgattcagaattactgtttctttgtgcatcagtagttttcaagtttgtctatggaaaacaaactgtacttttaactttattcttcattaagacattgtagatacaatgaaaacattgcttatataacctaattatcacattaagaatttgttctctgaatacaaataa

SEQ ID NO: 68238 - DNA, 601 bp, Human
taggcactaaacagttctaggtttgaatcgtggctttgccactatttgctgtttgtctttggaaaacttagttttaacctctttgagtcttatttccccaattataaaaaaatggacatagttctttctgtttactagttactaacattctctatctccctctgcactggtggcttctgtttgctatttagctttgtttccatagtgcataacacagtgcatggtacatcttaagtattcagtaagtgtttgattaataagtagttggatgaataaatgaatgaactctgtagatatatgyccatcacatacccactgacctaattgctgaatcaagtaagttttttcttgactgggcttctttttattggacactgttcctctaaatgcttttgtttctcagcatctctccttagccggctgctcttcactgcaattttttgactagcagctatatcctaatgactcccaaatctattatttcctttcctatggattccaaagatatatattcaactgtctactagacagctctgcctgaatagtgaagagacacctcaaacactacccaaacaaaaatcatttattttccgccggtagt

SEQ ID NO: 68239 - DNA, 601 bp, Human
atttatagggtagaagtgcaattttgttacatgcataaattgcatagtggtgaaatcaaggcttttaggatattcgtcacccaaataacatacattgtacctattaagtaatttctcatcatccaccccccttccacctcctcacccttctgagtcttccttgtcttatcattccacactggtagatggtattattaactctcatatacagatgaagaaacctagaatttgatgttagacaactttcccaacctcccacagttaacaaatgacagaactggaacttaaaccaggtatttaytaatctagagcctgatattaaccacttccatggagttttaccagtctacaagaaacataagttatatttcttcattaattaactttttcctagttttctccaagttactaaaaggctggtgcagaacttacatagatattaatactatatcactgtttttttaaataatattttattgaagaaaataaaaatcattatgatagtgttaaagaaattttgccaaaaaaaaatttctccactccagtgtgctaatgtatctaattgtgcccttcaggtcttggttcatagacacacattcat

SEQ ID NO: 68240 - DNA, 601 bp, Human
gattcctgaattcccagttgcacctgaagttgctatagaactgctgatggctgtgaacttcctagattgttaaataaaatataattttaaaaaaatgaaagaagtgttaccttaaaaaatggtagagttgaaaaaattcgcattttttcctactgttttctgtagattaacttaaatttctgaggataattgagttgtacatagaaattattactattaggaaacagtgagttatgttaaggcaataataggagactaataatttattatgttataaattgttagaaatgttgaattgggrtgaaattgggaaagagtaaatcttttaataagtaattgaagattacttgaagggacttgaactggagatgcaagaaaaattattttaagggattggttcattattctgcagtttccccatgccagcaacctcccttgtacacttgtaagtttgaagaagttagtgctgaatgaacaaattatcaaattgaatatcagaaatttctaaagttttgttctatgcttgtcatttattggcacttaccccaaacaaatggttttagtttcgccggatggataaccccttttggtatgtcaattt

SEQ ID NO: 68241 - DNA, 601 bp, Human
ttgtacacttgtaagtttgaagaagttagtgctgaatgaacaaattatcaaattgaatatcagaaatttctaaagttttgttctatgcttgtcatttattggcacttaccccaaacaaatggttttagtttcgccggatggataaccccttttggtatgtcaatttgaagtggattccttggaaaaggaggagaagtatggctaattaaaatttatcatgtgctaagcactgtactgtatgccttaaatattagttcatttaattttgcaacagcctttaataagctcagtactgatcttmtgcccattttcggaggtgtaaatagagacacaaagagattaatgacttgcttaaagtcacacagctctcatatggtggagctggaattttaaccttgtcactctggctccagagcatatctaaagcattatgctttgctgctccaggacaggatcttcaattcatccagccttgtttctgttcttaagactagtggtccagatctgaatttttcacctctatttagaaaagctgttgtgcagtgtttaggttggaaagatttattttagctccagtccacagtggcttttactttctgag

SEQ ID NO: 68242 - DNA, 601 bp, Human
cagaaatttctaaagttttgttctatgcttgtcatttattggcacttaccccaaacaaatggttttagtttcgccggatggataaccccttttggtatgtcaatttgaagtggattccttggaaaaggaggagaagtatggctaattaaaatttatcatgtgctaagcactgtactgtatgccttaaatattagttcatttaattttgcaacagcctttaataagctcagtactgatcttatgcccattttcggaggtgtaaatagagacacaaagagattaatgacttgcttaaagtcasacagctctcatatggtggagctggaattttaaccttgtcactctggctccagagcatatctaaagcattatgctttgctgctccaggacaggatcttcaattcatccagccttgtttctgttcttaagactagtggtccagatctgaatttttcacctctatttagaaaagctgttgtgcagtgtttaggttggaaagatttattttagctccagtccacagtggcttttactttctgagagtgccagaagttctcataaaatagttaatctgctgtaagctctggcatacttgaactcc

SEQ ID NO: 68243 - DNA, 601 bp, Human
agtgataactcctttttaactatgatgaaagtaaggtgtggctaaagtttatgtcagatttctctattattacaaataattgtaaactcaccggatatattatacatgttcagatttgtatacttctactagttttgattactggaaagactccaggaataaacaaacatcgcaagtcccctttttcctgtctcagatgggagtgaagataccagagagattgaacagaatgctggacatggttttagatactgtcagtgttgacatctgaacagactattggtttcctttaaatgtgctkaaaacacatttgttagctttcagttgttagccctgtttgcttacaatctatttgcagaaaaaagatactacatattttaacaaatgtatagatatttctttgctgttcagacttgtagaatgagttttcaagtaaaaattgttcaagcagaagaccaaagtgctgtctttgtattatccattgaaattcccattgagaatcctagtaaaataaaattttcttctgacttactgtttcagtccccagaagaaattagattgtccatgtagtacatttgatttatgtattttgagtgtacta

SEQ ID NO: 68244 - DNA, 601 bp, Human
agatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttygtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagt

SEQ ID NO: 68245 - DNA, 601 bp, Human
attacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatg

SEQ ID NO: 68246 - DNA, 601 bp, Human
gcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatwtatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatact

SEQ ID NO: 68247 - DNA, 601 bp, Human
ggcccgtggctcgggtgggaggtgtccatccagcttggcccgagcttcggtggtcagcgcgcatttctcttgagggtcatcggtggtgaccttttgactttttcaccccaccctcccatctctttgtctcgcatttgtgttcccgattcagagatggtagaaccaagtccattttaaagtaccctgatgaacactttccgtttttatttctgaaagttccctgcttggtctttactgcgaatttaataacatgttgactacatggcattgtccagtgattactatttttacctctgaaatycagcgatctttccagtagaattctggtccgtcagtccattgtgttttgagataagcatccagcaagtacctccttggcaattagaacatctgttttttcattcattcattcattcagcagctgtttagtaccgtactcagatgaagaggtttggtgtgaaggtaaagtatcctttcatggaagaggatgctttgactgaagtataatagatggacctttaaatgagacagttacataagtgatgtctgttaaggaaggtatggttatattctgggtcattttttaagcagtatatctgga

SEQ ID NO: 68248 - DNA, 601 bp, Human
gtgggaggtgtccatccagcttggcccgagcttcggtggtcagcgcgcatttctcttgagggtcatcggtggtgaccttttgactttttcaccccaccctcccatctctttgtctcgcatttgtgttcccgattcagagatggtagaaccaagtccattttaaagtaccctgatgaacactttccgtttttatttctgaaagttccctgcttggtctttactgcgaatttaataacatgttgactacatggcattgtccagtgattactatttttacctctgaaattcagcgatctttccrgtagaattctggtccgtcagtccattgtgttttgagataagcatccagcaagtacctccttggcaattagaacatctgttttttcattcattcattcattcagcagctgtttagtaccgtactcagatgaagaggtttggtgtgaaggtaaagtatcctttcatggaagaggatgctttgactgaagtataatagatggacctttaaatgagacagttacataagtgatgtctgttaaggaaggtatggttatattctgggtcattttttaagcagtatatctggaagttcaagtgtaat

SEQ ID NO: 68249 - DNA, 601 bp, Human
cttccttttcagaagtttttttctggcttctatcttgtttattttatatgaacttctaaaaacaacccatctagtctagtctgtacccctcctctgccagtctttctgttggaatcactttttttattttattgtggtaaaattatgcacagctagatgcacaagcattacagtccaataagtttgcctttgtatacacttgtgcaatcccagatcaaaatacagaacacttccatcacccagaaccttttcttacatccttttcaagttaccttgctccccagtgattggcttctattamatggattcagtgtactgttaggatttctttgtatttatagaataagtgacagctttatgatgtacctttatatccaagaataggaaaaacaaccttttcatttgttgaagtctcattttgagttcctgatagcatttttaaacattaaaatttttttttgctgttttatatatttaagttttttttttttttgctggaaatggcatctttttttccacttttatcttctatctggttatatataagaaagctttttattttgtatattagttaatattttatatattaaataataagccc

SEQ ID NO: 68250 - DNA, 601 bp, Human
tatacacttgtgcaatcccagatcaaaatacagaacacttccatcacccagaaccttttcttacatccttttcaagttaccttgctccccagtgattggcttctattacatggattcagtgtactgttaggatttctttgtatttatagaataagtgacagctttatgatgtacctttatatccaagaataggaaaaacaaccttttcatttgttgaagtctcattttgagttcctgatagcatttttaaacattaaaatttttttttgctgttttatatatttaagttttttttttttttgctggaaatggcatctttttttccacttttatcttctatctggttatatataagaaagctttttattttgtatattagttaatattttatatattaaataataagccccctgtagaatatttattatttctaatagttttgtagttgaattttttatttttcttatgtcatgccagcttttttgtttcctttgatttttacctcctccctcccccaactttttatactcttatattttttcttattgcatttatagtggtgattttagaagattatagttttcctccattatatgtaaaa

SEQ ID NO: 68251 - DNA, 601 bp, Human
tcacaaattgggaatttcagaaggccaagtaaaggaattaggaggatgaagaattgagtcaaatggaggacgtacacagcagtgtggcagtgagaattcagagaataatagataaccagggagagctggattttttctggtgaccataagcagggatgtgaggtatgagaggattagtcctgatacaggagatggtggttatcacttttagtgttgtaggactctgtggcagtgctttcagactgttactcatgacccattagtaggttatagaattttgggagatcacaatttctgttaygttgttaaaagaaatgaaatagaaaataccatagtgtgtcatgtgtaataagggactaagaattttttaacggttttattgagatataattcacataccattatagttatctatttgaaatatacagctcaaagcttttttagtatattcctggaataatggagccatcatcacagcctaactttagaacatgtttgtcaccccagaaagtaacctcatactcactagcagtcactccccatttcttcacacacaccccctcctctccctggccctaaacagccacttacccactttctt

SEQ ID NO: 68252 - DNA, 601 bp, Human
tacgttgtaagagtttttttttttttttttttttttaagagatggggttcttgctctgtcacccatcctggagtgcagtgatgcaacctgggctcactgcagcctcaaactcttgtacacaaatgatcctccctccccagcctcacaagtagctaggaccacaggtgtgccctgctaatttttaaaattttttgtagagatggggtctcactgtgccgcctaggtgctgtaactcctgggctcaagtgatcctcccaccttggcctccaaaagtgctgggattacaaacatgagcttcctygcctggccaaagagttctttatatattatagatacaagttgcataacagatgtatggtttataaatattttctcctgtttcagaggtagtctttttactttcttgatggcatcatttgtagcacaaaaagttttaatttcaataaagaaatccaatgtatttgtttttcccttgtgcttttggaatcttttataagaagccaatgcttaactcaaggtcatgaagacaacttctgcattttcttctgagttttatagttttagctcttacatttaggtctgtgatccattttgagttaat

SEQ ID NO: 68253 - DNA, 601 bp, Human
ttcagggggagaaatggccccggatgccagactcccttatgagcttttccttactctcccagatcttggtcttcatgctttttcactaccttggcactctgatgccctcaaacaggttttttggttttgatttttaaaacattttttctggggacttgggcaggtgtccagtttttctagttgctctcagtacgataattggtttgaattatctagttcaccattttaaggaaagcgatttgttaggttgatcaaggtttatgtcataagattctctgtttgaaattgtagtatatgtggkttcagtttttcctgagggtaagattttgggtaccagtttctacagattatagaaattattagaaaagggggaaatagccttaggaatagaaatgggagggaaaatggcagagaaaactagatatttttgcaaagtttgggaaagataaaggtatagggtaacattttcatgtctattaggagtgtaaaagggcattcatgtatcaaaggcgctgacatatttgttgtaatgatattgtcataattaaaaggctgtagaatctaggtattgtgggggtggctttgagaagtatctacttag

SEQ ID NO: 68254 - DNA, 601 bp, Human
gtgcatgagccatgcaatttgtcacatccgcaggctgactgccagtacttagatttgtttctcggtctagaatggatggattgtcattggtgatgagtataggattgcattctaaattgtggcagttatttggcagggagcccttggacagatgtagtttattcttcaagggtctccagcttagagttacccaccccgtttactgtccaaccctgaaaatgggtagtctaccatacatcatcccagctgggtggggcaggatgatgctctactgtaacctgtatctggttcagggcaaagrtacttatctgcctgcgagagctatccctgattttccaaattcccacaaggtaagacctggcaggcatcaaatcttacagtctgggatgctactgtcttggttacactaattaccaacctcattggatagggaggagtcccctgccagtttccattttgaccttctgctttttgtatagtagcccatcccagccatattaacttcgagaaatggggccaacccatgttttctttttagatttttctcagagttaactttaagggttcctcagtgcactttccactggtcttttcccctccc

SEQ ID NO: 68255 - DNA, 601 bp, Human
aggctaaatagtctaatttcttcctccagggaggcttgcttagcagcttcagctgcaaacctgtttgctacagcttctgtggtgttccctttctgaaaaccatttacatgaactatggctacctctgctggaagcaagaggctttctaaaacctgtttggccagttccaaatgtaccaattattttctcctgctatttattaggccccactctgtccagatttttccaaaagtgtgtaccactttggattttaagtaggcatacttaaattcagtgtatatagtgcctttttggccttcarggagctttagggcctggttaagagcataataattcacaggtttgggctaaccagcaattaggtaatcttcctttctcacataaggagtgtttatttccatcaatgacaccatcactgttatgtcccttgccatctgtcactggagacagcccatccacaaacagccttatctcatcatgtagtagagcttccctaaggtctggtctaactttggtttggtattctatgatacctaagcagttatgatctgatgtctctttgttctcctctcctttccctagaaaactgtctggattcagg

SEQ ID NO: 68256 - DNA, 601 bp, Human
tgttccgggcgcctctgctcctctttgctggggcctgcacctttcctggctgctgactcatagatgtcagagctgcaggacggctccacagaagccctgtgtttaggacacctcattagtgaaggagagtggagagtaaacccaagggactatccagaggaatgtcagatggagtctctttggctccctctttcctttgtcccctaagcctagaatttctgtttctcattttcagtcagtctctgtgtctgagcttttccctgtgtactcaactccccaactggaggtttcttgcacaccycgagaatcgctttgtctgtctctggccgtttccctcgcagaacggaactgcagattgggactctgcacttgccttatatctgggatacgtctcagtcacacacactcgacctccaaaaatgcccaaccaccaaggcagtacttagagtccaattttcctaccttggcttgtgcatgaggtttcctggttgctgcagtgcctgcttttctccgtatgtcacctccactgcctcctgaataacagtctcaggtttgtctatggcctttgcaaggagctgggacactcagacagagcgggcca

SEQ ID NO: 68257 - DNA, 601 bp, Human
gtgcagaaaagctggcaatccagaaatgttgggcacagacaaaagccccaggaaaaaaatgatgctctttagctggggaccaggaaaagggtagcctagcaagacagaaaataaccacttcagccaaagaacatagaagagtcaccctgattagcaaagaccaagtgaggacctagactttcacagtgtttaggctgtaacaagacaactcctcactccatagtggcagcagagccaatatgggaagcagtaaccataggcagggagcctgaactcccacgtatgcttaatatgagtcccktcttcccttcacccccaagttctttggtatacaaaagcctgtgggcggcaagccacccaggcaccgaggcaagagacaggggacacgagctgttccagtataataaaatataaaacaagaatagttataccagatatagatcttagatatgattatatatgaatatcattaatcattagtttgtagcaattactttttattccaatattatgataatcctcactctataatcatagtctaggaaaaaccaggccatacagagataggagctgaggggacatagtgaggtgtgaccagaag

SEQ ID NO: 68258 - DNA, 601 bp, Human
cattaatcattagtttgtagcaattactttttattccaatattatgataatcctcactctataatcatagtctaggaaaaaccaggccatacagagataggagctgaggggacatagtgaggtgtgaccagaagacaagagtgcaagccttctgttatgcccggacagggccaccagagggctccttggtctggcagtgacgccagcgtctgggaagacgcccgttaccaggcggatcgtggtccagcagtagcaaaaggtgtcaaggaacaacacccgctccttagcagactgggaagcrggggggagggtctccttttccccgggggagtttagagaagactttgctcctccacctcttgtggagggcctgacatcagtcaggctctcccgcagttatccggaggcctaaccgtctccctgtgatgctgtgcttcagtggtcccactcctagtctgccttcatgttccatcctgtacacctggctctgccttccagatagcagtagtaaattagtgaaaatactgatagtccctgatatgcagaaataatggcgtaagctgtctttctctgtctcctctccctctctgtctcctctccc

SEQ ID NO: 68259 - DNA, 601 bp, Human
gtagcaattactttttattccaatattatgataatcctcactctataatcatagtctaggaaaaaccaggccatacagagataggagctgaggggacatagtgaggtgtgaccagaagacaagagtgcaagccttctgttatgcccggacagggccaccagagggctccttggtctggcagtgacgccagcgtctgggaagacgcccgttaccaggcggatcgtggtccagcagtagcaaaaggtgtcaaggaacaacacccgctccttagcagactgggaagcaggggggagggtctccytttccccgggggagtttagagaagactttgctcctccacctcttgtggagggcctgacatcagtcaggctctcccgcagttatccggaggcctaaccgtctccctgtgatgctgtgcttcagtggtcccactcctagtctgccttcatgttccatcctgtacacctggctctgccttccagatagcagtagtaaattagtgaaaatactgatagtccctgatatgcagaaataatggcgtaagctgtctttctctgtctcctctccctctctgtctcctctccctctctgcctcagctgc

SEQ ID NO: 68260 - DNA, 601 bp, Human
agagataggagctgaggggacatagtgaggtgtgaccagaagacaagagtgcaagccttctgttatgcccggacagggccaccagagggctccttggtctggcagtgacgccagcgtctgggaagacgcccgttaccaggcggatcgtggtccagcagtagcaaaaggtgtcaaggaacaacacccgctccttagcagactgggaagcaggggggagggtctccttttccccgggggagtttagagaagactttgctcctccacctcttgtggagggcctgacatcagtcaggctctcccrcagttatccggaggcctaaccgtctccctgtgatgctgtgcttcagtggtcccactcctagtctgccttcatgttccatcctgtacacctggctctgccttccagatagcagtagtaaattagtgaaaatactgatagtccctgatatgcagaaataatggcgtaagctgtctttctctgtctcctctccctctctgtctcctctccctctctgcctcagctgccaggcagggaagggccccctgtccagtggacatgtgacccacgtgaccttacctatcattggaggtgactcacatt

SEQ ID NO: 68261 - DNA, 601 bp, Human
agaccacagtgcaaacaaattagaactcaggattaagaaactcgctcaaaaccacacaactacatggaaaccgaacaacttgctcctgaatgactactgggtaaataatgaaattaaggcagaagtaaataagttctttgaaaccaatgagaacaaagacacaatgtatcagaatctctgggacacagctaaagcagtgtttagaaggaaatttatagcactaaatgcccacaggagaaagcaggaaagatctaaaatcgacaccctaacatcacaattaaaagaactagagaagcaagaygaaacaagttcaaaagctagcagaagacaagaaataactaagatcagagcagaactgaaggagatacagacacggaaaacccctcaaaaaatcagtgaatccaggagctggttgtttgaaaagattaacaaaatagactgctagtcagactaataaagaagaaaagataaaagaatcaaatagacaaaataaaaaatgataaaggtgatatcaccactgatcccacagaaatacaaactaccgtcagagaatactataaacacctctatgcaaataaactagaaaatctagaagaaatgg

SEQ ID NO: 68262 - DNA, 601 bp, Human
aagggaaggtacaggatgtctgggaaattgtctgtgacatttaaactggtttttgcccagggggcatttgccaaatctggtttcctttcctcagcatcagagagcattgaggaacctgaggaaataataaggtctttctttctgggatgatgaatctgatacgttcttcctcttcaccttaaagctgagactcagctaaactggaaaccaccaccaatcccaccatccttcaagattgcagggaaagttgattttctgcatgcttcttagtttttaatgtgcatcagaatcacatggaggwcttgttaaaacaaagattgctgggcaacatccccagagtgtaagattcagtaggtctggggtgagacttttaaaatttgtacctctaataagtttccagatgatagtgattttgctggtcgggaaccacactgcaaaaattatttgtatagctaaaaccttgtcggagtgaatatgggggcaagatcactgctgagaattttaagcaaccagctgacccttgtataatttgcagtgcgaatttaacgctgtgtaggtgatctaaaaaaaaaaaagaaaaagaattccctaagataattta

SEQ ID NO: 68263 - DNA, 601 bp, Human
ttaatgtgcatcagaatcacatggaggtcttgttaaaacaaagattgctgggcaacatccccagagtgtaagattcagtaggtctggggtgagacttttaaaatttgtacctctaataagtttccagatgatagtgattttgctggtcgggaaccacactgcaaaaattatttgtatagctaaaaccttgtcggagtgaatatgggggcaagatcactgctgagaattttaagcaaccagctgacccttgtataatttgcagtgcgaatttaacgctgtgtaggtgatctaaaaaaaaaamagaaaaagaattccctaagataatttatccccataatggcagtatacatagactggcagtgagtatccccagactcttgtagaagctaacagaaattctctttggagaaactcatctccatcccagagttgaaagttttcctagaaataaaattctaagtaagtagaacaactgtgatagtcaaaaagaaaaacataaagaaactaagcactgtgagcaggactcaacagcagacctgctggaaaataggaataggcagctacagaatatgaagtaagtgtttcatatgtttcaacaaaa

SEQ ID NO: 68264 - DNA, 601 bp, Human
tcggatagacacatgaaaaaaaataaattggataccttcctcacatcgtataaaaatcagttccaggttgaataaatacctctatgtaaaagccaacaactgtataaagcttttaataacataaagagcatattatccatgattttaaggctggaaagattcttaatcaagacacagaaagcatgaaaaggattgatcggttcagctacattgttttggaactcatctttgccagaaatctttataaggggagtgagacagcaagcctccaactagagaagatatttgcaacacataattkagaaaggactgttacaaattaaccgggtttggcagtatgcacctgtaatcccactttcttgggaggctgaggcaccagaatcacttgaacctgggagatgtaggttgcagtgagccgagatcgtgtcactgcactccagcctgggctacaaagtgagactctgtctaaaagaaaaaaaaagaagaaggtgtaaagaactcgaacagttgaactagaaagagacttcaaaaataggaaaactgaaaggaaagtatacagaaaagatgcccagtctccttagtatttaagagaagtgcagac

SEQ ID NO: 68265 - DNA, 601 bp, Human
ttcctcacatcgtataaaaatcagttccaggttgaataaatacctctatgtaaaagccaacaactgtataaagcttttaataacataaagagcatattatccatgattttaaggctggaaagattcttaatcaagacacagaaagcatgaaaaggattgatcggttcagctacattgttttggaactcatctttgccagaaatctttataaggggagtgagacagcaagcctccaactagagaagatatttgcaacacataattgagaaaggactgttacaaattaaccgggtttggcagyatgcacctgtaatcccactttcttgggaggctgaggcaccagaatcacttgaacctgggagatgtaggttgcagtgagccgagatcgtgtcactgcactccagcctgggctacaaagtgagactctgtctaaaagaaaaaaaaagaagaaggtgtaaagaactcgaacagttgaactagaaagagacttcaaaaataggaaaactgaaaggaaagtatacagaaaagatgcccagtctccttagtatttaagagaagtgcagactaaaaccaagtgagatattagttacatttaaaagtc

SEQ ID NO: 68266 - DNA, 601 bp, Human
catgtccttttctagggtgaaaacagccactgaacatgaattatttcagtttacctttcctaggcttgaatgcttccctgttgctttcagaataatacttatacttttaaaaaaggaaatgtattatagctatcatcactttcacactttaaagcaaataaagtttttaccacttcatactactaacattgctctctcttgtactattatacttctctaagttttcctttctaccctgatgaccgttgtgcatttcttcttccatccttgcctttcttctttctttcccctggggcgtagsggggagcttacatataggtcttccctaaggtgctgtccttagtctgcatctttcttcttactaatttgtatgtaaaatgagaatttatatgacacagtaagtatgttttctacttgggttaataatatcactacccttcctggcatgcagactgaaatttcttgagttctagcttcttcctcattgcctgtatagccagttgactagcaaatttcattgattctttccaaaacttcagaaaattttcctcattttcattgacatgaccagctttatttgccttgcttaatgtcctcagat

SEQ ID NO: 68267 - DNA, 601 bp, Human
acaattctcctgcctcagcctcctgagtagctgggattacaggcgcctgccaccacgcccagctgatttttgtatttttagtatggacagggtttcaccatgttggccaggctggtctcgaactcctgacttcatgatccgcccacttcggcctcccaaagggttgggattacaggcgtgaaccgccacacctagcgtggtatttattttttagaaatggggcctcgctgtgttgcccagactggagtgcagtagctattcactggcctgaacataatgcactgcagccttgaactcttgrcgtctagccatcctcacgcctcagcctcctgagtactgaaaattttaaggtcattttgccttcagtcccacatgggagcaggagtcctaggtgagctggggttgccataaccataattgaatgtgagtcccctggcagaaaggtaacctccttttctttatatgcgctcatagaaattcatttatctattcctatttctcttttctccccacctttggctttggtagctggagctggtaagaaatctttcttattttctgtaatgtgttttataaattatgtgtggtctaatgattatat

SEQ ID NO: 68268 - DNA, 601 bp, Human
gggattacaggcgtgaaccgccacacctagcgtggtatttattttttagaaatggggcctcgctgtgttgcccagactggagtgcagtagctattcactggcctgaacataatgcactgcagccttgaactcttggcgtctagccatcctcacgcctcagcctcctgagtactgaaaattttaaggtcattttgccttcagtcccacatgggagcaggagtcctaggtgagctggggttgccataaccataattgaatgtgagtcccctggcagaaaggtaacctccttttctttatatgmgctcatagaaattcatttatctattcctatttctcttttctccccacctttggctttggtagctggagctggtaagaaatctttcttattttctgtaatgtgttttataaattatgtgtggtctaatgattatatggttgtaagaaaaataccataaaggaagagtgtttgtccttagttttcatctttagttatccataaaatctgaactctaccctgaaaaatttgtcgtcattgtatttttcatctttcctcgatatctacttgttagttcaatactatcttttatcaattttaatg

SEQ ID NO: 68269 - DNA, 601 bp, Human
caagggtacctttccaagtgactcaccaaaaccaataagccttaagaaaaatttttatgacttgaccaaggatgcacaagccatctccaaagaggtgcaaagcaagccctcacaagatccagaaccaccccaaagacagtttaaataatgaaagtcttggtagccacaaataaggtgcaaatccacatttttgcttgactgtactctctagggtttcagctgatggcagacagaagaagacaggaaatcaaaagctgttcatggaagggaaaaggatcagtaacaaatgggtaccctaaarggtcaagagtcatattaatattgtaataattgaaaatattcaaattcttgtaaatgtttctctcctaagctaaagatattaaccaaagaaaggaattttttgttgttctaaagaattttaactctgttttagatcttatctcagctggaatgctgcttggctaattccctgcatgttaacatttcaaacacatgataagatttatctctccaaggtactgtgaactccagctgggcattaaaggatatcatcagtgccatttattagtcctggttttgaaaaaaaaaagttgttagatct

SEQ ID NO: 68270 - DNA, 601 bp, Human
tatctaatatgtaatagatatataatatcacacttggaaattgcactttttctcagtcttttgatgatacttttttatggtagtgacacactaatatctccatccgtatggccacacatgtgctctggatcccattcttttcttcctttttggaaataatatgctatctgagaaacctattttctttctcattcccccattctcactcttcctctctttattggatcctttttgttagcatataaacatgttcaggttgtctctatgttatatgtgttatactatgctatatcatatatamtatataatctaattatcctcccttgaccatttactcctctttatctatttcatctttggtcttctttgttaaacttctctaaagaagtagctatatccagtttccttataaatttcccagttacatggcagctcattttaatctagcttctgctgcgttcgctctactcaaatggcttatttgacacctctgttaaaatcaatgctattagccattttgttctttaaaacactctcttcctttggcttcttcagtatgttcttgttttctgtctaggtctctggctgcatcttctgtggc

SEQ ID NO: 68271 - DNA, 601 bp, Human
ctgtggcttccttgtcagctcatctttctccagttgctcattaaatgtggttgttataaagctgaatcttaggtatctttttacttaacgactactcttgaataacttgtctctcattgctccagttacagtgacaactcctacatttatctttcaccgagactactcatctgggatccagttctatatctagataccaaattgatatttccatttgaatgtcttaaagttatctcagactcaacaggtttaagacttacaacttctcttcctccatattctctttatcttcaagattatwtttttggactcattgtagtccaaaatttgaaggactcaaattctctaccccttacattgtaaccatagtcaattaatcattctaagattcagtttcataatctgtaagatggaaaaaatgtagtacctttcctaacataaggaaacatcagacaaaatgtgaatatgggatgtaataccacggactagatttaccctctagctgtaaacaaatagaaaaccctcctagggttgttttcagtattaaaatagtatttacaaagcccttgaaacaggaccccatgtaaagtaagattttttt

SEQ ID NO: 68272 - DNA, 601 bp, Human
aatgtatccaagtctaattcctcatttgtttctagtttatttgtcctcggttttacagcttacatagtttggagtttcctgtttagttttgtttatttttaactcctttaggcctaagactcttcattgtttctctttcatctgagtcattataatagtctctcaaaagttcatattccactcttgctccccctttctcctgcagtacaatctacatgtcgcagccaaggatcaggtcaaggcattctcatgctctctccagtggctcaccttcttacctagtttgtgatctggccccagracatgcagactgcctagtaggcaattaatatctgctgaattaattctttgtattgtaagtcatatcaggatttcttgggggttagcattatcttaaaaccacaaaaaacaataactttagacctaattggtttcatgacttattgaggaggcgaggaataggttaaagctgctttgcatacattttggaatagtctcttttgtctagtaaggatggataagtttgttaataaccagtattcacatgggtagaaaaaaagtgtcttgatttttaatcctacaagtagtaaaggaatggtag

SEQ ID NO: 68273 - DNA, 601 bp, Human
ttgggggttagcattatcttaaaaccacaaaaaacaataactttagacctaattggtttcatgacttattgaggaggcgaggaataggttaaagctgctttgcatacattttggaatagtctcttttgtctagtaaggatggataagtttgttaataaccagtattcacatgggtagaaaaaaagtgtcttgatttttaatcctacaagtagtaaaggaatggtagtcagaagttgaatcgtacttttaatgcctcaggcaggatagaatagtattgttttgttttgtatcccaatatgcctaactacttctctctctctcctttctgttttgcttctcatcctttcacccattacagtctcagtatgtgtgttacaccaggaggttgccttggcaggtcagaggatctgtcacagtgaaggcactgtggtaccctttgttttttaggcaaggatgacacatgctagtcaacttatttccatttgttgttccctccacttggcactaaatgagacttaaccatttttgaatcaaagtttataaatttcttacaaaaattaaggtttttattctctataataagcacatgagaaagactggt

SEQ ID NO: 68274 - DNA, 601 bp, Human
agaattattcagcaaatcttttgagtagaatttatatgctttttttttttttgagggagtctaccaggctggagtgcggtggtgcgatcttggctcactgcaacttccgcctcccaggttcaagtgattcccttgccttagcctctcaagtagctgggactacaggtgtgcaccatcacacccagctaatttttttgtattttagtagaggcggagtttcactgtgttggccaggatggtctcgatctcctgacctcatgatccacccaccttgacctcccaaagtgctgggattacaggygtgagccactgcacccagcctcgtatgcattctttatcctaccttttcttgatggaagtacaaggttaaggatttatttaggctttaggctatctagtggagctaaataattatggatttgtacattgagtgcccacgatgtactaggtggatctttgaggcaacacaacgaacatgcagggtctctgttggcatagtccactgtctatttggatccattagcattttaggaaataggtgcaaaaaaatatatgttgtaatagatatagaagacacatgttgagcgtcatagacttggaa

SEQ ID NO: 68275 - DNA, 601 bp, Human
tcactgcaacttccgcctcccaggttcaagtgattcccttgccttagcctctcaagtagctgggactacaggtgtgcaccatcacacccagctaatttttttgtattttagtagaggcggagtttcactgtgttggccaggatggtctcgatctcctgacctcatgatccacccaccttgacctcccaaagtgctgggattacaggcgtgagccactgcacccagcctcgtatgcattctttatcctaccttttcttgatggaagtacaaggttaaggatttatttaggctttaggctatstagtggagctaaataattatggatttgtacattgagtgcccacgatgtactaggtggatctttgaggcaacacaacgaacatgcagggtctctgttggcatagtccactgtctatttggatccattagcattttaggaaataggtgcaaaaaaatatatgttgtaatagatatagaagacacatgttgagcgtcatagacttggaagggatccagttacttgtctttggagaaagtgagaaatgtatatgactgtttcatgaattcagtttacagatttttgcttgaagtttttttgtgt

SEQ ID NO: 68276 - DNA, 601 bp, Human
gtctcgatctcctgacctcatgatccacccaccttgacctcccaaagtgctgggattacaggcgtgagccactgcacccagcctcgtatgcattctttatcctaccttttcttgatggaagtacaaggttaaggatttatttaggctttaggctatctagtggagctaaataattatggatttgtacattgagtgcccacgatgtactaggtggatctttgaggcaacacaacgaacatgcagggtctctgttggcatagtccactgtctatttggatccattagcattttaggaaatagktgcaaaaaaatatatgttgtaatagatatagaagacacatgttgagcgtcatagacttggaagggatccagttacttgtctttggagaaagtgagaaatgtatatgactgtttcatgaattcagtttacagatttttgcttgaagtttttttgtgtgtttttgaatttcttattacagcgcagcttatgatgccattcttgaaagaaatgttgcaatcaagaagctaagccgaccatttcagaatcagactcatgccaagcgggcctacagagagctagttcttatgaaatgtgttaatc

SEQ ID NO: 68277 - DNA, 601 bp, Human
ttttgagatctaaatatgtgcaggcctctgtgtattggagttactgggttcattatcaagggaaaaaaaatcatggaagttcaggattaggccctttatttggggagcttacaatggtgttttgaatacaaaacagacatacagagagttaaatatcaaacatcacaaagcagtggccgtttgtcaaatgatgatggtggcccatatattgaaatctaaaaagagggacgatttctgtgagctttaattaactgggaaggctttggggaggagtagacctaggctgactcttaaagatggsgtaaaaattggattgttgaaggaaaggagccttcagagaggaagaatgacgtaaaaaaggtccagagacaaagattaaacttagataataatagggaggaaattgtggtagccattcttgttccaagcgggaacttgatgtgttgctcatcacagttttgctggtggcatcctgtccatggatagagctgctcgtgccccttgtggcctgtgaacgcagttccatggcagtggtggtgttgccttagtttttccttggggaggagttcagttaatcctacctctcaagcctgggtgactg

SEQ ID NO: 68278 - DNA, 601 bp, Human
atctttgccaagtgattcagatggagctagatcatgaaagaatgtcctaccttctctatcagatgctgtgtggaatcaagcaccttcattctgctggaattattcatcgggttagtagaagaaactatcgtcatactctttgttttctcattgaggtgaaattcatgtaacaaaattaaccattctaaagtggcatttttagtacattcacagtgctgtacaactaccacccatattaaattctaaaatattttcattacccccaaaaaagtctccatgtttcttaagcagttgtgcatcwttgccctggcatgataccagtctgctttctgtgtctatagatttgcctttatgtttccatttatatgaaatacggcgtgatgttttcaagatttctccatgtttaccgtgtatcaatagttcattcctttttatgactgaataatattctatataccatatttcgttcatccattcatccatcgatggacatttgggttatttctacctttcagctattatggatcgtgctatgaaaattcaagcacaaatatttgtttgaatatatattttcagtcctttaggatatacctgtgactgg

SEQ ID NO: 68279 - DNA, 601 bp, Human
ataatatgtgatattttgtgcttggcttattttacctagcataatcttttcaaggttcattcatgtatttattgtgtgtcagttcttcttgtcattttattgacaaatatttcactgtatagatatattgtttatccatttatcacttgattataatttgggttgttaccactgactattacaggtaatgctgacatgaacatttatgtaaaatttttttgtgtgttggtatgttttgtattttagttaaatctagcttattctttgaaaagtattgagaggattttttttttttttttttcctgagagacagaatcttcctctgtcactcaggccaggatgcagtggcgtaatcatagttcacttgcagccttgaactcctgggttcaataggttgaaaagaattttttttttttttttttttttttttgagacagggtctctgtctgtcacccaggcatgagtgcagtagcatgaacatggcttactgcagcctttacctcctgggctcagtgatcatcccacttcagcctcccaagtagctaagactatggacatgtaccaccatgcctggcaaatttttattttttatttttttgta

SEQ ID NO: 68280 - DNA, 601 bp, Human
gtttatccatttatcacttgattataatttgggttgttaccactgactattacaggtaatgctgacatgaacatttatgtaaaatttttttgtgtgttggtatgttttgtattttagttaaatctagcttattctttgaaaagtattgagaggattttttttttttttttttcctgagagacagaatcttcctctgtcactcaggccaggatgcagtggcgtaatcatagttcacttgcagccttgaactcctgggttcaataggttgaaaagaattttttttttttttttttttttttttgagacagggtctctgtctgtcacccaggcatgagtgcagtagcatgaacatggcttactgcagcctttacctcctgggctcagtgatcatcccacttcagcctcccaagtagctaagactatggacatgtaccaccatgcctggcaaatttttattttttatttttttgtagagacggggtcttgccatattgcccaggctggtcttgtattcctggcttcaagcaatccagctgccttgacctcccaaagtgctgggatcacaggcatgagccatcatgcccagcctggaatttttaaa

SEQ ID NO: 68281 - DNA, 601 bp, Human
ctgccattgtaacacaaaagcagccataggtgatctgtacttgaatgagcatgactgtgtttcagtatcagcactttctttacaaagcaggcaggccttaatttgccagcccctgtgctagagcttcaggttcattgtacaagtggctgtgcaggtgacagcttcatgaaatgttttgttactacgtaacctagatcacctttccagccttcgatgtgagtttccctgctgctcaactgctaagccaggatcttatgtttttataataattaacaccccacctctgacaccagtttcagtrttagaatagactcagctgtactgaataacagataaacccttaattctcagtggcttagcacgactcaggcttatttcctttgctgaatgtgtggtgcagatcatggtgggtttgtggactgtgcgtttacatagatgatcagcaacccaggctgccagagaatcctctggaaagttcctaatcaccaaagcagggcaggagatgacaggaagttgtgcactggcccttctcttctttacttccactcacatcccatgaactagaactacccacgtgcccttgcctaactgaggaagctag

SEQ ID NO: 68282 - DNA, 601 bp, Human
gttgctattcttatatatagttagcagtgtaattaacagctgtaaggtacatattgatatatatggatgaatttcaattaatagtctttgaggctttttttgacaatttttttgcttaacaaaaatatctgtctttaaaaattgttactttgctcttaattttttcacaatgaagtgcttgaaattggaatgttatttctaaattggaatctgctagtataaagagccagtaaccttcaaccatcacactaaacattgaagtagtatcaaagcttgtaatatttattcttaaacatgcagkgtttctttgctgaggtactgtattttagaagtattagcaacattatatttacagaataccaataatgaaaatttttttcttctgtttcattaagacctttgaattgttggtatatttaatttcataaaaccactagattacatatcttctaaacccatccatgattgcctgtcgaaatatgttaaagacaacatacatgcttttctgtatgttaacattacaaaagtaatacaaaagtaatagttgtctttcaagcaggctattttccttttttgtattaatcggtgatatttaatatgt

SEQ ID NO: 68283 - DNA, 601 bp, Human
aatttttttcttctgtttcattaagacctttgaattgttggtatatttaatttcataaaaccactagattacatatcttctaaacccatccatgattgcctgtcgaaatatgttaaagacaacatacatgcttttctgtatgttaacattacaaaagtaatacaaaagtaatagttgtctttcaagcaggctattttccttttttgtattaatcggtgatatttaatatgtatactgcatgtcagtacaggtaatacagtgcatttgtgttgtggatttatgctttcttcgttttttggtmctttggcttataatagtattcatcaaagctaacaggcaaagtatgttaaacatgaagccatgagtgtttatgctgctgcctgacttttgatgggcacagcacagaatatgttaaagtaggggccaggtgaaaaattctgaattattcagtagtatctatagcaagtaattttatagattagtggcaccaaggcaatggtgtcctacttctacaaacagacagaaattttatagcaaatttgtgtgacttcaggtgggaaatcagggatggaaaaatggataatgactcttctagtccttt

SEQ ID NO: 68284 - DNA, 601 bp, Human
agcagtggttttcagcccatttggtttcagcatctttgggtgcctgaacctcaccctcagaaattctgctcagtgttccatttgaagaccattgattttatttcataaatgtattcttgagaacttttaagtaacttgcattattccaatttggaatgacccttatttagtgttcatgtggttcagaagtacttagcctagtgcatgagttacctttaactatccttcatcccccagcataagtcattcctgtccccttcctaaaccaatccccttgagaggatttctgtctcgagctcargtattcctgttaactttttaaaatccaggaaatgcttgttaggtaatactttcggcaaaggaaactgtttgctcttactatatttaataaatccatatttctgcttatcaagtattagagtagaaataagaagacccaagtttacttaactaggccacttgagtgacagtggcatgtcccataacctcgtgtaaagtggggcagttgaattgaggtttcttcctgttaaacttaattttattccttgtcttggcatttgctttaaaacaagatgtgccagaagtacatcttgtttcaaat

SEQ ID NO: 68285 - DNA, 601 bp, Human
tctgctcagtgttccatttgaagaccattgattttatttcataaatgtattcttgagaacttttaagtaacttgcattattccaatttggaatgacccttatttagtgttcatgtggttcagaagtacttagcctagtgcatgagttacctttaactatccttcatcccccagcataagtcattcctgtccccttcctaaaccaatccccttgagaggatttctgtctcgagctcaggtattcctgttaactttttaaaatccaggaaatgcttgttaggtaatactttcggcaaaggaawctgtttgctcttactatatttaataaatccatatttctgcttatcaagtattagagtagaaataagaagacccaagtttacttaactaggccacttgagtgacagtggcatgtcccataacctcgtgtaaagtggggcagttgaattgaggtttcttcctgttaaacttaattttattccttgtcttggcatttgctttaaaacaagatgtgccagaagtacatcttgtttcaaatttgaatcatttgaatttttcctttttagtgagaagctgtaaagacttttttgtagggaagtagc

SEQ ID NO: 68286 - DNA, 601 bp, Human
cttaactaggccacttgagtgacagtggcatgtcccataacctcgtgtaaagtggggcagttgaattgaggtttcttcctgttaaacttaattttattccttgtcttggcatttgctttaaaacaagatgtgccagaagtacatcttgtttcaaatttgaatcatttgaatttttcctttttagtgagaagctgtaaagacttttttgtagggaagtagcttttaacttttgtagttacacagtcctttaagatcctctgtccaaaaaaaggcattacagacagttttgcatgtattatcmgcagtattcacacataccctgaagcccattcatggatcttgctgcaggaccatttctaaatgtggttcagatgtaaaattcttgtcttaaactgaaaaacacattcattgaaaggataggactccacgattctagacattttcagaattctcacctcatagctgtcaatgaagagtgtttttaagttagtgtgttggatatcatttgcgattatttttagtgagccttcgaaacccaagagaaaaaaattaccactggaggcagtcagtgcagtgcaagtagcttgatctgcagctgtct

SEQ ID NO: 68287 - DNA, 601 bp, Human; identical to SEQ ID NO: 38090

SEQ ID NO: 68288 - DNA, 601 bp, Human; identical to SEQ ID NO: 38091

SEQ ID NO: 68289 - DNA, 601 bp, Human; identical to SEQ ID NO: 38092

SEQ ID NO: 68290 - DNA, 601 bp, Human; identical to SEQ ID NO: 38093

SEQ ID NO: 68291 - DNA, 601 bp, Human; identical to SEQ ID NO: 38094

SEQ ID NO: 68292 - DNA, 601 bp, Human; identical to SEQ ID NO: 38095

SEQ ID NO: 68293 - DNA, 601 bp, Human; identical to SEQ ID NO: 38096

SEQ ID NO: 68294 - DNA, 601 bp, Human; identical to SEQ ID NO: 38097

SEQ ID NO: 68295 - DNA, 601 bp, Human; identical to SEQ ID NO: 38098

SEQ ID NO: 68296 - DNA, 601 bp, Human; identical to SEQ ID NO: 38099

SEQ ID NO: 68297 - DNA, 601 bp, Human; identical to SEQ ID NO: 38100

SEQ ID NO: 68298 - DNA, 601 bp, Human; identical to SEQ ID NO: 38101

SEQ ID NO: 68299 - DNA, 601 bp, Human; identical to SEQ ID NO: 38102

SEQ ID NO: 68300 - DNA, 601 bp, Human; identical to SEQ ID NO: 38103

SEQ ID NO: 68301 - DNA, 601 bp, Human; identical to SEQ ID NO: 38104

SEQ ID NO: 68302 - DNA, 601 bp, Human; identical to SEQ ID NO: 38105

SEQ ID NO: 68303 - DNA, 601 bp, Human; identical to SEQ ID NO: 38106

SEQ ID NO: 68304 - DNA, 601 bp, Human; identical to SEQ ID NO: 38107

SEQ ID NO: 68305 - DNA, 601 bp, Human; identical to SEQ ID NO: 38108

SEQ ID NO: 68306 - DNA, 601 bp, Human; identical to SEQ ID NO: 38109

SEQ ID NO: 68307 - DNA, 601 bp, Human; identical to SEQ ID NO: 38110

SEQ ID NO: 68308 - DNA, 601 bp, Human; identical to SEQ ID NO: 38111

SEQ ID NO: 68309 - DNA, 601 bp, Human; identical to SEQ ID NO: 38112

SEQ ID NO: 68310 - DNA, 601 bp, Human; identical to SEQ ID NO: 38113

SEQ ID NO: 68311 - DNA, 601 bp, Human; identical to SEQ ID NO: 38114

SEQ ID NO: 68312 - DNA, 601 bp, Human; identical to SEQ ID NO: 38115

SEQ ID NO: 68313 - DNA, 601 bp, Human; identical to SEQ ID NO: 38116

SEQ ID NO: 68314 - DNA, 601 bp, Human; identical to SEQ ID NO: 38117

SEQ ID NO: 68315 - DNA, 601 bp, Human; identical to SEQ ID NO: 38118

SEQ ID NO: 68316 - DNA, 601 bp, Human; identical to SEQ ID NO: 38119

SEQ ID NO: 68317 - DNA, 601 bp, Human; identical to SEQ ID NO: 38120

SEQ ID NO: 68318 - DNA, 601 bp, Human; identical to SEQ ID NO: 38121

SEQ ID NO: 68319 - DNA, 601 bp, Human; identical to SEQ ID NO: 38122

SEQ ID NO: 68320 - DNA, 601 bp, Human; identical to SEQ ID NO: 38123

SEQ ID NO: 68321 - DNA, 601 bp, Human; identical to SEQ ID NO: 38124

SEQ ID NO: 68322 - DNA, 601 bp, Human; identical to SEQ ID NO: 38125

SEQ ID NO: 68323 - DNA, 601 bp, Human; identical to SEQ ID NO: 38126

SEQ ID NO: 68324 - DNA, 601 bp, Human; identical to SEQ ID NO: 38127

SEQ ID NO: 68325 - DNA, 601 bp, Human; identical to SEQ ID NO: 38128

SEQ ID NO: 68326 - DNA, 601 bp, Human; identical to SEQ ID NO: 38129

SEQ ID NO: 68327 - DNA, 601 bp, Human; identical to SEQ ID NO: 38130

SEQ ID NO: 68328 - DNA, 601 bp, Human; identical to SEQ ID NO: 38131

SEQ ID NO: 68329 - DNA, 601 bp, Human; identical to SEQ ID NO: 38132

SEQ ID NO: 68330 - DNA, 601 bp, Human; identical to SEQ ID NO: 38133

SEQ ID NO: 68331 - DNA, 601 bp, Human; identical to SEQ ID NO: 38134

SEQ ID NO: 68332 - DNA, 601 bp, Human; identical to SEQ ID NO: 38135

SEQ ID NO: 68333 - DNA, 601 bp, Human; identical to SEQ ID NO: 38136

SEQ ID NO: 68334 - DNA, 601 bp, Human; identical to SEQ ID NO: 38137

SEQ ID NO: 68335 - DNA, 601 bp, Human; identical to SEQ ID NO: 38138

SEQ ID NO: 68336 - DNA, 601 bp, Human; identical to SEQ ID NO: 38139

SEQ ID NO: 68337 - DNA, 601 bp, Human; identical to SEQ ID NO: 38140

SEQ ID NO: 68338 - DNA, 601 bp, Human; identical to SEQ ID NO: 38141

SEQ ID NO: 68339 - DNA, 601 bp, Human; identical to SEQ ID NO: 38142

SEQ ID NO: 68340 - DNA, 601 bp, Human; identical to SEQ ID NO: 38143

SEQ ID NO: 68341 - DNA, 601 bp, Human; identical to SEQ ID NO: 38144

SEQ ID NO: 68342 - DNA, 601 bp, Human; identical to SEQ ID NO: 38145

SEQ ID NO: 68343 - DNA, 601 bp, Human; identical to SEQ ID NO: 38146

SEQ ID NO: 68344 - DNA, 601 bp, Human; identical to SEQ ID NO: 38147

SEQ ID NO: 68345 - DNA, 601 bp, Human; identical to SEQ ID NO: 38148

SEQ ID NO: 68346 - DNA, 601 bp, Human; identical to SEQ ID NO: 38149

SEQ ID NO: 68347 - DNA, 601 bp, Human; identical to SEQ ID NO: 38150

SEQ ID NO: 68348 - DNA, 601 bp, Human; identical to SEQ ID NO: 38151

SEQ ID NO: 68349 - DNA, 601 bp, Human; identical to SEQ ID NO: 38152

SEQ ID NO: 68350 - DNA, 601 bp, Human; identical to SEQ ID NO: 38153

SEQ ID NO: 68351 - DNA, 601 bp, Human; identical to SEQ ID NO: 38154

SEQ ID NO: 68352 - DNA, 601 bp, Human; identical to SEQ ID NO: 38155

SEQ ID NO: 68353 - DNA, 601 bp, Human; identical to SEQ ID NO: 38156

SEQ ID NO: 68354 - DNA, 601 bp, Human; identical to SEQ ID NO: 38157

SEQ ID NO: 68355 - DNA, 601 bp, Human; identical to SEQ ID NO: 38158

SEQ ID NO: 68356 - DNA, 601 bp, Human; identical to SEQ ID NO: 38159

SEQ ID NO: 68357 - DNA, 601 bp, Human; identical to SEQ ID NO: 38160

SEQ ID NO: 68358 - DNA, 601 bp, Human; identical to SEQ ID NO: 38161

SEQ ID NO: 68359 - DNA, 601 bp, Human; identical to SEQ ID NO: 38162

SEQ ID NO: 68360 - DNA, 601 bp, Human; identical to SEQ ID NO: 38163

SEQ ID NO: 68361 - DNA, 601 bp, Human; identical to SEQ ID NO: 38164

SEQ ID NO: 68362 - DNA, 601 bp, Human; identical to SEQ ID NO: 38165

SEQ ID NO: 68363 - DNA, 601 bp, Human; identical to SEQ ID NO: 38166

SEQ ID NO: 68364 - DNA, 601 bp, Human; identical to SEQ ID NO: 38167

SEQ ID NO: 68365 - DNA, 601 bp, Human; identical to SEQ ID NO: 38168

SEQ ID NO: 68366 - DNA, 601 bp, Human; identical to SEQ ID NO: 38169

SEQ ID NO: 68367 - DNA, 601 bp, Human; identical to SEQ ID NO: 38170

SEQ ID NO: 68368 - DNA, 601 bp, Human; identical to SEQ ID NO: 38171

SEQ ID NO: 68369 - DNA, 601 bp, Human; identical to SEQ ID NO: 38172

SEQ ID NO: 68370 - DNA, 601 bp, Human; identical to SEQ ID NO: 38173

SEQ ID NO: 68371 - DNA, 601 bp, Human; identical to SEQ ID NO: 38174

SEQ ID NO: 68372 - DNA, 601 bp, Human; identical to SEQ ID NO: 38175

SEQ ID NO: 68373 - DNA, 601 bp, Human; identical to SEQ ID NO: 38176

SEQ ID NO: 68374 - DNA, 601 bp, Human; identical to SEQ ID NO: 38177

SEQ ID NO: 68375 - DNA, 601 bp, Human; identical to SEQ ID NO: 38178

SEQ ID NO: 68376 - DNA, 601 bp, Human; identical to SEQ ID NO: 38179

SEQ ID NO: 68377 - DNA, 601 bp, Human; identical to SEQ ID NO: 38180

SEQ ID NO: 68378 - DNA, 601 bp, Human
atgcattcttcattagagtattaaaacattttctaataatttgaagctatagtgtgtttgatttgtagtatattaaaatctgtcatttttcttttaggctgtaaaggatgtgaatctttgaacatagttgccatgaatcttaaataacaaaaagcagttagtatttttaaaatattccatttgttttataaacattattttgtaggtatctgtaatgcgtgatgaggataaattactgaggattaaaattaatgaactggagaaaaagaaaaaccagtgttctcaggaattagatatgaarcagcgaaccattcagcaactcaaggtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgttta

SEQ ID NO: 68379 - DNA, 601 bp, Human
gtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcataytgatgctgtgtgcttcctggtttgatgtgaccagaaaggcacataccctctttggtattctttccctaaatttataacctcagactcttcacgaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaag

SEQ ID NO: 68380 - DNA, 601 bp, Human
taacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatactgatgctgtgtgcttcctggtttgatgtgaccagaaaggcacataccctctttggtattctttccctaaatttataacctcagwctcttcacgaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaa

SEQ ID NO: 68381 - DNA, 601 bp, Human
tgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatactgatgctgtgtgcttcctggtttgatgtgaccagaaaggcacataccctctttggtattctttccctaaatttataacctcagactcttcaygaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttt

SEQ ID NO: 68382 - DNA, 601 bp, Human
aaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaraaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatg

SEQ ID NO: 68383 - DNA, 601 bp, Human
taatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaataktcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttga

SEQ ID NO: 68384 - DNA, 601 bp, Human
tagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaakgtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttgagtttaagtttaccagtgaggaagcttttaatg

SEQ ID NO: 68385 - DNA, 601 bp, Human; identical to SEQ ID NO: 38181

SEQ ID NO: 68386 - DNA, 601 bp, Human; identical to SEQ ID NO: 38182

SEQ ID NO: 68387 - DNA, 601 bp, Human; identical to SEQ ID NO: 38183

SEQ ID NO: 68388 - DNA, 601 bp, Human; identical to SEQ ID NO: 38184

SEQ ID NO: 68389 - DNA, 601 bp, Human; identical to SEQ ID NO: 38185

SEQ ID NO: 68390 - DNA, 601 bp, Human; identical to SEQ ID NO: 38186

SEQ ID NO: 68391 - DNA, 601 bp, Human; identical to SEQ ID NO: 38187

SEQ ID NO: 68392 - DNA, 601 bp, Human; identical to SEQ ID NO: 38188

SEQ ID NO: 68393 - DNA, 601 bp, Human; identical to SEQ ID NO: 38189

SEQ ID NO: 68394 - DNA, 601 bp, Human; identical to SEQ ID NO: 38190

SEQ ID NO: 68395 - DNA, 601 bp, Human; identical to SEQ ID NO: 38191

SEQ ID NO: 68396 - DNA, 601 bp, Human; identical to SEQ ID NO: 38192

SEQ ID NO: 68397 - DNA, 601 bp, Human; identical to SEQ ID NO: 38193

SEQ ID NO: 68398 - DNA, 601 bp, Human; identical to SEQ ID NO: 38194

SEQ ID NO: 68399 - DNA, 601 bp, Human; identical to SEQ ID NO: 38195

SEQ ID NO: 68400 - DNA, 601 bp, Human; identical to SEQ ID NO: 38196

SEQ ID NO: 68401 - DNA, 601 bp, Human; identical to SEQ ID NO: 38197

SEQ ID NO: 68402 - DNA, 601 bp, Human; identical to SEQ ID NO: 38198

SEQ ID NO: 68403 - DNA, 601 bp, Human; identical to SEQ ID NO: 38199

SEQ ID NO: 68404 - DNA, 601 bp, Human; identical to SEQ ID NO: 38200

SEQ ID NO: 68405 - DNA, 601 bp, Human; identical to SEQ ID NO: 38201

SEQ ID NO: 68406 - DNA, 601 bp, Human; identical to SEQ ID NO: 38202

SEQ ID NO: 68407 - DNA, 601 bp, Human; identical to SEQ ID NO: 38203

SEQ ID NO: 68408 - DNA, 601 bp, Human; identical to SEQ ID NO: 38204

SEQ ID NO: 68409 - DNA, 601 bp, Human; identical to SEQ ID NO: 38205

SEQ ID NO: 68410 - DNA, 601 bp, Human; identical to SEQ ID NO: 38206

SEQ ID NO: 68411 - DNA, 601 bp, Human; identical to SEQ ID NO: 38207

SEQ ID NO: 68412 - DNA, 601 bp, Human; identical to SEQ ID NO: 38208

SEQ ID NO: 68413 - DNA, 601 bp, Human; identical to SEQ ID NO: 38209

SEQ ID NO: 68414 - DNA, 601 bp, Human; identical to SEQ ID NO: 38210

SEQ ID NO: 68415 - DNA, 601 bp, Human; identical to SEQ ID NO: 38211

SEQ ID NO: 68416 - DNA, 601 bp, Human; identical to SEQ ID NO: 38212

SEQ ID NO: 68417 - DNA, 601 bp, Human; identical to SEQ ID NO: 38213

SEQ ID NO: 68418 - DNA, 601 bp, Human; identical to SEQ ID NO: 38214

SEQ ID NO: 68419 - DNA, 601 bp, Human; identical to SEQ ID NO: 38215

SEQ ID NO: 68420 - DNA, 601 bp, Human; identical to SEQ ID NO: 38216

SEQ ID NO: 68421 - DNA, 601 bp, Human; identical to SEQ ID NO: 38217

SEQ ID NO: 68422 - DNA, 601 bp, Human; identical to SEQ ID NO: 38218

SEQ ID NO: 68423 - DNA, 601 bp, Human; identical to SEQ ID NO: 38219

SEQ ID NO: 68424 - DNA, 601 bp, Human; identical to SEQ ID NO: 38220

SEQ ID NO: 68425 - DNA, 601 bp, Human; identical to SEQ ID NO: 38221

SEQ ID NO: 68426 - DNA, 601 bp, Human; identical to SEQ ID NO: 38222

SEQ ID NO: 68427 - DNA, 601 bp, Human
taagtgccaaatcaaaggcgaagacctgagccatctcaatctaaaatcataagcccattacaatttcagattttccaaatagattacctaccagaagaagccatggtgaatagaagacaagcgacaggcagtgtattctgcacaatcaactgggataaggaaagtcctgaaaatgattttcaaaaacatgcaatcactttctttgcctttctatatgtcatcaacccaaaaaaatctcacatcacatctacatacatcgtcagaaaaatacgtggaataaagacgtctaaattaaccacgaaaaaaattatcaaaatctactaaataaacattgggaaatatgacctgaatatgatattggttccagaaaatcaagttaactgagctttctcggtcataaaactcttggatttttaaaatcagacaaagtcacaagggtgaagaatttttcccccataaactctttaacatttcaccgaaactgtaagaagatattccagattcaactcaacagtgcccccggagccatcttaatactgcctacaactcattgtgcaaatgaaatacccacccctgctttgtctgtgtctgacgtggtgga

SEQ ID NO: 68428 - DNA, 601 bp, Human
tgaagcacttctttctcgtgctctcgtttctcagccagctgcttcaagacctcagcttcatgggactggaaaaaaaagtttaataggctaggcactctaaaatgtattcaggctgggtgtggtggctcacgcctgtaatcccagcactttgggaggccaaggtgggtggatcatttgaggtcaggagttcaagaccagcctggccaacatggtgaaatcctacctatactaaaaatacaaaaattagccgggcgtggtggcgggtgcctgtagtctaagttacttgggaggctgaggcagragaattgcttgaacccgggaggtggaggttgcagtgaactgagatcgtgccactgcactccaccctgggtgacagagactctgcctcaaaaaataaaatgtattcagcataagttaaaattacaataaaaataatttactaaggggattgaaaaggggcagaaaataaggtccctttaaataacaccaaaattaggacctgaattatccctatcataaaatactgtgaaaatgatattctttttctagtatttgtatttaactttggaaaagtgcttatctgttcagaaatcttacccaa

SEQ ID NO: 68429 - DNA, 601 bp, Human
ccccccaagatttgtaattttatatttcagtgcatgcttgcatgctgattcatttaccattccatattgtaattttttgatgtagattgttcagatgttccctgagtaattatgtttaaagaagcattttaaaatcaaatgaattaaagtccaaagtaatagtaaaattacaaaattacatattagacatcaccactctctctattatttttataacttgtgttaatgtgaaggcttggctagctaaagaagatggtgccagatgatctttgaagtccttttcctgatactgttcttcacrtcaaatatgtcacacatttaaaattggtcatttggtggaaatgcatatcttatgtagtgatgtcatgagacttttcctattagtattacctcattagctgaaatggagtcagagaatttcttaccataaatgtctgatatcctacacacacatacacacacacacacacacagagagcagacaaaaccatggcgattgataatattatctttcacaacttacacaacacactaatagaaggaaattattcttagctttctttctgacacatggagagctctcatgctagaaagttttctt

SEQ ID NO: 68430 - DNA, 601 bp, Human
ctcattacaaccgtaaattcctgggctcaggtgatcctcctgcctcagcctcccaagtagctgggaccacagttacacaccaccatgcccagctaatttttaactttttttgtaaagtcagagtcttgctatgttgctcaggttggtctcaaactcctggcctcaaccaatcctcttctcttgacctcccaaagtgctgggattacaggcttgagccaacgcgcccagcatgactatttgttgactcagttttgttgtgtgcccattgcatgccaggcactaaatgaaggcaatgaagacmcagatcaaatgacatgtcacaagctctcaaaaaacccacagtgtagagatgagcctaaagactaatatggaataaggagtttttgttttaagcttgacgggaacacagggtaaggagcatcttcgtctgtggaggtacaagggatactttgctacacagtagactgatcttaagaaatgaaaggtatgcatggtgaaatcccatctctactaaaaatacaaaaaattagctgggcgtggtggcaggcgcctgtagtcccagctactcagaaggttgaggcaggagaatggcatgaactcg

SEQ ID NO: 68431 - DNA, 601 bp, Human
gcacaagcggaactgcttcagattcagacgtgggcaaggctgggaggggcctggtggttcacctcctcctgaccctctcctctggcctctctaaagcataaggggtctcttctccaaggcacccatggcacagtgtagtaactttattcatagaactatattcttattatctctttgtgtcgtatttgccctattagtgcataaattcattgagaacaaacatcatttattgtttgttttcttgtttatttatttttctggctttagatattagctagcacagtacttggctatttgctcttgttgttgttgttgttgttgtctgtttgttttgggactccacccaggctggagtgcagtggcctcatcatagctcattacaaccgtaaattcctgggctcaggtgatcctcctgcctcagcctcccaagtagctgggaccacagttacacaccaccatgcccagctaatttttaactttttttgtaaagtcagagtcttgctatgttgctcaggttggtctcaaactcctggcctcaaccaatcctcttctcttgacctcccaaagtgctgggattacaggcttgagccaacgcgcccag

SEQ ID NO: 68432 - DNA, 601 bp, Human
atttaaagaattgtcctaggcaagatgtgtaccagtcagtccgtgtagggccttgactgtgggaatggggtttggctttgtgcacaagcggaactgcttcagattcagacgtgggcaaggctgggaggggcctggtggttcacctcctcctgaccctctcctctggcctctctaaagcataaggggtctcttctccaaggcacccatggcacagtgtagtaactttattcatagaactatattcttattatctctttgtgtcgtatttgccctattagtgcataaattcattgagaacaarcatcatttattgtttgttttcttgtttatttatttttctggctttagatattagctagcacagtacttggctatttgctcttgttgttgttgttgttgttgtctgtttgttttgggactccacccaggctggagtgcagtggcctcatcatagctcattacaaccgtaaattcctgggctcaggtgatcctcctgcctcagcctcccaagtagctgggaccacagttacacaccaccatgcccagctaatttttaactttttttgtaaagtcagagtcttgctatgttgctcaggttggt

SEQ ID NO: 68433 - DNA, 601 bp, Human
attaaaatgtgaaaaaatgggttgaggtataagttgttataaaagattaaccacagaaaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaaggttcaaataatccctcygtccttcatgatatgctccttatatctgattcaaatacttcctcatcttctgtaatgcatattttctaaattctagatttctagattccaacaattttatgagaatctatcacatttatcatcaaaacactttccttattcaaatgtagtctattgtgagctagtagctctgtgagaggccattaagctaagtacctcaccttcactggactggggtatattggaggatgcccaggtacttgctttaaagccagctctttttgtatagggagcttcttttggtttgcaaatctgagtgac

SEQ ID NO: 68434 - DNA, 601 bp, Human
catgttataattttaagattaaaatgtgaaaaaatgggttgaggtataagttgttataaaagattaaccacagaaaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaargttcaaataatccctccgtccttcatgatatgctccttatatctgattcaaatacttcctcatcttctgtaatgcatattttctaaattctagatttctagattccaacaattttatgagaatctatcacatttatcatcaaaacactttccttattcaaatgtagtctattgtgagctagtagctctgtgagaggccattaagctaagtacctcaccttcactggactggggtatattggaggatgcccaggtacttgctttaaagccagctctttttgtatagggagcttcttttggt

SEQ ID NO: 68435 - DNA, 601 bp, Human
cagttttctagttgggtttttttgtttctgaagagtcattttcaatttaaaaaatcaagcatatgaaaaaacaataaaaaaccatatccttccatgaaagtaattaacgtaagtttaggaatagatgctttgagacatcattcacgatgttctataattcatgcaaaggatgaaaagccaaaataccagtgatcctttttttctgttaatgaatatgttgccataacatgttataattttaagattaaaatgtgaaaaaatgggttgaggtataagttgttataaaagattaaccacagamaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaaggttcaaataatccctccgtccttcatgatatgctccttatatctgattcaaatacttcctcatcttctgtaatg

SEQ ID NO: 68436 - DNA, 601 bp, Human
aaacaaatgactaaacaagaacagttttctagttgggtttttttgtttctgaagagtcattttcaatttaaaaaatcaagcatatgaaaaaacaataaaaaaccatatccttccatgaaagtaattaacgtaagtttaggaatagatgctttgagacatcattcacgatgttctataattcatgcaaaggatgaaaagccaaaataccagtgatcctttttttctgttaatgaatatgttgccataacatgttataattttaagattaaaatgtgaaaaaatgggttgaggtataagttgytataaaagattaaccacagaaaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaaggttcaaataatccctccgtccttcatgatatgctccttatatctgattcaaat

SEQ ID NO: 68437 - DNA, 601 bp, Human
ttgtaaatatttcatgaaggtatcagttagcacattggacttttatttaaagaaggtcactttctcctttgaaatataagatttggaaactggagtaatttgcaattgaacaacaacaaaattcctgaatcatttttaaaaatgtcaacacagaacttaccgttttaataggtatttaattcattttgtaaaaacatttaattttattttcctgggattttacttattaggcaagaggaggtctagttttatctatatgagtgcctataatgttctagatatcatatacaaatatataaargaaataatgtcttttcctttaagaaacagattacaaatgaaaacaaatgactaaacaagaacagttttctagttgggtttttttgtttctgaagagtcattttcaatttaaaaaatcaagcatatgaaaaaacaataaaaaaccatatccttccatgaaagtaattaacgtaagtttaggaatagatgctttgagacatcattcacgatgttctataattcatgcaaaggatgaaaagccaaaataccagtgatcctttttttctgttaatgaatatgttgccataacatgttataattt

SEQ ID NO: 68438 - DNA, 601 bp, Human
atctttatttgtatcatttttgttccactttgggggtggaagagcagagaagaagcatgaataaagtgtgcatgactctattaattttattttattaatttttttaaagaagcacattgactaaaatccattcttagattaaaattcagttgtataatttagtgacagtatagatttatagttaacgaaactaacttgaaaccaaatagtccatgattgggaaaaacatataaaggctaaatcaagtcaaatgctttaactcatctaaaatttcattttgttgaagggtgcctttttattscctttagtgagagtacatgtctgtccttggttattgtttccagtgattaagaaggcctggagtaaaacacgtcttgtaggtgtctgaactttgaaatcattgctaatttatttttaaggcttttaaaaaataaaatatacccaacatttataaatcagacaaaaaatttaccttgaaaaatattttatgagaactttcattctggaatgcaagtgtgttttggtgggaagataagcaaggctgaacagaaaagatttttgagttcaattttgattacaaaaattatttggagaaagcctt

SEQ ID NO: 68439 - DNA, 601 bp, Human
ggtaagagagttctgttcttttctgtgtggaggaaattgtttctgatttccttactctgttttaagtcccctcccacaacatcagcaccctggattacgtgctgtactacctctttacttttaaacaaaagtgaaacaagtgcaaacaaaagcttgtggtgcattaataaatacagcaacaatgccagcattatttccttctttcttttaatcacatcttttttttttttcaaatagagtctctgctgtcaaaacctgactaaaatatcatctcaagaatacatattgttagaatatcacmtatttttctaaagtaatacggaacattaaaaagttcagaattatttgtcaataaaaggtagaatacacaggtttatctttatttgtatcatttttgttccactttgggggtggaagagcagagaagaagcatgaataaagtgtgcatgactctattaattttattttattaatttttttaaagaagcacattgactaaaatccattcttagattaaaattcagttgtataatttagtgacagtatagatttatagttaacgaaactaacttgaaaccaaatagtccatgattgggaaaaa

SEQ ID NO: 68440 - DNA, 601 bp, Human
ttccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatctctttttaaattttttcctgagttccataaagatgatataaaaggagaaataaagtaaacccaaagtgtgcccgtgagactttactgactttgagggcttcagtgacctcagtaaatcactktctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcattttaacattcatttgaatggcaatgtacccactaatatcaagcagtgggctgagcaaaggataaaatatacaaagaagcaaacttaccatcaaacacgttactataataacaaagatgctgag

SEQ ID NO: 68441 - DNA, 601 bp, Human
accgttagttcattcaatgccaaatagtactgcttaatttagtgggttaagtttgttttgggttctatttttaaaattagaaacatgcttttaaaggctacacattattacttacagagctattccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatytctttttaaattttttcctgagttccataaagatgatataaaaggagaaataaagtaaacccaaagtgtgcccgtgagactttactgactttgagggcttcagtgacctcagtaaatcactgtctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcatt

SEQ ID NO: 68442 - DNA, 601 bp, Human
ctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttagaaatgcagaatctgaaacacatyctatatgttaatagcaagctctgctctgtttctgctgccctttagtactcaaaggctgggcatgactctgctttcccacttcccttcttctatccttgcctttgctcttctgaatcacatccattgatcccctgaatattttccacttttatcactttcaattcctttctattctcccccttctcttatcctttctcatctgcaaagcagaaaaacaccctaattgtgactgacaagagagggaacagcacttgagatttcccatataaaggaagaatcacgtatattaaaatgcaatta

SEQ ID NO: 68443 - DNA, 601 bp, Human
tcataatgtcatgtattcatcattacagaaaatagaatagtttcactgccctaaaatctgctgtcccctacctaatcgttccctttctctgaaatctctggcaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccrcagagaatattctgcaggaatctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttaga

SEQ ID NO: 68444 - DNA, 601 bp, Human
aaaaactgagcagaaaataccaagttctcacatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggyaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccgcagagaatattctgcaggaatctgttgattgaatgaatagatgaatccacctgctaacccaatagagagcaatcacctatacttctgaaatgctcctttct

SEQ ID NO: 68445 - DNA, 601 bp, Human
tgtgatttttaaacacacacagcagatcatatcaaggctctgcctaaaacattcttcccctagagcctgaacaggctaagcttattctaactgcacccacagtaccctctgcctaggggtcctttactcacatattcacccataggtctcaaacatctcaggttgctctgctccactcactcattattatggtttcttcttcatagcacttatcaacatttgattttttaaattaatatactattttttagagtagttttaggtttacagaaaaactgagcagaaaataccaagttctcayatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggcaaccactgatattttctataggcttgactt

SEQ ID NO: 68446 - DNA, 601 bp, Human
agaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgarccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagccaaataacctaggagtcatccttaattttacccctgttgctgaggattgggacacagcaagttttgtcggttctactttcaaatagatctcaatccttcacttctctccttcccca

SEQ ID NO: 68447 - DNA, 601 bp, Human
ctgtggtaagttccatcagataaacttggctttgtgctaatcctattaggtagtacttcttttcttgtgaatatgaacttcccgtctgtgtgctgcgggttcctctgttacttttcagaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgagccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagc

SEQ ID NO: 68448 - DNA, 601 bp, Human
gtccacctttgacatgtatttattacatgatgttaaggctatagcaggtggttcaatgtaggatttcttgctgcggctaccagactacaactagagaaactctttccctcccatatggatgactctcctatgggtctaacatgccagtgtttttattgatccaaacaactattttcatgtgatttctaaaactgctttccagaagcaatctggcctgtagacatctctagctatatttcataaatgtctttgtacttgttaataaacctgtaaggacatttggatgtctaatttagatgayaaatggtgttctttctattatttgttcaagtttaagaactaattcttcttagtaagtttctttcatctaaaacagactgaatggattggaagttgcccacacattttttcttggaaaactgtatttttctatttgtcgctccacccactgcacattcacatttgtgaggtgctaaataagtcagcatatttgaaaatgtcatgcctgtctaattttatgcctggcaacattttttttttgtattttaaggaaagtaaacaatatgccacttttcaaaaattctgccaagtcttatgttgt

SEQ ID NO: 68449 - DNA, 601 bp, Human
agcaatttagtgatatctacgtaagtgaatgtcacatggagacctacattgcccatcaagaaaccacaggtattttaggggaggaggtggaaagaatgacttgatcaatctctgttttcttcctgttgtggagtcaaagggttcagtgtttaaggacttttagagataaacacattcctttatttttatgtcatccattgttccttggcaatactttcaaataattatgaaggatcaattttgtattctgcagttcttaaaatcccaagctatattttctgaagggtgtgtttgtgtgtgyaaaccataactatttgcatagggcattgtgatgtatcatgggaaatatattcaaaatttatatatgtgatttaaaaacctcaggcaacaaaatatatggggttagaaaatggagacatggaaaataagaggagaatgaacctgggatattactttgagaacttactctcccactaccctggtgttcaaagttggatacactacaagtcatgttttaaatataaaattaaagcttcttattttaagaaacgccatgggaaagctttacttaatatttttgagaggcaaagaattagtctct

SEQ ID NO: 68450 - DNA, 601 bp, Human
ttaacactgattacacacttgctctgctagaatcccccacgtggaccaaagagatgggtatgattccgtccttgtattcgcccttctcaaagattcactttaatgaaatgaataagtgaatatttaaccttatactcctttaaactgtagaccaacatgtccagcagtggtctacagagggcaggatgctgggaatggctactttcctagacaattttattctgaccttgcttagaattggtagtgcatgatgataataaaaatttgtcttttaatcagtttcattatgacccttcattgktatctactatagataacatggcctcctattgcctgcagaccctttcttgccaccggcccttcgttcatcactgatgcccaggtctgtgcttcaaagttcctctttgaagcaaacataaaagcacaaaaataatgtggatgaccagagtaaaagaaccagaaagaagctaaaaaatcaagttaaacctctttatcttttagaagaaaatgaggtccagatgagtgaatgactcaggtgaggccaccaaacccaggaacggcagggctgggtctggaatccagttctcctgactcccagtta

SEQ ID NO: 68451 - DNA, 601 bp, Human
tttaataagtgtcagaggtagtattagctgagactcaggtctatagtttatcattaagctattggttcttatggaagattctttagaaacagacgagatcttcagatgtgaagcaacattaattaactccataatatttttgagtgtttactatgtaccagggtttacaggaaccacaggagacacagagtatcttgagccatagtacctgttcttaaaattcttgtcatctgctgaaaacacaagacaaaccacttaaaaaccagttcaagtccctttctgaatgattgttcaattaaartcattgccagaggagtggtatatctgagaatttataggtgttatacatcactgtgggcacaaataggttacatggccagtggtagggggtaagttttgtgttgggctctggagactagagatcggtaggctgagggaagaggaaggaccaggcaaacagaaatgcaaatgtggacaggagcgcagcactcagagggggatggggatggaaacagagagcatggaatagaaggtttattttaggatgtagttgcaaatggatttggagcaaatgatcagggccagatggtataggacatct

SEQ ID NO: 68452 - DNA, 601 bp, Human
gacaactgtccatgaggggccactcatgctcagagatccctgtgcaatcaggctgagggtagatggctgctaccaccacctctttgcttgtcctcttctctgttctgcttgccctgctttcctaataagcttcccctgagagcatcttctcaacacatcatttggacaagagcccttgtctcaggctgtgcttttacagaacctcaccaaagacctaagagaaagattctgggccccatttttatttgacagaaaatgagagagttggatccattttcgattatgggtctatttaatgaacatctatctatctatctatctatctatctatctatctatctatctatctttcgagacaaagtctcgctgttttgcccaggctggagtacagtggtgtgacacagctcactgcaaccttgagctcccaggttcaggatatcctcctgcctcagcctcctaagtagctgggagtacaggtaaacaccaccatgcctggctaatttgttaaaaaatttttgtagagacggggtctcactatgttgcccaggttggtctcaaactcctggcttcaagtgattctcctgccttaacctcccaaaat

SEQ ID NO: 68453 - DNA, 601 bp, Human
gggcaatgaaaaaaagagctgcctggaaaaacggacaggtgtttgagtagggctgaccatcctctggagactgacaagatgaaggatccacatctgaggtatattccttcaggcaaagtgggcctctgccatactttgaatgtattcattctcatagatcctttagtacttcatcatttttactcttatttttgattaaggtgggtttaaaattccaacttttttttcttagaaaccttaagtagactaaggattctgtcaggaaaaaatattcctctgaatagggatttggtaacaacaygctaagttaggagccaacgtaacaagagtaaaacaaatgattcagaagatcatattcacagcagggaccgtgagggttttaggagctcccctcagagccccaggtgcagcgtgacattgccaaggacatgcagggagcacagctccaaggggctccctctcgatgtctaatgaggccaggcaacctgccagcaccacaggcttctgtggggcaagggcgaggtggtggtgagcatccattttttttttgtttgttttcctccgaggcagagtcttgctctgttgcccaggctagagtgca

SEQ ID NO: 68454 - DNA, 601 bp, Human
tctaatgtcatttgatatttttcataatgtcatttgatatttttatcctcttggggggatacaactagtggatgacaaaaaaacaatgaaaaaataataattccaagcaaactattattgacattgtgttaaagattttgtgagacaccctgcccacactagatttcactagtatcaccctagaggatgtaagttctaatgagaatttctgtcacacccaagcctcgatttttacttttacagtatagtgctgtttcactctgccacctgcaggtcatatatggaagaacatatttaaatyagaaggcctggcttggtggctcactcctgtaatcccaacactttgggaggccaaggcaggtggatcacctcaggtcaggagttcaagacctgcctggccaacatggtgaaaccccgtctctactaaaaatacaaaaattagccgggcatggtgacgggcacctgtaaccccagctacttgggagactgaggcaggagaatagcttggaccctggaggaggaggttgcagtgagctgagatcatgccactgtgctccagcctgggtgacagagcaagaccccgtctcaaaagaataaatga

SEQ ID NO: 68455 - DNA, 601 bp, Human
tgcatttaatttttttttttttttttgagacagagtctcactctgtcacctaggctggagtgcagtggcgtgatcatagctcactgcaacctccacctcctgagttcaaacgattcttacatctcagcctcccaagtagctgggattacaggtgtatgccattatgccaggcttatttttgtatttttagtagagatgagattacaccatgtctctgctaaaaggtcttgaacacctggcctcaagtgattcaccagcctcgacctcccagagtgctgggattacaggcatgagccaccaygcctggctgcatttacaaaatgcatttcttcctacttattcccatttttttctctccaatatttctaagatttgtatatttacgcaggggatggctaggggagagaagggggaaagtggaataagcttttggaatttggaagaaagaacatgtatgttaaaattcctatctagtattaaacataagtcacatattcattattgtgtatttgatcatgtacagcatatattgtcagacttcggtatcgtggaagaagaaatcttgaaattgtctcacaaattttaagggttttgtgctgtc

SEQ ID NO: 68456 - DNA, 601 bp, Human
gagttaaatatctggctctctgagacatacaggccaatatttctagactctgtcaaattctaggatgaatgcacagccctggttgaaggtaaattcaatgatgtgtctctcttcgctaaggagggacattactgcgcctgttgaaccctaaatagtaaaatcattgtcaatactattgcttataatgtacacatcatagatagatgatgatcacaagtgatatttttcaacatcttctttgtatgacattacccagaagatccaagctaaaacccagtaaagaatgatgctttttttttttgcagtctgctttatgtttttgcaaaacattttacattacacttgtaaaatatatacatatgtatatattttagtcaacttaattcaagaaaattatacaaaaaatctaatttaatgcaacaaaaacctatcatatgcccagtttttagggcaaaatcaggcttaaaatttgggtagaaatttaaggccctagaaatgtatgtacagtggttgacaatttggggtctggagccaggccacctgtattctatatttattgcacacctctcatggccaattggatgcccttgagcaagtgaca

SEQ ID NO: 68457 - DNA, 601 bp, Human
taagccacccgccgtcataaagaaggtgagatatttattgaacagatgtttcattactcaagaaaattcacattttcaagtaaaaagccaaaagatgggccttccacccaagtccctgaaaaagattcttggcagcatttatatttagtgcctacaagttttacgcactgagtttttactgtttagatgtgcgggtcaacaaatcactgagaagacaccaaaactgtctgccagatgtcgaccactgattaatttgtcttaagttcagccaaaagggaagaaaatatgatgggtggagcaygaacagcaagcacaatcaacatctgaccaaccagggtttcctgtcaccttgggaacaaaattgattggcactggtttcctgtgtacaagttaaaaaccagtagcaactgcagtaacaagaataaactacagataagagacttggaaattaaatcaaggcacatcaccaaaatttcagcttgcaaccctaagcagaaaagttccaagagaactttttgagggcttttttttttccccttttaagctattttgtatgtaaacttaatttttctaattttgccacttctggcaatctgaaatc

SEQ ID NO: 68458 - DNA, 601 bp, Human
gggtccttttaggtcttgtgcctaggacttgcaaatgcctcgggtgaataagaatgcttttcctgtgtaagagcacaagacattttaggaacaggaaaagcctatccggtccaacatacctgccctttttaggtttatctaaatcccaccttcctgcattgttaccttccttcatcttcctatatagagataacatttcttgtatgtttctcatgatctctcctgtcactagacctgataaaattagacctatattttagtaccactctcgttaaaacaaatgatttctgaaaagagttckcaaggctagtaaacagtttgtaatttttcttttttaagagtcataaaccatgagtttgaaagaggagactccaaagaagcttgacttggagggacgcggaggtcatccggcttgactttgtgcttagcttttatttatgagttatcttatttgccagaatctgggtaccaacattttctctcagagtgttcagtgacgagggatatgtttatttgggataagactcattatgaagaaaatatgcaggtggctaaagattaattacaagcagcagaggcctgttaaaaagcttaacattct

SEQ ID NO: 68459 - DNA, 601 bp, Human
gattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggattcaattataatggggaaatactagaagaatacataaatttacagattgaaacatatttrtaccattttgcacatgcttgaaatattgtgtaaaacaatttgaagataagtcctttggacttttttgctttcgtatgtctgaattatcaatacgcacattttccaccaataattctccatgtcagatgaggacattcggagaagtgtgaatgagataaaaacgaggtgcttaagacattctgttcaaacggatagagttcatttactgaatactcctgaccggttcctggagttcagatccacacctaacaaattcccaaagttcttcagacctcagcaagtcaaaatacgctacggaaa

SEQ ID NO: 68460 - DNA, 601 bp, Human
ccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcaccatgatggctrggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggatt

SEQ ID NO: 68461 - DNA, 601 bp, Human
cttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcascatgatggctgggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttaca

SEQ ID NO: 68462 - DNA, 601 bp, Human
tgtaggtgtgaaaaggaaaataagaatgaaatacaaaggagtttccaaactgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaataytaactgtctgaatcaggataaaatgacttttagaaaacccattactttgatttaaatgttatattttttatagaattggaattgcttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcc

SEQ ID NO: 68463 - DNA, 601 bp, Human
gcacaagactcgccccagttagattttgaaaaatagctctatcacatttttgtaatttaatgaaaaaatgcttagtacaggacatgcagcacatcctgacaaagtcaatacaagacacaggacaaaattgttaaatacagaacatgtcccatatctacagaatgcctggctaacctaacaagatggaacacaattgacctaattttaatttcttccatgcatccgggcatttcctgtgtgcatggcagggatttgtaggtgtgaaaaggaaaataagaatgaaatacaaaggagtttccaractgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaatactaactgtctgaatcaggataaaatgacttttagaaaacccattactt

SEQ ID NO: 68464 - DNA, 601 bp, Human
agcttctaagtgtttataacaggataaaatcattaaaatactggaattctagacatgctagaaaacactcagattgggtccactatatatgtactctaactttatctcccatttttgggtagaattgttaataattttcaatttttttctattgtctgtcttctaagtaaaaaaaaaaaaaaagtttgcctctaatgaaatttatgtatttgtaaattatatacatgtactattatacttatgtattatgcaaattatgaaatatttacaaaatttgaagtaggaaagggcaagataaatrtactttttttgtaatatatatgttttacaccctaatggatcattttacacatttcttgggatgcacatgccccactttgagaccactctctcaattatctagacttacataggtaatggtaacttttttcagccactttggatatacaagacagtaagcacctaggacctatggtatctaccatatcagctacaagtactattcatcaaagattatttaaaatagcattttgctgggcgtggtggctcatggctgtaataccagctacttggaaggctgaggcaggaaggatcacttgag

SEQ ID NO: 68465 - DNA, 601 bp, Human
cagcactttgggaggctgaggcgggcagattgcatgagcccaggagtttgagaccagccaagggaacatggcaaaagcccatctctacaaaaaatacaaaaattcgctgggcatggtggtgtgttcctgtagttccagccacctgggaggctgagtgggaagatcgctggagcctagggaggttgaggctacagtgagccgtgatcacgctactgcactccagccttggtgacagagtgagaccctgtctccaaaaaaagtttcttctatatattgagtatgccaaaataattttttttttgttatttaagacattacgatatcagggaacctgccccgatagtcatgtaggttcttttctattttccctaagcatcggctggtttgagaaataaagggacagagtacaaaagagagaaattttaaagctgggcgtccgggggagatatcacatgtcagtaggttctgtgatgccccacaagccgtaaaaccagcaagtttttattagggagtttcaaaaggggagggagtatacgaacagggtatgggtcacagacatcaagtacttcacaaggtaatagaatatcacaaggcaaatgga

SEQ ID NO: 68466 - DNA, 601 bp, Human
ccaaagtggctgtaccattttatgtttccatctgcaatgtctgagatttccaatttctccacattcttgctaatacttgctgctgcctttttttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgtgttgtaaaattatgtrtatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagttttggcactaagttat

SEQ ID NO: 68467 - DNA, 601 bp, Human
actaccaaattcttttccaaagtggctgtaccattttatgtttccatctgcaatgtctgagatttccaatttctccacattcttgctaatacttgctgctgcctttttttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgygttgtaaaattatgtgtatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagt

SEQ ID NO: 68468 - DNA, 601 bp, Human
agaaataaaaatgttctaaattagcatgctttaaccaaatcaaacaaaatgaaaaaatgcccagaagcaattcccaaccaattttatataatattaatgagtaatatttatgatagaaaactaaagttatatatactccctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcacyggcagttactctgtatttctctctctctccaggctctagaaaccactaatatacatgctgtgtctgtagatttacctgctttggacatttcgtataaatggaatcatacaacgtatggcctcttgtgtcttgtctgacttcttttacgtagcataaatgttttcacggttcatccatgttgtagcatctatcagtactacattccttttcatggcacaatatagtccattgtatggatacacccacattttgtgtattcattcatcagttgatagacatttgggttgtttctacttttgg

SEQ ID NO: 68469 - DNA, 601 bp, Human
atactgtgttttattatctatattatgtccaaggagcagatagactggtaaaaaataagtatttctggaatgcaaaatatacacattttagagtgaactgaaatttgtcacgtaaaggacgtttttatgcttgctataagaaatatatccctttgcttttccagaaataaaaatgttctaaattagcatgctttaaccaaatcaaacaaaatgaaaaaatgcccagaagcaattcccaaccaattttatataatattaatgagtaatatttatgatagaaaactaaagttatatatactcyctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcaccggcagttactctgtatttctctctctctccaggctctagaaaccactaatatacatgctgtgtctgtagatttacctgctttggacatttcgtataaatggaatcatacaacgtatggcctcttgtgtcttgtctgac

SEQ ID NO: 68470 - DNA, 601 bp, Human
gttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatcaaggtctgcctttacctaaaatgaactctcaatcaaaattatgaaaatctactctctccagagtttctccaaatgtttacccaagaacagtaagttatttaaatatacatctctgtgtttgttcagtgttcatttaaaagtgtaccaccygccatgtaatcgtgggctttggtcagttaggtgctttgcaaataaaccaggatgacctttgctccctacaagtcactggcctttcaccttggaatttcagagtagggagtggcttctttttggccagtggagagtcaatgactttgctgggttactctgtggccacagattatatttaaagtatcatcagtcttcaggtggaaggaaggaaggcgccaattacctggaagggctgtgttagaattaaatgaagagaatgcacttgatttgatcaccgtgatcagattcttgccagtataa

SEQ ID NO: 68471 - DNA, 601 bp, Human
atggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttaggggtagtaggataactaaggggtagtaggtattaacctgggtgatgaaataatgtrtacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatca

SEQ ID NO: 68472 - DNA, 601 bp, Human
tgtaatactatgcagccataaaaaaagaacgagattatgtcctttgcagggacatggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttagggrtagtaggataactaaggggtagtaggtattaacctgggtgatgaaataatgtatacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatct

SEQ ID NO: 68473 - DNA, 601 bp, Human
gaaaattaaaactggactccttccttatatcatatacaaaaattaactcaagatggcttaaacgcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgyatcagacaaaggtctaatatccagcatctataaggaaccttaacaaatttacaagaaaaaaaatctcattaaaaggtgatcaaaggacaggaacagacacttcccaaaagaagatataggtgcagtcaacaatcatatgaaaaaaatctcaacatcactgataattagagaaacgcaaatcaaaaccataatgagataccctctcacaccagttagaatggctactattaaaaagtcaaaaaatgacatatgctggcaaggttgtggagaaaaaggaacgcttatacactgttggtggga

SEQ ID NO: 68474 - DNA, 601 bp, Human
aaagctggaggcatcatgctacctgacttcaaactatactacagggctacagtaaccaaaacagcatagtactgggacaaaaacagacacggagaccaatggaacagaatagagatgccagaaataaggctgcacgtctacaactatttgatcttcaacaaatctgacaaaaacaagcaatgggaaagtattccctattcagtaaatggtgctgggagaactgactagccatatgcagaaaattaaaactggactccttccttatatcatatacaaaaattaactcaagatggcttaaacrcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgcatcagacaaaggtctaatatccagcatctataaggaaccttaacaaatttacaagaaaaaaaa

SEQ ID NO: 68475 - DNA, 601 bp, Human
cccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagtgaataaacaacttcagcaaagtttcaggatacaaaatcaatgtgcaatgtgcaaaaatcactagcattcctgtacacyaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttacctgaatta

SEQ ID NO: 68476 - DNA, 601 bp, Human
aagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagtgaataaacaacttcagcaaagtttcaggatacaaaatcaatgtgcaatgtgcaaaaatcactagcattcytgtacactaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttac

SEQ ID NO: 68477 - DNA, 601 bp, Human
acctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagygaataaacaacttcagcaaagtttcaggatacaaaatcaatgtgcaatgtgcaaaaatcactagcattcctgtacactaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactac

SEQ ID NO: 68478 - DNA, 601 bp, Human
tcacatgaccatctcaatagatacagaaaagaataaaattcaacatccattcatgttaaaaactcttaataaactaggtactaaaggagcatacctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaaytatccctgtttgcagatgacatgatcctgtttgcagatgacatgatcctatatctagaaaacccagagtttcagcccagaagcttctgaagtgaataaacaacttcagcaaagtttcaggatacaaaatcaatgtgcaatgtgcaaaaatcactagcattcctgtacactaacaacagtcaagccaagaggcaaatcaggaatgaactcccattcacaattgccccaaaaggataaaatacctaggaatacagctaactagggagatgaaagacttctacaaggagaactgcaaaacact

SEQ ID NO: 68479 - DNA, 601 bp, Human
tactgtgctttgacggtttttccagtcctctgaaaatacaggaattggggggactatattaaacaggagtctgaaaatttggagtgtagaagccaagcttacataggtaaatgttacagttgtgattcagtttgaatcttgtttaagcatcaataaagtctgagcattaacatcctaaagttacatcctatgttaattttattcagaaaaaggaagaaaatgtactgctttgttttgtaaccaaggatgattaatttttactccttttttttttgtcatttggtattgttttgactgtcaytcatggtgaggaggctgtttccctttcaacaaaataacaaaatgatagtagttctatttttagttcctaagttaatttttcctagtttatataattatttaagaaaaagatgctaaaaaaattaataaatctcaatgactaagccattccttgtgaaatgagaagtcttctttgaatttcagctgatttaaatataaatacaaatacaaacacacacacacacacacacacacacacacggcattttctaagtagcacaatacaatgaataacctcctgtctctttatgcaatcaactac

SEQ ID NO: 68480 - DNA, 601 bp, Human
agactgcataatctgcaaatgggaataataataaaactcacaaaattgactcacaccataaaagataaataagcaagaatatgtgaatacttccaccctaatgtctgggatataataaacatatatgaattattatcataattaataataacatggtgatttttgcttcactctctatttacacagctatgtgggagctacatgagtacacactgatgaacatttgagggaggtaaagttgagaaaattggttagtgattaagagttagcagcagtatcacacatgcaaaatcaatggtcrtctaagttgggactatttttcatacttcaagtccttaacatttatacctaatgtctttaaagttaacaatgttttcatgattcaaaaataatgcatgttaactaaagctaaaaatagagattttacaaatttcataatacccatatttagagtaactgctaagaacattttttgtgtatgtccttcaagtccttatatgtatgacaaaaatctagatttttattcaatatattcttttatgatttacttttaaaaaaaggaagtaggcacagaaccattgcatatgatttactttttaaa

SEQ ID NO: 68481 - DNA, 601 bp, Human
gtaccaaccctctttctggatcacttgaaagatgataggataaaacagaaataaacacggaccactaggaaagttaaattgtgacataaatggagtgttaccaattttgagaactgaaataaatgagtaggtattgtgaccattcataataaaatttcccaaaggaaatcctgaagggaagaaataataataaatataaaagatgccaggcatgaacccaggaagatgatatatgaatttcaccctaaagtaaaaagaaaatcttttaacatagagaatatttttagtgtaggaaatgatycattttcctacctgaaaggacctacacctcactaggtagaatgttgctatgccttttgattgaatctataaaagttttgaattcataaaaagatgtctgaccttttatatgtgtataggacaaggcaaaatttactacacccttattttacaaaaaaaattcaaaacaatcatttaaaagaaccagatacattgaacttgtcacattactcttgaaatattgaccttggaaaatgcgttcaatcattgttctgcatttcgcttaagcaacttggaccttagactgcataatctgcaaatg

SEQ ID NO: 68482 - DNA, 601 bp, Human
tcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaaaacaagtttttgctcatttgaataacaaaggagacaaaagtggagaaatggagagatggaattcttttactttgtgtggactgagtggcataggcagtttttgcaactcccarttctatgacttttaagttccgaggttaatggcatttaataatgttatgctgtttccatctctttatcttccagtaaattatacatagtaccaaccctctttctggatcacttgaaagatgataggataaaacagaaataaacacggaccactaggaaagttaaattgtgacataaatggagtgttaccaattttgagaactgaaataaatgagtaggtattgtgaccattcataataaaatttcccaaaggaaatcctgaagggaagaaataataataaatataaaagatgccaggcatg

SEQ ID NO: 68483 - DNA, 601 bp, Human
tttggtcactgagaacagtgagacttcaagcagtatacctcatttagcaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtraaaagtatatataatttgtctggagttgtcttcattagtgtacacgtcaaatcttatgtggtgagaagcaagaactttaatgttgatgttgtcttcagaactgaaaatgtgatcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaa

SEQ ID NO: 68484 - DNA, 601 bp, Human
aatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagcaaccaataaagaatggaaatggaaaaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtaaaaagtatatataatttgtctggagttgtcttcattagtgtacacgtcaaatcttatgtggtgagaagcaag

SEQ ID NO: 68485 - DNA, 601 bp, Human
ctttgggtcaaaattgttcaattctaatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagmaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtaaaaagtatatataatttgtctggagttgtcttcattagtgtacacgt

SEQ ID NO: 68486 - DNA, 601 bp, Human
ctgagttcaggagttcaagaccaacctgggcaacatggtaaaaccctgtctctacaaaacatacaaaaagtagctggatgtggtgacccacacttgtagtctcagctactagggaggctgaggtgagataatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcrtatgtgaattgacacacgaattcatttaattttgtggtaaacttataaggggccatagaaatcacagacccttaaaatgagttacaatttatcttcctctcataattccccttttcccgctggggggcaaggggatgctcttacaacttacacagaccctgagtcctgagtaggaagtgaggatgccttttacaagtaatattagctgtgtggaccaaggggtaactatgaaatagcatgtgagagactgaggattgaagtcagagatggtgtttacaaaaactgttacatttaaagggg

SEQ ID NO: 68487 - DNA, 601 bp, Human
tcataggttggctaataatattaagtgaaaaattaagtaaaaaaaaattaggaaaagctatatctatatctatatcttctgagtgaatccctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagakaatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcatatgtgaattgacacacgaattcatttaattttgtggtaaacttataaggggccatagaaatcacagacccttaaaatgagttacaatttatcttcctctcataattccccttttcccgctggggggc

SEQ ID NO: 68488 - DNA, 601 bp, Human
attgcaaaaacttgtctttctgtacatgcacacaattcagtgagaacttttacagaaataacaaccaactatattttctcttttagtatcatggttggccatagcaactacccatagttcctttacaggaaaataacaattttgttgttggaaagaactctaaattgagaaaatatgctataatttatgaatgcatatacttattacagaaatcataggttggctaataatattaagtgaaaaattaagtaaaaaaaaattaggaaaagctatatctatatctatatcttctgagtgaatmcctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagataatcatttgagcccggggggttgaggctgcagtgagccgtgatggtgccactgtactccagcctgggcagcagagagagaccttggct

SEQ ID NO: 68489 - DNA, 601 bp, Human
atgttggtaattagtaacttacagtattttccaagtatttagaagtttccaaatcctttttattaaaaattcagagaggggagtctcactttgttgcccaggctgaattgcagtggctactcccagatgtgatcacagctcactgcgacctcaacctcccgggctcaagtgatcctcctgcctcagcctcccaagtagctgggaccacacatgtgcaccaccatgcctggctacattttgtattttttggtagagatgaggttttgccatgttgcccaggctagtaattaaactttttttktgtgtgtggaaatggggtcttattatattgcccaggctggtctcaaactccaggacatgagccactgtgtgtggctccaactacttccttttacaaatgcaagaatacaacatataactgagtatggggaaatgtaggtttccaagaaaaactcttgtaatatatagcttgtactaaaaaaaaaagccaagaattaaacaaaaaatgtataatcatcatcgttttcatcactactgttataaatgaatgaaaatggggctcttgagtactttgcttttaaaactgtaaacttctctatac

SEQ ID NO: 68490 - DNA, 601 bp, Human
gaaaaacacttttaaattatttaaaccactgttatttgggttgtggttaatagtatatataagttttctggcaaaaatatttcagaaaagaatagtattatcacaaaatcagttctgcctagggaggcattaatagaataggtacatcccaaacatctggggtttgtatatattcagaagtcaaattcagggtttcttagagttggagttcgcatgtccaataattatcacgatctataaaaaataacgttttagcaacataacaaaaggtaatcatcattttagtctaaaactaagcccycaggccccataacattgccattagaatgcacgcagtgattagttcagtctggatagccctaaattgcttattgcactgatttcctttcttctgacctacaacaaacacatggcctggacagaagtctttttcactatttggaagaagctgtctttagttagcatatgtagcggtttgttcactgacagcacaagtatctgatattggttagattcgtttagtgctagcaacattgtcttaaattctaaaatcactttccatcaagagttgaaagactctttgtggactaaagtgttacgg

SEQ ID NO: 68491 - DNA, 601 bp, Human
tggagctgaattttaacattgagagtgaaattattccattgtttatacgtatcttccgtcaatcctattgatcaaaactcttggcagatcacaaaataacaaacaaggaggagaagccacagtggagcaaacaacatttattgcacactctccaccaagaatctcatggaggaggttccctgctgggagcctttggctatacagcgccctaaaagcttcttgccaagcatgctccgtgctgtctggcatttttgctgtcaatagctggagcacacaatagtacgcatatccaaatatgtaytttaagagctagtcgtctcctagtagtcaccatccctgtctttctttagcaataagatcccaattctggctgagaacttggtaggatgcacagcttaagacttcccttcttaccaccccttgcattagttgcggccatgtgactaagttttcacttatagcaggtgagaggaagtgatgcgcgtgacttttagatcatgaaattaaagtgaggagtgatgttcttcttctaccacttctgattccatcttgctgcctgggatgtggtcatggtgatcaggatcttagaccatgcaaaggt

SEQ ID NO: 68492 - DNA, 601 bp, Human
gaatgaactaccatatgatccagcaattccacttctgagtatatatccaaaggaactgaagtcagtatgttgaaggcatttctgcactcctatgttcttgcagcactatttacaatagccaaggtttgaaaacaactggagtgtccatcaacagatgaatggattttaaaagtatggtctatatacataatggagttctatctggcctttaaaaagcaggaaattctgtcatttgtgacaacatagatagacttcacagatattatgctaaatgaaataagccaggcacagagagacatgrtcttctttatgtgtggaatctaaaaaagttgaactcatagaaatagagagtagaatggtggttaccaaaggctaggtgggtgggtgaatggggaaaggggagatggtggtcaaaggatacaaaatttcagttaggagaaataggttctggcgatctattatagaccatggtgactattgtttaataataatattatatatttcaaaatagctgaaataatgggattttaaatgttctcaccacaaaaaataaataaatatttgaggtaatggatacattaatattagcatgatatgatca

SEQ ID NO: 68493 - DNA, 601 bp, Human
tgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaatgcaaattaaaaccacartatcacttcatacctgttagaagggctattatcaaaaagataaaagataaatgttggcaaggttgtgaagaaaagggagctctggtaggctgttggtgagaatgtaaattagcatagccattttggaaaacagtatggagattcctcaaaaactatgaatgaactaccatatgatccagcaattccacttctgagtatatatccaaaggaactgaagtcagtatgttgaaggcatttctgcactcctatgttcttgcagcactatttacaatagccaaggtttgaaaacaactggagtgt

SEQ ID NO: 68494 - DNA, 601 bp, Human
ttaaagcattctggaaataagtccaatctcagtcttgtccttcagagctttcaaaatgtagaccctatggagatggaagctagcaccaaactttcaaaagcacttcattttcccccaaatctcatacagtcttaacagatctatctctacatttcctacaattgttggtcaggggcagactgaccctcacttgcatgagccattttcaataagaaccttgtatcttattttgtattcataatgttgtattcattttttaagagtgtcttccagggcaaagttccatgacattgatgtgggyaaaaatttcttggatatgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaat

SEQ ID NO: 68495 - DNA, 601 bp, Human
tctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatactggctggggagatggcggtgtggcagaggcagagtgcttcattctcttctctatgtgaccctcactaaaggtctccttgtctcacaggatttctgtctctctcctactgtattccagtgygctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgccttcgtttctgtaaagtatcatagggcgttaccaacctagtattactttttatgttaatgacttcacttggtgtttcttgatttttgaattctgtgatttctcagctttaaatactcaaga

SEQ ID NO: 68496 - DNA, 601 bp, Human
gagatggtggctactggcccctggaacaggatgtactctagttgtggctctggtttcaaaatggcatcatatagctgcagcttgaatcacagggatgaggggatacaatgtgggctccttctctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatmctggctggggagatggcggtgtggcagaggcagagtgcttcattctcttctctatgtgaccctcactaaaggtctccttgtctcacaggatttctgtctctctcctactgtattccagtgtgctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgc

SEQ ID NO: 68497 - DNA, 601 bp, Human
tattgataacctctgaaggccttggtgtggctagtttgctggctcaggacaggtcacccctggaaacagcacacttggctggtgagcacaagaacaaatccactggttaaggtggggacccgctgtgagatgcatacatggctggtgagcatgcagcagccagtctgccagcttgggttagggattctctgggggcagtgtacttggctggcaagcatggggcttggcttgccaactcagagcagaagtcccctgaaaatgacatgcccagctggtgagcttactggtggtatatgcggayaggtctgccagctcaggttggggcatccttagaagtagtgcacccaactgttgagtgcaccagggacatgcaggggctggtccactggtttgggtgggactcgctttggaatggtgcattcgctggtgagcatgctgactgcgcatgaggccagtttggacttggtttctctgctgatcaagattgtctgttcctttgagggcaaggtgctatatgggcttcatggatggggcactggatctaggctctgagagacagggttcagggtgctgcagtcactaggatgtgaaaggtggaaca

SEQ ID NO: 68498 - DNA, 601 bp, Human
ccatgtatcattatataatgatcttctttgtgcttttttgtgatttttgatttgaagtctattttatctggtataagtgaagctactcctggtctcttttagtttccatttgcatgtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttmctcctgccattttgttaactgttttctagatactttgtttctttcttctacttttattgtttccctttgtgacttggtggttttccatagtgataagctttgattcatttctctttttgatttgtgtatctgctgtaatttttttctttgtggttattctggggcttatgtaaaaagaacttagaatattttaagctgataacaacttaactttggtcacatacaaatattctagactttcccttcccccatccacaattcataatttccttcaggtcattattttaaattccttttcag

SEQ ID NO: 68499 - DNA, 601 bp, Human
gtttgtttattttctgtctggatgatctgtccattgctgagagtggggtgttgaagttgaagttcatgattattactatatagcagtctatctctttctttaatctaataaataattgctctttatatttgggtactctagtgttaggtgcatacatatttacaattttttttttgttgaattaacccatgtatcattatataatgatcttctttgtgcttttttgtgatttttgatttgaagtctattttatctggtataagtgaagctactcctggtctcttttagtttccatttgcawgtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttactcctgccattttgttaactgttttctagatactttgtttctttcttctacttttattgtttccctttgtgacttggtggttttccatagtgataagctttgattcatttctct

SEQ ID NO: 68500 - DNA, 601 bp, Human
tcttttaaaatttgttaaggcttgtcttgtgctgttaagaaaaacgtgtattctgcagttgttgggtgaaatattctgtaaatatctgttaggtccaattggtctattgtgtggtttaaatccaatgtttgtttattttctgtctggatgatctgtccattgctgagagtggggtgttgaagttgaagttcatgattattactatatagcagtctatctctttctttaatctaataaataattgctctttatatttgggtactctagtgttaggtgcatacatatttacaattttttttttgttgaattaacccatgtatcattatataatgatcttctttgtgcttttttgtgatttttgatttgaagtctattttatctggtataagtgaagctactcctggtctcttttagtttccatttgcatgtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgaca

SEQ ID NO: 68501 - DNA, 601 bp, Human
ataacacagaaatattttaactttcctcatcttctcaaattttaaatactatcattatccagtattttagtttcaccttcatattttactttctttgctcactattatttcttgtatttgagtactttttttctggattgaattcttcttcattctgttttatcctcccttgtagttgttttggtaagattttttttggtggtgaattcttaccatttttgttagtttgaaaatgtctttcacacctggccctgtaggatagatttgttgggtataaagttctgggtagtcaagtattttmtttcagttctttgtaggtaatattctactgatttttggcttctagttttgctatagaaaagcctttttttttttggttagttactctggtgggagtaattactttctttggtgctttttcagttccagagatgtgtctagctgtgatttacatttacctattcagcctaggatttattgtgctttttagatttttgaactcaagtcttccatcagttttggaaaatccctatctattatttcttcaaatattacttcttttctcatatcctcttctttctccttctaaaacacctgttat

SEQ ID NO: 68502 - DNA, 601 bp, Human
ttttctcccagtgtgatggtgatttatcaattccttctttaattctgcccattaatgcttcagatatttggggggaggttatgtatattatgcatttatatatttagaatcttacttgtgaatttcacattttagtgttatagattgacattccttatctctagtaagctctctgataatgattgttttgatttgaaattcattttcatctgacattctttatctctggtaacctctctagtaattattcttttgagaatattcttttgagaattattcttttgagagtcagttttatctracttgacttttgattagtattagtttggtgtatttttttccatcctttccattttaacatttctgtgtcctcttgtaggcagcatttaactgaatttatttattttatcagtttggtaatctctgatatttaatttgcaagttatttgtttatatttagtatgatttggatttttttctatctcccaattaggtaaaagtttatcctgatttttctatattaccttttgttttcccttttattttggtttattttcgaaattctgtcttttctctcttctaccagattggaaattataca

SEQ ID NO: 68503 - DNA, 601 bp, Human
ggattacagaaatgagccaccatgcctggcctcatcaatccttttatctttgttttatgtttaacatttattcttcattattccttccttttttctctcctgttcattttatagttcttttactaacttaagtctgttgcttagatcacaaattcttttataatatcatattcatgcctataaacttccttctatgagcatttttagcagcatctcacaagatttgatgtgtagtatttgcatcatccctgaattgcaggtaatttacagttatattataaattcattttcatccatgaaytgtgtgtgtgttaaaactttttttaagcatcaaagtgtattttttaatcttatctttctgctttttatttctaacttaatgcactgtaatcgaagcatatatgtacagttattcctggaaatttgccaagacttgctatatagtcgtagttggtcacttttcacaaaatctcatgctttgaaaatttatattatgagattattgattggaaggttctatatatctttcttaaactaagcttgctaatttgaataaaggttatgtataaactttttctatatttttattttttgtctgctt

SEQ ID NO: 68504 - DNA, 601 bp, Human
cacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattayaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaagtagtttaactcagatgaaagatgcatgtaaatgtagagaaaga

SEQ ID NO: 68505 - DNA, 601 bp, Human
acacaagccatatatatatatgttatacacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccwcaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaag

SEQ ID NO: 68506 - DNA, 601 bp, Human
ctatgtgtgtgtgtgtatatatatacgagctatatatatatataagctatatatatacacacaagccatatatatatatgttatacacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatktcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccg

SEQ ID NO: 68507 - DNA, 601 bp, Human
aagtcaagctctcacttactcccattcgatgagaaactaagcactgtggtttctactgctggaacacttaaatatatcttccaaagctattttatatatatatgctatttatatatatatatatacacacaagctatgtgtgtgtgtgtatatatatacgagctatatatatatataagctatatatatacacacaagccatatatatatatgttatacacacacacacacacacacacacacacacaagcttgcacactgtcagccaggctggagtgcagtggcacgatcatagcttacygcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcat

SEQ ID NO: 68508 - DNA, 601 bp, Human
taacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttgaatcyatcttgaatggattcgtgtttcataagcaaagtcctgcatgagatcctaatttatcttgtgactccaatttatgctcatgaatccagttgaccagcgacagcattcataatatctaattctgatcctccaaaggaaagctgaataccagaaagggactctcttctgcttgcttgctaggttggactcccacaataataccttctctgaccttgtttggatagaccctctggttgtgggacttggtttgctcgtttcttttcattcattttcaaagcatgaatcctttagtctactccaca

SEQ ID NO: 68509 - DNA, 601 bp, Human
tcttggctcactgcaagctccgcctcccaggttcaccccattctcctgcctcagcctcccgagtagctgggactacaggcgcccgccaccatgcctggctaattttttgtattttttagtagagacggagtttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttraacataacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttg

SEQ ID NO: 68510 - DNA, 601 bp, Human
tatgaacaaatgtacatgttttaaaataaaatactttttttatgattctcacattgaccatttttgattaactgtgtgtttttccggttttttttttttttttttttttttttttttttttttgagacggagtctcgctctgtcactcaggctggagtgcagtggcacgatcttggctcactgcaagctccgcctcccaggttcaccccattctcctgcctcagcctcccgagtagctgggactacaggcgcccgccaccatgcctggctaattttttgtattttttagtagagacggagwttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttaaacataacactgtggattaaacattaaggtgcaaagttagatttggaatatatgcatgcctggaaggacaggagagtaattttgtttgggcgcagtcagcatctgaatttctagccacccttaattgctt

SEQ ID NO: 68511 - DNA, 601 bp, Human
tgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttttkttttttgggatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcatat

SEQ ID NO: 68512 - DNA, 601 bp, Human
attgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttwttttttttgggatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcat

SEQ ID NO: 68513 - DNA, 601 bp, Human
ataaatggaaatgctgctcgcttctctcccaagcttgccgggggccctcttgaatgttttttttgactcgttaccaaaaaagcaattggcagtcagctcccagtagacaatgcaatgtgacttgttcattcaaacaacccttaattagcatcccatctcctttctgagatacaatagcttatttttacacactgaatacatttttccctcatttagatgacagaaaaagagaccagataagtgtgggtacttttgaatatgaggtgggggacagctgcaaatgcagttgtttctaagagtrcaagttcatgttcaaattattttcctgtacagctttttagggtttctttattgtggtgctaacaatgagataaaagaggcagaaaaggcagggaagaaaaatgctgccttacagataatactgtgaaaccacactaattgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgt

SEQ ID NO: 68514 - DNA, 601 bp, Human
ttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggtatataaattatatctcaacagttttttttaaagtatcagtttcatatgtgcctattaaacactgtcactgctggctccatacaaaaaaaaaaggcagaattacccaaaactcctyagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtggcatacaaccaagtttcctttatatgtaaggcagatataatgatcattaatacaactatggtattatattttcccggaccaacagtttttttcacttatggaactaatttacaaaa

SEQ ID NO: 68515 - DNA, 601 bp, Human
tcttacctttaagacaaggtttcgaatggtgtagttatcacattcatttacactgataaccagaacctcaacttttccatatatccctctcttttccggccagtatagcacacatttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggyatataaattatatctcaacagttttttttaaagtatcagtttcatatgtgcctattaaacactgtcactgctggctccatacaaaaaaaaaaggcagaattacccaaaactcctcagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtgg

SEQ ID NO: 68516 - DNA, 601 bp, Human
gaatcacttgagccaaggaggcggaggttgcagtgagccgagatagcgccactgcactccagcctgggtgatagagtgagactctgtctcataataaataaataaataaataaataaataaataaataaatagttgttcatataaattactttaaaaatgctgccttcagtttggttacattaaaaggaaaattaggggaaggaggtatcagttttaggaagagagctttgaactagaaattagggacaggaaccagcacagaccctgctgctgttgttggcttggcctctagtgctccaygttctggtaacagcactttgttttcctttggtgacttgctcacttctcatttcataaatttgtttcaacctgtttttctggagataactcttaaaataattgactggttttcaccaaacttgaaatagtaatgttaccaagatacaagccaagcagagttcacatgtcatgttgaaacaacaaaaaagccactgataatttcaaaaagtgcatctttattcctggtgtgtacaagactgatgagactaaatcaatcaatataagtttcaaagcagataactgctgaataggtctcctgtt

SEQ ID NO: 68517 - DNA, 601 bp, Human
ggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataattgagagagaatattctaggtacgacaatgatatacaatgaaagaagaaaagaattaatgagaaacagcaaatatgatttgcaacaataagtagaacagcttrtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataatttcaaggagttcactgacctctgcggtttatggataggttcaacgttagggacttttgctctaggtttttttttttttttttttttttttttttttttataaga

SEQ ID NO: 68518 - DNA, 601 bp, Human
agaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataaytgagagagaatattctaggtacgacaatgatatacaatgaaagaagaaaagaattaatgagaaacagcaaatatgatttgcaacaataagtagaacagcttgtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataattt

SEQ ID NO: 68519 - DNA, 601 bp, Human
ggattcatgctttcctttctatagactgtaatcacgttttcaacatctccttttttcatgattagcagtgatctcattatagtttccaagtctcaagtcttttccttgacaaattcgcacagctgctaagttcatctttctgaaatagggacttaattatatcattccctactcaaaacctatagatggctccattaactatagcataatgtctaacctccctaccatggtattcatgaccttgcaaaatctgaatgtgactaactttcaagccttatgtattttgctgtcttccctcccrtgtgccatgattttcacttacgtcaattgtttgggcttttggttttccaatttttctgtgttaacaatgttttcttggtcagaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaag

SEQ ID NO: 68520 - DNA, 601 bp, Human
caatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtgrtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaaggggagttttgccttggacatactgatgttcagaagtc

SEQ ID NO: 68521 - DNA, 601 bp, Human
tgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattrtaagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaagggg

SEQ ID NO: 68522 - DNA, 601 bp, Human
tgagatgtttatgcatgaagtcaggctgatgagatcaggctgtgaatgaaaacagtgctctgaaggcaagcctctgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggaga

SEQ ID NO: 68523 - DNA, 601 bp, Human
tattacacaccaggcatttcacataggtcatatcatcttttcatccttacaataataataggaaatatatactactattactccaattttccaaatgagaaaactgaggcatggagaagggtagtaacttgcccaaggccatacaaccaaaaaaatggtggaatctgggatgtaaactcaggcaggcaatctgtttccagagcccagaatgttaatcgccatgatgaactgcttctagagtttacatgctaacagaaagagaaaataataaagaaagaaacaaacatagtagaaaacaaasagggaagatacggttagaaagacttagaggctactgtctaaaaaggagacaagaatgttacagatgggaagggaaaaactaatctggatagggaaatttgaatgtttatttttttagaggtaagagaaacttcacagataattttaataataaagatgataataacataacaaacatttattgagggcttactatgtgccagactctattccaagtgttttacatatattatctcatttttcagaataatcttcttgtcttttttattgaaatgccaggacatagcacatagtgctcaaa

SEQ ID NO: 68524 - DNA, 601 bp, Human
gagtattatcaaagagatatgtttttgtcaagaagttttacaataaacatattccaaaagcctatttacttttctataagattgataaagatcagagaaataattagagatcaggcaaatgtcccagattccaataggtccattttgttacttcccaagctacttgactttggacaagttactcgctatctcgaattctttggttcctcattaaaaaaaaaaaaattaggccaagatgcttcttttccttcacttgggtttattttgggagttaaataagtcatgtgctttgaagaccatrgtgaagagtccatgattaaatacattctgtatgtattaaatacatagtgcattctggaatctctggacagattcagagctgaaggtaaggatagccaggaaaatcggaatttggggacaaggtttgaacaagtgatgaagaaagatatgctgcaagtgcataacggtagacatttggattggctgagaccagttttccctttactgccatgagccaaaaacatggttaatggcagcagttagccacacattggaatttttaaaatgaggtatgataggaaaaagctgaaggactggaaca

SEQ ID NO: 68525 - DNA, 601 bp, Human
gtattcctaatgccaggagttacactctctccagctaccacactgaaaagaacagatcacttcgtttagattgaagcgttaatagcatagtagatatgaagtgttatgccatctcccatctccagattcaataaactttagaaaaagataattcttttaaaagaatccatccaagattagctctttactagcagtattttagacattcgctatacattttagcatcctccatagatagatattttaagaagcagcaatgttttgtccctcaaattgtactcttaaggcagttgccgacaaygtcactccaactattcataaaggagctctcatttatactaaaaactgttttaaaaattatggtgtcccgttgtcattgcattttgtttttaagaggtggagttttgctatgttgcccagggtgggtggcctcgaactcctgggctcatttgtttaaaatggcagagtattatcaaagagatatgtttttgtcaagaagttttacaataaacatattccaaaagcctatttacttttctataagattgataaagatcagagaaataattagagatcaggcaaatgtcccagattccaatag

SEQ ID NO: 68526 - DNA, 601 bp, Human
cacaaagcttcttgaaagaacagcttatctttattattacaacttctttccctctcatttagatggttcttgaggaaattcatctgtggtcaaataaatgtgaaagagtgcttaaataaaattaaaggagtttctacattgggaagattttagattttttaatgcattaatgcttattgtgagtctccgagtggggaagacttcgaagaaatatagtgtagggctgggtgccatggctcatgcctgcagtcccagcactttggcagcccgaggcaggtggatcacctgaggtcaggagttygagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaacaaaatatatatatatatataaacagcttttccccgaacttagtcaagaacctactttgtgcctgaacgccaccaagagggtttggcttagg

SEQ ID NO: 68527 - DNA, 601 bp, Human
caggcctgagacaccgtgccgggcccttttcctctttttaggggtccaggttcaggcttaaattactatcctatctctagtcttctcttcaccacaaagcttcttgaaagaacagcttatctttattattacaacttctttccctctcatttagatggttcttgaggaaattcatctgtggtcaaataaatgtgaaagagtgcttaaataaaattaaaggagtttctacattgggaagattttagattttttaatgcattaatgcttattgtgagtctccgagtggggaagacttcgaagraatatagtgtagggctgggtgccatggctcatgcctgcagtcccagcactttggcagcccgaggcaggtggatcacctgaggtcaggagttcgagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaa

SEQ ID NO: 68528 - DNA, 601 bp, Human
tacgccccacatctccttttactatgtagacagagaggcctagagtggacaaatggtcacacagaaaattagggggcagagccacgcaccaagctccttgacatctagtccagagatgtccggcacctcattcttttgctagtcttaccagtgttcagttgcaattgccataccacccacttcatcttttaattaaaagcgaatgcagtgggaatgaagggatgatcccttaatgcccttctaaataaaacattcgtgggtgccttgcactgaatttgaactcctacttggaaaaaaaaaagaaatcttattttagttcaaaatatgctcaaaagtattagtaaaaggagaatcacagactcatgaatctgcaatgagaactgagcatctattaatagaagttgtcacaaagccaataaaaataatgtcttgccagagaatgaggaatctaccaaatggttttgtcattgttatactggaaatatccattcagcataacacattcgtctctgaaccagaccatttgaatttattactaaaatgcagatttttaacttgagtagaaattgcttgttcttttcatgttaaattacaatgacca

SEQ ID NO: 68529 - DNA, 601 bp, Human
cctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttawaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagta

SEQ ID NO: 68530 - DNA, 601 bp, Human
tcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttwaaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagt

SEQ ID NO: 68531 - DNA, 601 bp, Human
gtgtaaatgaccttctgtcactatctcaaactgtagaaccttgacatacccaagcctaaatgaatcttttttagcaagagctacatgcagcgaagctggttggcttagctttatagcaattggtatttttaactaggtggtatagttgaacaatttagtgatatttgagattagaaggtttaagtattatatggaagggctttctaagtaataaaaaatgattatactgtgttcagtttagtactaatgttatggatctttttttcaactataattttaaaaaattgacctatacatttayggtaatctcctgttaataggaaaatgtgattgagcaaaatatcccttttgcaacaatgctggccaacagaaagttcattgtacttatcatattcagatattaataagtaatctaaactaaaataatcagagataaacaatttttcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaattt

SEQ ID NO: 68532 - DNA, 601 bp, Human
atttcaaccaggttttggaaacaaaaaatatgttggggacatatattagccttggaaattgatggcatatatattcttctgagatggctgtagttaaaaaaaaaaagaaaagaaaatcatcgaactgaagtgactaatcaaaacatttaaacaatgatatgatgcacattggaagcatctttttatcctgtgtgggaagccacaagtgaggcctttggatgtcattccagtttaagccctctaaggtaaggatgtacaggcaactacaaattccatccttgactcttaaaaagaaggattygacagataatttcctgctactcaggaagaaaaaaaagaggaaaaaaaaggccttggaataagatattattttatatgtttcacttcccaggttctgttttaaaattcttccagtgtccagttgccaatgggattaaaaggaaaacgatgaggaaaaagttatctgaggtcaatctgcaatggaatatgttcctttcctgcctgcttagatgtcttctgatagtcacgaattgatttgtagtcatacttctgtaatatctatatgcatgtgaagcactgtctgatgttaaaatataaacat

SEQ ID NO: 68533 - DNA, 601 bp, Human
ggtggctgaggaccctgggcagggcagaggaggaggatgggtcattaggactagatgccaatcccagctttgaccagggaagttgtgttttttattggttttctgtgttggtgttctgtggaagattctgcctgcaaaaagttttccattgttcacaaagaagtttgaaaaccactggcctggctaataaggtatttaggtatttatctaataaggcttcaagttttacaaggtttaaatgagagaatccacaaaactcttggcacagtaactgcccttcagtgagtactaaataaatgcygtgtattatttttcttattcttagttaatacgacacctagggtaaccatgtttggaagagttgtggttcattggtgttgtcctggtgtcattatcaattgggtcacctttcactctcagaagtaccttggtttggatgataaattatttgttcatcctaatgatgccccattccatgctgtggaagaaagtcattccctttattgcaaaagtggtgttagccacgtggcttggatttctttgtgcccacagactatgaaatgctgtgtttggccaggccagagaggattcagatatacta

SEQ ID NO: 68534 - DNA, 601 bp, Human
gttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttaggtcagataggtttcatggatttgctaaaatctggatctatattactgatataaagttcccaatacaaagtggttctgggaggtgagaaacaagggtactctttttcttacttttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcatatctgataaatgcttatgttagaactaaaacataaccccagccaatcataagcatccaactcacatattgttatgtcagtaaggactttccaatacagtacctgaaaaaaggcaattatgt

SEQ ID NO: 68535 - DNA, 601 bp, Human
gagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttargtcagataggtttcatggatttgctaaaatctggatctatattactgatataaagttcccaatacaaagtggttctgggaggtgagaaacaagggtactctttttcttacttttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcata

SEQ ID NO: 68536 - DNA, 601 bp, Human
gatcacttgagcccaggagctcgagaccagcctgggtaacatagttagaccctgtctacaatttaaaagaaaaattagctggacatggtggtatatgcctgtggtcccaactacacaggaggttgaggccagaggatagcatttgctctataacaggtaatccattcttagaaaggtcaacagagtcttctttcttcttatttttgatatggggtcttgctttgttgcccaggctggagtgtagtcatgcaatcacagctcactgcagccttggcctcccaggctcaggtgattctcccayctcagcctcccaagtagctgggatgacaggtgcatgccaccatactgagctaattttttctgtgtgtgtgtgttttttgtgtttgttttgtttgttttgttttttaagagagagagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatac

SEQ ID NO: 68537 - DNA, 601 bp, Human
tggacagtctctgctgaaagtctgctctcatacaggcacagagcatggtgcacaaattcatactgctcactggtttgcaccattccacctctgcaaggaagaaatcataaaataactgattttgctaaaatcttgcaatttcaagtaacacagagatttcatccaagctagggtattatgccaaagacacatagaacagtcgacctagtggttcttttgttatccctcttacctgtgtccaaatgtctcaactatcaaagttaacatggtaatgtatataaagggcttaacacagttcccrgcacacactaggcacgtgattaatttttacctgtgtaacattactggggaggtggtacagcctaatgatcaagtacttggatttggcatcagccaaggtgagttcaaatccctcctctgccaattcttagctgtatgcatcttggacaaattcctcgaaaccccttgcactttagtttcttcctctgttaaagcaggatagtaacagtaactactgctgtgaaggttaaataaattcattgtagctggtatatttgtattacttctcaggtgcctcatgattcatctcttgttaaaatgg

SEQ ID NO: 68538 - DNA, 601 bp, Human
ggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcycacaccgttgtgccactggacgatgctacacaggagtacaaggtggggaagcagacacacgatgtcagtgtgggtaaaaagggagaagcggcagaggatgagatactccctaggtagagatcgtaagctcctactactcactttgtattctcagagctgcatatgcaggggcacacagtatgtgtgatcagttgtcctctagcctgaaaaagagcaatggtgagaagtgccctaaaatttctctctgacttttgcaatacatgtgagtcttatgggtgaatattggtatgtgtggtcata

SEQ ID NO: 68539 - DNA, 601 bp, Human
gcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgaygctacacaggagtacaaggtggggaagcagacacacgatgtcagtgtgggtaaaaagggagaagcggcagaggatgagatactccctaggtagagatcgtaagctcctactactcactttgtattctcagagctgcatatgcaggggcacacagtatgtgtgatcagttgtcctctagcctgaaaaagagcaatggtgagaagtgccctaaaatttctctctgacttttgcaatacatgtgagtcttatgggtgaatattggtatgtgtggtcatatttttcataaatgaatgaaaccac

SEQ ID NO: 68540 - DNA, 601 bp, Human
taccataagtagcttagctcttggtgatatgatttttcatagtaataacttttggtaaagttctaagtataacaatataatcttgggttttattcagctattgctgaaaaattcacgtatagtaaaaccatgtaagaattactctgtgtttatactatataaaatggcattcaagcccaggcctatgtttttgtttttgtggtttttttttttttttttttttgagacggcgtctcgctctgtcatccaggctggagtgcagtggtgccatctcggctcactgcaagctctgcctcccggrttcatgccattctcctgcctcagcctcccaagtacctgggactacaggcgcccaccaccacacccagctgattttttttttctatttttagtagagacagggtttcaccgtgttatccaggatggtctcgatctcctgaccttgtgatctgcccacctcggcctcccaaagtgctgggattacaggcgtgagccaccgtgcctggccgcccaggcctgtgtttttgaatatccagcagaacattagaaaatgttgcaggtcagttcactatgccggattgtctcacacattggaggagtg

SEQ ID NO: 68541 - DNA, 601 bp, Human
gattttttttttctatttttagtagagacagggtttcaccgtgttatccaggatggtctcgatctcctgaccttgtgatctgcccacctcggcctcccaaagtgctgggattacaggcgtgagccaccgtgcctggccgcccaggcctgtgtttttgaatatccagcagaacattagaaaatgttgcaggtcagttcactatgccggattgtctcacacattggaggagtgcttgcgtcattgtcaggaacttccccaaccatggaaaacaagaagatgtgcctatttccaaaatatcctyagagtgtgttaacagcttcatcaagaaccactgccctaaaatatagagtgaaaaaaagagaaaagattaccggtttataagaggaagggcctttttgcttcctatttatcacagtcatgaatgttaaacttacacccatacctaaacaaacacacatgcatgcacacacatgtgcaaacacacacacacaaaggctgtgttttattgagggcaaatgtgagaatatattttgttcagatgtacactgagaaggcagtggtggaaagtgaagcagcaagtggccctaaactagaagagcta

SEQ ID NO: 68542 - DNA, 601 bp, Human
gaattgccagttctctgaagtgacttgaaacaatttaacaagttcagccctgaaatctacatatgtatattttataataacccatataactcttactgattcttacactttcccagttctctggtttttatctggtgcatgtgttgcaatatgcaaaggatgacaatcttatttttaactttttattatttgtactttcctttttgtttcgttgttttttgtttgcttgttttgagacagaatctcactcacccaggctggagggcagtagtgatcacagcacactaactcaaactccagkgttcaggccatccatcctcttgattctttttgagtagctaggactgcagatgtgcattgccatgcccgactaatttttttttctttttagttgaaacaaggtctcactatgtttcctaggttggtcttggcctcaagtgatcctctcacctgggcctcctaagcactaagtttacaggcatgagccaccatgctgagcctatactttccttttctcgacagattgaattaactagaactttacagttgataataacacagatatctctgatatctgtaatagttaatgtcatcatattat

SEQ ID NO: 68543 - DNA, 601 bp, Human
tttatcttaaattaaaacaaatatatatatccgcagtggtcttcactaccaagtcatcagtaggggggtgatagtgatggagccattctttacagaaggaaattccaatggaataaaaaatgagtgttctgttaaaccattttctctcattttctttctttcttttctttctgtctttgtctttctgtctttctttcctgtctgtctgtctttcatctcgatctgttgcccaagctggagtgcaatggtgcaacaatttcagcttactccaacctctgccttctttgctcaagccatcatsccacctcagcctctccagtagctgggactacaggcatgcaccaccagactcagctaattttttgtattttttgtagagttggggtttcaccatgttacctaggctggtctcaaacttctcatcccaagcaatccacctccctcggcctcccaaagtcctgggattacagtcatgtgtcaccacacccagcctttgttaaaccattttcaatgaaactggaagtctgtgttaattcatacatatggtgggtgagagaaaggcttccttataccacactgaccctgctgatacaacatcttc

SEQ ID NO: 68544 - DNA, 601 bp, Human
aaagtgtttgaaatattttgttctcttacgtaaatgaatggtgttagcaaaactagggaacatattttttatcttagagattagattaccagcatttgaagcagtgaggcttcattgtacatttatttttatgttacgtattgcttggtatttgttcctatggcctttcatgtatgtgtgttctgccttccatattaaactgggaaatccttgtgggacagagatttgtcttctttgtcttctggaccccaagtattcacaaatcagtattagcacacagttattaatgtgtttattcttscttttttttttttctgagagagtcttgctctgtcgcccaggctggagtgcagtgcatgatctcggctcactgcaacctttgcctcctgtgttcaagcgattctcctgcctcagcctcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttat

SEQ ID NO: 68545 - DNA, 601 bp, Human
agagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagyggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctagaccatatgctgtcttgctcggcatccttcttaacactttccgtttttttctgcccctcagactacaccttgtacttctctacatagtgagataaatgataatgtcagaggg

SEQ ID NO: 68546 - DNA, 601 bp, Human
tgaaaccccatctctactaaaaatataaaaattagccagatgtggtgttgggcgcctgtaatcccagctcctctggaggctgaggcaggagaactgcttgaacctgggaagcggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctaraccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaagagattattatctgtttactttagggtcagggtgagaagtgagccattgctttctccccttccttaggtgacaccatggattgagaaagttaaccaaaccaggttgttctggggacctttaagggaccaggctctg

SEQ ID NO: 68547 - DNA, 601 bp, Human; identical to SEQ ID NO: 27452

SEQ ID NO: 68548 - DNA, 601 bp, Human; identical to SEQ ID NO: 27453

SEQ ID NO: 68549 - DNA, 601 bp, Human; identical to SEQ ID NO: 27454

SEQ ID NO: 68550 - DNA, 601 bp, Human; identical to SEQ ID NO: 27455

SEQ ID NO: 68551 - DNA, 601 bp, Human; identical to SEQ ID NO: 27456

SEQ ID NO: 68552 - DNA, 601 bp, Human; identical to SEQ ID NO: 27457

SEQ ID NO: 68553 - DNA, 601 bp, Human; identical to SEQ ID NO: 27458

SEQ ID NO: 68554 - DNA, 601 bp, Human; identical to SEQ ID NO: 27459

SEQ ID NO: 68555 - DNA, 601 bp, Human; identical to SEQ ID NO: 27460

SEQ ID NO: 68556 - DNA, 601 bp, Human; identical to SEQ ID NO: 27461

SEQ ID NO: 68557 - DNA, 601 bp, Human; identical to SEQ ID NO: 27462

SEQ ID NO: 68558 - DNA, 601 bp, Human; identical to SEQ ID NO: 27463

SEQ ID NO: 68559 - DNA, 601 bp, Human; identical to SEQ ID NO: 27464

SEQ ID NO: 68560 - DNA, 601 bp, Human; identical to SEQ ID NO: 27465

SEQ ID NO: 68561 - DNA, 601 bp, Human; identical to SEQ ID NO: 27466

SEQ ID NO: 68562 - DNA, 601 bp, Human; identical to SEQ ID NO: 27467

SEQ ID NO: 68563 - DNA, 601 bp, Human; identical to SEQ ID NO: 27468

SEQ ID NO: 68564 - DNA, 601 bp, Human; identical to SEQ ID NO: 27469

SEQ ID NO: 68565 - DNA, 601 bp, Human; identical to SEQ ID NO: 27470

SEQ ID NO: 68566 - DNA, 601 bp, Human
ttcaaagatatattagaattctcactatcaactgctaattaactaattaagacatccacacacagacttgtactaaaacataattcataagcacaatgcataaacaactaaaaccagcacacattcatttaatgacagataaaatggcatgccacatacatttacccagcctgaatatatgtaaacacgaatttattcacaaacaggagctctcagttacacttacacactcgaatatatacatactcagactcccatccaaacacaccagacacacttctaaacatgcaaacattaacayatatacacactgtttgtacaatcattccctcaaatgcaaacttcagacacacctgatccatggcacagacacacacactcatgtttggtcactcattcattcaacaagtacttgttgaactcccgttatctgttggccacaagtgaacacagaacacactcaaaaaaacataaaacataaacacaattttccatgcctgggtctattgcctgggtgatcatgtaagtaaggagaaagaatttggcctccgggtggcctaaataatccacaactctgctgtttctcttagtccagtccagt

SEQ ID NO: 68567 - DNA, 601 bp, Human
ctggggagaaggaacataaaatactcaagatggaaaatgatttgttcaggtttgtctggtcatctgaccctctgcctccaggaatgaaatggccccaggagaggagtcccttccttagctgacaatccccgagccttcaccaccctgacagcttactccctttgggtcttcttcctcttgatttgtctctaagactttggatcaggactttccccctttatcctgtgccattagaggctgtgacttggttttcccacttgagtctttcttcaggtttaacattctattgtgttttgcttcrggtaagtggtatctggggtctgtactgagtttgatatgccccgcactgaaatcattctgagtttccgactcatcccaaaggaacatgtgtaaataacaaccctcccttgttactgaaatcaattatctgtgtatgactccagaggggagaagaaacttgggtaatgtaaaaataattgataaattgttttcaaaattatttgctccagaatagagttaggaacaggtacacacacgataaatatgtgtgttcaaagatatattagaattctcactatcaactgctaattaactaattaag

SEQ ID NO: 68568 - DNA, 601 bp, Human
accaaaagggacagatgtcagcagacatgctattacctccaaggaaggcatagaaactccccctgggcccctcctgttagtgttattattaccaaaaacatgtatagtgcctacgtgggccaacagtgtggaaccacctgggaacttgttagatatacgctctcagaatctgcatcctaacaagatgcccaggtgatttgcacacaggtaaagcctgaaaagcctgcctcagaggatgtgaaagctctcgtttagttcagtgtggtcctcgggaaagctcttctgctcaccgcaagttggytggtttccaaagctgtgcgtgccagcttggatctcctggggctgatataccacattctcccctcctcccatctctatcccacagtgcagcgacatttctcccttcagtccaaacttcatgattcctccctgttttcctcccagggcactggtgactcatttacagtcttccctcctggcaggctctctggctcacccctgggttattcactctgcctcagtaattctgaaactgtcagagtctgaggaccactttttaccaccaaaaactgctgcagagccttgcgttttgttactttta

SEQ ID NO: 68569 - DNA, 601 bp, Human
agctttgaaatggtggtatagaaaaagtgtccgggtttagttttttttgtttcgttttgttttgttttgtttgtttgtttttgagatggagtttagctcttgtctcccaggctggagtgcaatggcacaatctcagctcattgcaacctttgcctcccgggttcaagcgattctcctgcctcagcctcccgggtagctgggattataggtgcacaccaccatgcctgggtaatttttgttttttaatagagatggggtttcgccgtgttagccaggctggtctcaaactcctaacctcagrtgatccacctgccttggtctcccaaagtgctgggattacttacaggcgtgagccgccgtgtccagccaagtttgtttgtttgtttgtttttgtcacttctctgagtgcaaaatcagtgctttaaaaacaattcatttctctctctttatctcactatcccagagggtgggttggcgtcactgggaaactggcaaaaactggtagtgagatttccttatactgggtgctgacatcgtagtggcataacctgtaaggtctgcaggggggctaaagaagagagaaactaagttttgatccatt

SEQ ID NO: 68570 - DNA, 601 bp, Human
ggcagagtacttgaggccaggtgttctagaccagcctggtcaacatggcgaaactctgtctctactaaaaatacaaaaattagctgggcatggtggcgtacacttgtattcccggctatttaggaggctgaggcaagagagttgcttgaacccgggaggtggaggttgcagtgagctgaagctgcaccattacactccagcctgggcgacagagcgagactgtctcaaaaaaaaaaaaatttgtgttttattttcttttacgtcgcatttaatgaattatattgaaattttaaaacttgtrtctgcaggcatagtgttataatctttaaatgccatgtcagagtagcaaaagggattacagaatatttgttataaaaagagggcattgggtcatagagttgaagactacttgtgtggacagtatgctgtgagagaaaacctggagatgacctggagtccacatataacaagccttgaatccagactgacaggctcgggctatcagccctcagtgtgttcctgccctcaattttgttatcatttgattaggatagtttgcttgcctttttccatttgctcgtatgtgatgtgtcatagactg

SEQ ID NO: 68571 - DNA, 601 bp, Human
gagctaatctgagtgaaacaaaaacagtaaagagactagaagccagattggtattttgcatcatgtatgcttgtttgaaaatctttgctcctgaagtaaatatttggcaaccaagtgattagcgaccacaatttcaacaaaataataagtcattgaaaatggactatttgtctgaaagagcaatacctatattacaaagattgaacttcatggctcattacaaccattttcaaaatttaactgcaactatcttcttataaattaagagagtttaatttgtgttccatagtgcgatgacaawaaaaaagtaaaaacaaaacaaaaaaaccctcatgcctaaatttagaatattgtattatgtagcaatccaaaacattcaaaacaaattaaatagtttaacttatgtgacaggcagataagcatttcaaaagcataatgaagtccaattatgtagtgcttaatgtagacaggagaagaatctaacattatgcagacattttctaaataaaagctccctgtaggacagctatatataaacatgggtaaggtaagcgcagactagttctgtggaaccttttgaaatcaagagtctaaaacacaa

SEQ ID NO: 68572 - DNA, 601 bp, Human
aatggactatttgtctgaaagagcaatacctatattacaaagattgaacttcatggctcattacaaccattttcaaaatttaactgcaactatcttcttataaattaagagagtttaatttgtgttccatagtgcgatgacaaaaaaaaagtaaaaacaaaacaaaaaaaccctcatgcctaaatttagaatattgtattatgtagcaatccaaaacattcaaaacaaattaaatagtttaacttatgtgacaggcagataagcatttcaaaagcataatgaagtccaattatgtagtgcwtaatgtagacaggagaagaatctaacattatgcagacattttctaaataaaagctccctgtaggacagctatatataaacatgggtaaggtaagcgcagactagttctgtggaaccttttgaaatcaagagtctaaaacacaatacatttttcaggtaggcaccaagttatcctaaaaaattttcatgttggttattctgacgttgttttttctcttttttttttttttttgagacaagtcttgctctgtcgcccaggctagagtgcagtggctcgatctcggctcactgcaacctccgc

SEQ ID NO: 68573 - DNA, 601 bp, Human
taaatagtttaacttatgtgacaggcagataagcatttcaaaagcataatgaagtccaattatgtagtgcttaatgtagacaggagaagaatctaacattatgcagacattttctaaataaaagctccctgtaggacagctatatataaacatgggtaaggtaagcgcagactagttctgtggaaccttttgaaatcaagagtctaaaacacaatacatttttcaggtaggcaccaagttatcctaaaaaattttcatgttggttattctgacgttgttttttctcttttttttttttttttgagacaagtcttgctctgtcgcccaggctagagtgcagtggctcgatctcggctcactgcaacctccgcctcctgggttcaagtgattctcctgcctcagcctcccaagtagctgggattacactcttaagcctgtgagagggcaaggaagggagtagtttctggaactttgagagagttgagatgaaggagaaggtaacctgtaggaatgccagccagtgacccagtaggaaaggcatcaaggggaataaatacttcaaactcttttgctaccctctgatctcctgctgtagcctccc

SEQ ID NO: 68574 - DNA, 601 bp, Human
gttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccraaggttttgattaccagtccagactttctaggacaccacagctgcctttctgtagaacagattaacatgactctcagagtccgcaagagtagtggtgaggtgtcagttcaggggaatactcaaaggtcactgtccttttcagatatctgggtagttgctacagtatgtgcttaggaattgctggataaaaaaatattctttaaaatctcatcattttagtcgttaataatttattattataactcgtaaaaatatacctttaggcaagttattcttaggtagttatggttgctttcattt

SEQ ID NO: 68575 - DNA, 601 bp, Human
gtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccgaaggttttgattaccagtccagactttctaggacaccacagctgcctttctgtagaacagattaacatgactctcagagtccgcaagagtagtggtgaggtgtcagttcaggggaatactcaaaggtcactgtccttttcagrtatctgggtagttgctacagtatgtgcttaggaattgctggataaaaaaatattctttaaaatctcatcattttagtcgttaataatttattattataactcgtaaaaatatacctttaggcaagttattcttaggtagttatggttgctttcatttggagtccagagctttactctctatttctggagttgcaatttctgctgtccttggcccatttaaaaactttttcagaaggccttttaaattttatttttttattaaaagaaagcctgtgaatccaaagaatcttaggtggtttc

SEQ ID NO: 68576 - DNA, 601 bp, Human
tgtagggaaggaatttccacaaatggttatgaaaagtctaagtgtcttaactcccagacaaagatagagaattctgttagtaagataagtatgggactggagaagtcagctaacctctgcccttccccaatcgtgatatgctcagagaagttaagacttctttctgtgtgagaaatacgggatcttttccactagatcttgcttattatccaagaaattatcatttctagttttagagaatgatgaaactcatttgtgctttgaaatataacctgtatacatgtgcacagtaagtcatttrgctatttattgtcagactctgggagttcatagcaaacttagcaacattccatgtgcaaatttgcatatttttccccccatatcttacctacttgccttaggctgggagtctattttcctacaaaactggtaattgctcttatctctgtgtccttcagtgtgttcctctgcttattgaattcagttttatgcatttagtcttctctcctagtataagctgctcctgatacttttaaatatgtatttcagaagagaggtgctcagaattgttacttaacagaatcagcatctccctttactt

SEQ ID NO: 68577 - DNA, 601 bp, Human
gttaagtcagctactgggtcatcttttaataaaagaaaaggatggggaagagaatggattcttaagcagtgttgcctgtcagaatcaccggagggaggtttacaaaatacacattctgtactctgaccctgtgggtggggtattctgacccaagaagatgattcgttccaggaatcatgcttcttggatgatattgatgtacccccactggctttatggaaagaatattgaagaagaagatagattctcttgggggctgtgcctctagtttgaaaccagggaaggcacattttggtattaktctgtggcctcagtttcttcatcactgcaatgagattggactataggtggtctctaaggttccttcagacagtagcattttatgattttgaagacaacttttctgaagtacttttcaaactaatttctttccgtctttcttttgtaagcaaataagtagtatgagtgtaagtctctagctcagagaagaatgaagtttgcagttcgaaaaggccatgcaatagcagttcacttccccaaaatgctcagcccttgtaggatgccgttaggtcatctggaagttctgtatgccttcactggg

SEQ ID NO: 68578 - DNA, 601 bp, Human
aaaagaaaaggatggggaagagaatggattcttaagcagtgttgcctgtcagaatcaccggagggaggtttacaaaatacacattctgtactctgaccctgtgggtggggtattctgacccaagaagatgattcgttccaggaatcatgcttcttggatgatattgatgtacccccactggctttatggaaagaatattgaagaagaagatagattctcttgggggctgtgcctctagtttgaaaccagggaaggcacattttggtattagtctgtggcctcagtttcttcatcactgcartgagattggactataggtggtctctaaggttccttcagacagtagcattttatgattttgaagacaacttttctgaagtacttttcaaactaatttctttccgtctttcttttgtaagcaaataagtagtatgagtgtaagtctctagctcagagaagaatgaagtttgcagttcgaaaaggccatgcaatagcagttcacttccccaaaatgctcagcccttgtaggatgccgttaggtcatctggaagttctgtatgccttcactgggagcgtagtgaagatgagagcctttcctttg

SEQ ID NO: 68579 - DNA, 601 bp, Human
gtaagtctctagctcagagaagaatgaagtttgcagttcgaaaaggccatgcaatagcagttcacttccccaaaatgctcagcccttgtaggatgccgttaggtcatctggaagttctgtatgccttcactgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctcygctatttccgagctttgtgacctgtaggcctcaatgtcttcatctgtgaaggacaggttcagctctgatggcctatgatgtgatgaaccttgtgaacttgtaggcagagtgccacggtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaac

SEQ ID NO: 68580 - DNA, 601 bp, Human
ttcgaaaaggccatgcaatagcagttcacttccccaaaatgctcagcccttgtaggatgccgttaggtcatctggaagttctgtatgccttcactgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctccgctatttccgagctttgtgacctgtaggcctcaatrtcttcatctgtgaaggacaggttcagctctgatggcctatgatgtgatgaaccttgtgaacttgtaggcagagtgccacggtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaacgttgagttcctgctgtgttgaagatgctgttttagg

SEQ ID NO: 68581 - DNA, 601 bp, Human
ctgtatgccttcactgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctccgctatttccgagctttgtgacctgtaggcctcaatgtcttcatctgtgaaggacaggttcagctctgatggcctatgatgtgatgaaccttgtgaacttgtaggcagagtgccackgtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaacgttgagttcctgctgtgttgaagatgctgttttaggcagtgtaggagatagaagacttatatcctcctcctaatttgtattcttatcagcacctggtaccatagagagttcatata

SEQ ID NO: 68582 - DNA, 601 bp, Human
tcttcagcctgtttttctttaatgtgagcagaacagtaaagagagaatacattggaatatcttgttggttcccctgtttggctttacctacagctctttggttttcttcttttaggtcatactttcccaattagtatgtaggtatttatgatgttttgaagcccagagcgatggttccaatatcttgtggaattcagctctgagtgtgaagtcctgactttgcctctttctatcagtttgactgagcaagtcacttaacctttcttgacttcagttttccccatctatagagtgatactgyacactggtttcttttcttttctttttccccttcctttccttttcctttttcttttccttccctctccctctcctccctttgcctttgcctttccctttccctttcctgagatagagtctcactctgccgcccaagttgtattggagtgcagtagcatgctcatagctcaatgcagcatcaaatgcctgggctcaagtgatcctcctaccttagcctgccaagtagctgggactacaggagtgtgccaccatgcctgctgcttttttgtttgtttgttttttaaatttttttgtagggatg

SEQ ID NO: 68583 - DNA, 601 bp, Human
taattataaacaatagaagtttatttggctcgtggttctagaggctgggaagtccaagagcatggcactgatatctggtgagggccttcttcttgctgaataataacatgtcagaagggcaagtgagcacgcgagctagaggggatgggccaagatgtcatcctttatcaggagcccactcccaagataatggcattaatatactcatgagggcagaaccctcctgatctaaatcacctcttaaagatcccacctctcaacactgttacaatggcaattaaatttcaacgtgagttttagrggggacattcaaatcataacaggtagttagccctgttgagtaatggagaaaggattgtattagttccaaggaaagatgcatcatccagtgtgggtctggaaatatttgccagatggcttttctcttttagtaatattcatttgtggaatgtttctttaggtataaattggtgctgaagtaatttgataaggaaaaaatatcactgcctaattggtatttggtcacgagcagtaccagttcgtaagatttttttggaggtagcaaggggtggatagtgctactattggaagtttgcttatg

SEQ ID NO: 68584 - DNA, 601 bp, Human
tgagtacattacaagtaataaggtgctaagtattattttggaaacttttggttttatatgtttctgtttctacatgtattagattgtgttgtaaaagacatttctttgggactgtattttacaacacagtctcatacacgtagactctaatacacatattgaaacagtttgaaactcagtggtctaacaagtagcataccccaaatttacaatatttgtagccttctgctgttgggtacattcatgaaaaggtcttgcatccttaaagtgaaggctgaaagagttttatgtcattggggcragtgggctaccaagctcccataaattctaggagctgccttttgtctaacgattaggattattgagtactattttgatgccttttgggtatcatctgaaatgtaatcattgaattggaaatggaataaacaagagaaaggctagtttactcattatttgacaatagctctttaaagtagttaatattatgaatattcctactactaaggtttataagagtttgtttttttctttaatgttatactttaaaaagtattattcattcactgggcaaataatttttttttttctagaggaatac

SEQ ID NO: 68585 - DNA, 601 bp, Human
ctgtctccatgggtagccctccagggaacttagtagttgtctaatgttaattaccttataccacagtctaattactaagagtattgtctgagtccattcaggctgctataacaaaatgccataaacgtggtggcatataaacaaaagtccatttctctcagttctggaggccaggaagcccaagagcaaggcaacagcagatatggtgcctgatgaggcccacttcctggaaggtggccttcataaaagtggttcatagaaaatgtcttctcactgtatcttcacatggtagaaggggcamatttgctctctgggggtctcttttataaagtcactaatcttattcacgaggcctctgccttcatgatctaatgaccccccaaaggctccctcttcctcctaccatcagcttgagggttagatttcaacatatgaatttttgggggatgtaaacattcagtccattgcaggtataaatgttttcaacaagcatttgttgagtatctgtcctttttctaagctttcatgttcctactagaacactggatgtggatatccaataggaatatatttaagtcagtatcattatctttttctcaaa

SEQ ID NO: 68586 - DNA, 601 bp, Human
gcaaagtatgcagatgccaaaaagtgagattgctaggtcaaaacgaacatgcgtttaaaatgttgatagataccaacaaattgctttacaaaagttcctatcagtttgtatatcagtttttctaagtcctttttaaacatggactggattagcccgttcttgcattgttgttaagaaatacctgagtctgggtaatttataaagaaaagagggttaattggctcatggttctgcatatttgtacaaacatggcttcaacatctgcttccggtgagacctcaggaagcttacaatcatggcrgaaggcaaaacttgagcaggcacgtcacatggcaagagtgagagcaagaaagagagtggggggaggtcctaggcttataaacaaccggatctcacctgaactaactgagcaagaactcattcatgaaagatgcacccccgtgatccagtcatctcccaccagacctcatctccaatgtcgggaatcacatttcaacatgagatttggaggataggcatccaaaccatatcatggacctagcatacttctcccagcctcacgtctctgatttaagtgttcactcatttacttgggcactgt

SEQ ID NO: 68587 - DNA, 601 bp, Human
aaatgttgatagataccaacaaattgctttacaaaagttcctatcagtttgtatatcagtttttctaagtcctttttaaacatggactggattagcccgttcttgcattgttgttaagaaatacctgagtctgggtaatttataaagaaaagagggttaattggctcatggttctgcatatttgtacaaacatggcttcaacatctgcttccggtgagacctcaggaagcttacaatcatggcggaaggcaaaacttgagcaggcacgtcacatggcaagagtgagagcaagaaagagagkggggggaggtcctaggcttataaacaaccggatctcacctgaactaactgagcaagaactcattcatgaaagatgcacccccgtgatccagtcatctcccaccagacctcatctccaatgtcgggaatcacatttcaacatgagatttggaggataggcatccaaaccatatcatggacctagcatacttctcccagcctcacgtctctgatttaagtgttcactcatttacttgggcactgttacttgggcactgtcagcccctgtccatgtttgtattcagtataaattgtgtgccgg

SEQ ID NO: 68588 - DNA, 601 bp, Human
ttcactcatttacttgggcactgttacttgggcactgtcagcccctgtccatgtttgtattcagtataaattgtgtgccgggcactctgccacatgttggggatttagtactggatgagacagaaatggtccctgccatcatgtagcttacactttgccacatagaacttttgccatatgcagactctttttatgcatttgcagctactatcctctctttctggtatgacttttttccttttaacttttctacctagagaattttctttcatccttttaaccagcttaaattttgccctcygtcattatctttatcccttcagagttagatagtccttcctcagtgctccatcttggcactcatatgctttttgtggctattcccctgagaagttttcgtgatttgtttgtatatgtatgtgcctgtgtgtgtgtgtgtgtgtggacacacatctacatcttgcatattagattgtaaactcagtatagacttggaactatgatatgtacctgaacacttccccagcttactgccttcaaccctggagatgcttaatcaatgttgattaagtgaatgaatagtaaactataaaatgacctt

SEQ ID NO: 68589 - DNA, 601 bp, Human; identical to SEQ ID NO: 29047

SEQ ID NO: 68590 - DNA, 601 bp, Human; identical to SEQ ID NO: 29048

SEQ ID NO: 68591 - DNA, 601 bp, Human; identical to SEQ ID NO: 29049

SEQ ID NO: 68592 - DNA, 601 bp, Human; identical to SEQ ID NO: 29050

SEQ ID NO: 68593 - DNA, 601 bp, Human; identical to SEQ ID NO: 29051

SEQ ID NO: 68594 - DNA, 601 bp, Human; identical to SEQ ID NO: 29052

SEQ ID NO: 68595 - DNA, 601 bp, Human; identical to SEQ ID NO: 29053

SEQ ID NO: 68596 - DNA, 601 bp, Human; identical to SEQ ID NO: 29054

SEQ ID NO: 68597 - DNA, 601 bp, Human; identical to SEQ ID NO: 29055

SEQ ID NO: 68598 - DNA, 601 bp, Human; identical to SEQ ID NO: 29056

SEQ ID NO: 68599 - DNA, 601 bp, Human; identical to SEQ ID NO: 29057

SEQ ID NO: 68600 - DNA, 601 bp, Human; identical to SEQ ID NO: 29058

SEQ ID NO: 68601 - DNA, 601 bp, Human; identical to SEQ ID NO: 29059

SEQ ID NO: 68602 - DNA, 601 bp, Human; identical to SEQ ID NO: 29060

SEQ ID NO: 68603 - DNA, 601 bp, Human; identical to SEQ ID NO: 29061

SEQ ID NO: 68604 - DNA, 601 bp, Human; identical to SEQ ID NO: 29062

SEQ ID NO: 68605 - DNA, 601 bp, Human; identical to SEQ ID NO: 29063

SEQ ID NO: 68606 - DNA, 601 bp, Human
gcagtgcctgtaatcccagcactttgggaggccaaggcgggcggatcacctgaagtcaggagttcgagaccaagctggccaacctgatgagatcccatctttactaagatacaaaaaattagctgggcgtggtgatgcacacctgtaatcccagctactcggaaggctgaggcaggagaatcgcttgaacccgggaagcagaggtggcagtgagctgagagccgagagccgagatcgtgccactgccctccagcctgaacaacagagactccatctcaaaaaaaaaaaaaaaaaaaaaaaagctgggcgcgctggctcacgcctgtaatcccagcactttgggaggccgaggtgggcggatcatgaggttaggagttcgagaccagcctggccaatatggtgaaaccccgtctctactaaaaacacaaaaattagccaggcgtggtggcgcttgcccgtagtcccagctacttgggaggctgagacagaagaatcgcttgaacccaggaggcagaggttgcagtgagccgagatcatgccactgcactccagcctgggcgacaaagcgagactctgtctcaaaaaaaaaaaatgtccctag

SEQ ID NO: 68607 - DNA, 601 bp, Human
cactttgggaggctgaagcaggttgatcacttgaagtcaggagttcaagatgagtctggccaacatatcgagatccctgcaccccctgccccatctttagctgggcatggtggcacatgcctgtaatcccagctatttaggaggctgaggcacgagaatcacttaaacctgggagatggaggttgcagtgaccactgcactccagcttgggcaacacagtgagattctgtctgaaaaaaaaaaaaaggccgggcatggtggctcatgcctgtaatcccagcacgttgggaggctgaggtgsgcggatcacgaggtcaggagatcgagaccatcctggctaacatggtgaaaccctgtctctactaaaagtacaaaaaattagccgggtgtggtggcgggcacctgtagtcccagctactcgggaggctgaggcaggagaatggcgtgaacccgggaggcggagcttgcagtaagccgagattgctcaactgcactccagcctaggcaacagcacaagactccctctcaaaaaaaaaaaaaaattgcagggatattttgtaaaatttgtagtgataaaagtggacaaaagacataaagataa

SEQ ID NO: 68608 - DNA, 601 bp, Human
tttacctcttgacactgttttagttggggatgacaagaatgacccaatcaactttcacaagctaacaggaaaaaatatcgtttctaaaaacaacaaggccgggcatggtggctcacgcatgtaatcctagcacattgggaggccaaggcaggcagatcgcctgaggtcaggagttcaagaccagcctggccaacatggcaaaaccccgtctctactaaaaaatcaaaaattagctgggggtggtggtgcacacctgtaaccccagctactcaggaggctgaggaaggagaatcgcttgaayccaggaggtgaaggttgcagtgagccaggtggaggttgcagtgagccaagattgcgcctctgcacttcagtatgcgcgacaggagtgagactatctcaaaacaacaacaacaataacaacaaaattagccggcatggtggctcacacctgtaatcccagcactttgggaggctgaagcaggttgatcacttgaagtcaggagttcaagatgagtctggccaacatatcgagatccctgcaccccctgccccatctttagctgggcatggtggcacatgcctgtaatcccagctatttagg

SEQ ID NO: 68609 - DNA, 601 bp, Human
tgggaggctgaggcaggagaatcacatgaacctggaggcagaggttgcagtgagccaaaatcatgccattgcattccagcctgggcgacagagtgagactccatctcaaaacaaacaaacaaaaaaactggtttaggttatagcgggcagtttcagcagccaggcttacagataattacatttttggagcaatgttatgtgccctgagtgcttttttttccctttacctcttgacactgttttagttggggatgacaagaatgacccaatcaactttcacaagctaacaggaaaaaatatsgtttctaaaaacaacaaggccgggcatggtggctcacgcatgtaatcctagcacattgggaggccaaggcaggcagatcgcctgaggtcaggagttcaagaccagcctggccaacatggcaaaaccccgtctctactaaaaaatcaaaaattagctgggggtggtggtgcacacctgtaaccccagctactcaggaggctgaggaaggagaatcgcttgaatccaggaggtgaaggttgcagtgagccaggtggaggttgcagtgagccaagattgcgcctctgcacttcagtatgcgcg

SEQ ID NO: 68610 - DNA, 601 bp, Human
aacacgttgggaagccaagatgagaggttcacttgagcccaggagtttgggagtgcagtgagctgtgatcacaccggaacactccagcctgggcaacaaagcaagaccctatatcaaaacaaacaacaaaaaaagagaactgttgtatattgttctttaagaaagttcattgtcactagtaaggttttggggagctggcaagttttgattggcaagtaatggcaactaggtaaaacgatccttagagtcactgcaggttgtttttagcagctaattagataaaactggtttaggtcagccrggcacggtggctcacgcctgtaatcccagcgctttgggaggccgaggcgggtggatcacctgaggtcaggagttcaagaccagcctgaccaacatgatgaaaccccgtctctgctaaaaatacaaaaattggctgggtatgttggcgggtgcctgtaatcccagctacttgggaggctgaggcaggagaatcacatgaacctggaggcagaggttgcagtgagccaaaatcatgccattgcattccagcctgggcgacagagtgagactccatctcaaaacaaacaaacaaaaaaactgg

SEQ ID NO: 68611 - DNA, 601 bp, Human
aggtcaggagttcgagaccagcttggccaacatggcaaaaccccatctctactaaaaatacaaaaattagcccggcatgggggcgggcacctgtaatcccagctactggggaggctgaggcaggagaattgctttaacccgggaggcagaagttgcagtgagccccagattgcaccactgtcctccagcctgggcaataaaagtgaaactccatctaaaaaaaaaaaaaaaaaaagaaagaaaaaaagaaaagaaaaagaaaaaggctgtccaagtaaaataaaatacagagacaaatctmtaaatttaaaacatttgggaagcaataattgccattcagggcatacacacaaacagggtggtctttggtacgtcagaagaacaaacagatggttagaggttttatttttgtaaaagagaaatatagccaggaacagtggctcatgcctgtaatcccaacacgttgggaagccaagatgagaggttcacttgagcccaggagtttgggagtgcagtgagctgtgatcacaccggaacactccagcctgggcaacaaagcaagaccctatatcaaaacaaacaacaaaaaaagagaactgtt

SEQ ID NO: 68612 - DNA, 601 bp, Human
ggcaaataaatatccgggctacaagggtcatctcctgaaacatggcttgtaaacacgtgattagccatccttttctctagtatcctactcttttcaaggtaagccatgggaaaatagagcagcagttctcctgggaatcaggggtacaaaaaggctgtccaagccaggcgcagtggctcacgcctgtaatcccagcactttgggaggctgaggcgggtggatcacctgaggtcaggagttcgagaccagcttggccaacatggcaaaaccccatctctactaaaaatacaaaaattagccmggcatgggggcgggcacctgtaatcccagctactggggaggctgaggcaggagaattgctttaacccgggaggcagaagttgcagtgagccccagattgcaccactgtcctccagcctgggcaataaaagtgaaactccatctaaaaaaaaaaaaaaaaaaagaaagaaaaaaagaaaagaaaaagaaaaaggctgtccaagtaaaataaaatacagagacaaatctataaatttaaaacatttgggaagcaataattgccattcagggcatacacacaaacagggtggtctttggtacg

SEQ ID NO: 68613 - DNA, 601 bp, Human
tcctggacatgtattccggaactttaaattaaaaaaaatatatcaacaatcacaaggaggcctagaagagtcattgccaatcctactgagaattgtccagaatcagaagtttacaccaggataggacgaggactcgctttttcctctgccaacatctagttcatgctattgggaactctgcttcttcatttggagtcaaagggagatgatgaaaaaacactttctatgcttacctggatgggctttttttttttctccacagaattaccatactgagatttttgtgatatatgcaagattygtgtgtgtgtgtgatgctggttattattatgtcatagtggacacttattaacgttgccttcacttttcttttttttttatttatttattttattttatttaagacagggtctcactctgttgcccaggaaagagtgcagtgggtttatcaccattcattgcagcctggaactcctgggctggagcaatcctctgacctcagcctgtgcccctgtggtcccaccaccatgcctggctaatttttttgtaaagacggcggtggtgggcagggcgtggggggaggtctctctatgttgcccag

SEQ ID NO: 68614 - DNA, 601 bp, Human
gttaatctgcagatcttagccccacttcagaccctctgagtcgaaaattcggggcaatctgaatttttaacaaacaccagcaccgttccacgtgatccgatctgcgctcaggttaaagattcccagcttttttagattcattctaaaagaatcctgtcagtgaattagagcaaactgtttaaaaatcctgataaccgggggaggggagcatcaagataaatagctaatacatgcggagcttaatacctaggtgatgggatgatagttacagcaaaccaccatggcacacatttacctgtgtaacaaacctgcacgtcctggacatgtattccggaactttaaattaaaaaaaatatatcaacaatcacaaggaggcctagaagagtcattgccaatcctactgagaattgtccagaatcagaagtttacaccaggataggacgaggactcgctttttcctctgccaacatctagttcatgctattgggaactctgcttcttcatttggagtcaaagggagatgatgaaaaaacactttctatgcttacctggatgggctttttttttttctccacagaattaccatactgagatttttgtg

SEQ ID NO: 68615 - DNA, 601 bp, Human
cagggcgattaatagtgtcggtagtgttagaccgtggtttagcacgagtagcaacagtgaacagctaaaccccgggactggccaccagcagggagcctcccacggagcccgttaatctgcagatcttagccccacttcagaccctctgagtcgaaaattcggggcaatctgaatttttaacaaacaccagcaccgttccacgtgatccgatctgcgctcaggttaaagattcccagcttttttagattcattctaaaagaatcctgtcagtgaattagagcaaactgtttaaaaatcctgrtaaccgggggaggggagcatcaagataaatagctaatacatgcggagcttaatacctaggtgatgggatgatagttacagcaaaccaccatggcacacatttacctgtgtaacaaacctgcacgtcctggacatgtattccggaactttaaattaaaaaaaatatatcaacaatcacaaggaggcctagaagagtcattgccaatcctactgagaattgtccagaatcagaagtttacaccaggataggacgaggactcgctttttcctctgccaacatctagttcatgctattgggaac

SEQ ID NO: 68616 - DNA, 601 bp, Human
ttaaacctcaaaatgaatgattagatatattccggctttggtcctggcattcgttatacatttattttggtcttttgagtcgaccttgtggttgccccgggtgaccacgtgggtagctgaatctgctaagcagcagttcccaggccccatctggtgctagaggatgagggcctcacccgtctggggtcgcggctgtcttgaggaccagggcgattaatagtgtcggtagtgttagaccgtggtttagcacgagtagcaacagtgaacagctaaaccccgggactggccaccagcagggagyctcccacggagcccgttaatctgcagatcttagccccacttcagaccctctgagtcgaaaattcggggcaatctgaatttttaacaaacaccagcaccgttccacgtgatccgatctgcgctcaggttaaagattcccagcttttttagattcattctaaaagaatcctgtcagtgaattagagcaaactgtttaaaaatcctgataaccgggggaggggagcatcaagataaatagctaatacatgcggagcttaatacctaggtgatgggatgatagttacagcaaaccaccatggca

SEQ ID NO: 68617 - DNA, 601 bp, Human; identical to SEQ ID NO: 29252

SEQ ID NO: 68618 - DNA, 601 bp, Human; identical to SEQ ID NO: 29253

SEQ ID NO: 68619 - DNA, 601 bp, Human; identical to SEQ ID NO: 29254

SEQ ID NO: 68620 - DNA, 601 bp, Human; identical to SEQ ID NO: 29255

SEQ ID NO: 68621 - DNA, 601 bp, Human; identical to SEQ ID NO: 29256

SEQ ID NO: 68622 - DNA, 601 bp, Human; identical to SEQ ID NO: 29257

SEQ ID NO: 68623 - DNA, 601 bp, Human; identical to SEQ ID NO: 29258

SEQ ID NO: 68624 - DNA, 601 bp, Human; identical to SEQ ID NO: 29259

SEQ ID NO: 68625 - DNA, 601 bp, Human; identical to SEQ ID NO: 29260

SEQ ID NO: 68626 - DNA, 601 bp, Human; identical to SEQ ID NO: 29261

SEQ ID NO: 68627 - DNA, 601 bp, Human; identical to SEQ ID NO: 29262

SEQ ID NO: 68628 - DNA, 601 bp, Human; identical to SEQ ID NO: 29263

SEQ ID NO: 68629 - DNA, 601 bp, Human; identical to SEQ ID NO: 29264

SEQ ID NO: 68630 - DNA, 601 bp, Human; identical to SEQ ID NO: 29265

SEQ ID NO: 68631 - DNA, 601 bp, Human; identical to SEQ ID NO: 29266

SEQ ID NO: 68632 - DNA, 601 bp, Human; identical to SEQ ID NO: 29267

SEQ ID NO: 68633 - DNA, 601 bp, Human; identical to SEQ ID NO: 29268

SEQ ID NO: 68634 - DNA, 601 bp, Human; identical to SEQ ID NO: 29269

SEQ ID NO: 68635 - DNA, 601 bp, Human
aggttatgaccggctcacccaggggcctgggaaggctatggccatatgcccacttcactctgcaggacaagtggcctgtccccactatattcacctcctcacccctctcccttggatggaccagtggtggtgtcacccaaagcaaattgacactatttttcccttggtaaccgcaaagggggagaatcacccgtctcctaattttaaccagtacgtgagggaccagggcgccatgaccgaccagctgagcaggcggcagatccgcgagtaccaactctacagcaggaccagtggcaagcaygtgcaggtcaccgggcgtcgcatctccgccaccgccgaggacggcaacaagtttggtgagagttggccctccccccagggcacccacacctccactctgcctcacttccaccctgcctcacctcctggtccatccccagatcctgtgtcagggctgagggccccaagggcctgagtgtccccaaccccttcgcctgagtctggaggtcagtgtggctgggtggtcccctgctgtagccataggccggcagccccgatggacggaggtctttctcccctcccccaccacagccaagctcat

SEQ ID NO: 68636 - DNA, 601 bp, Human
taagtcaggatggggacaccaagaccactaagccagggacccttggggagctgtttgtgggccaagagccactataggggtccgtagaaagggctgtccgtagacagccctgagtcagaagccatgagaaacttcagaagtcaggggacacttctcagagaaaaaccacatacgagctggagccagaataaggaggagctcgcccggtggagaaggaggaaggcattccaggaaggagggagactctgtatcaccgcatggaggtgatcacttggggagagagaggggctgaccatggctrggggaagcagcagggagagacaggtgaagcaggctctcttgggtccctcaaaactagaccctgcttctaagcttctatgtgtctatgggtttgttagaatccaggccacctcctccaagaagccttctctgatctcctcagcccttccctgtccatccatcgcatcggctgtccagccctaggcagccgtgggagggtgttcagcttgtatagggagaagaggggacagcctcatgacctcatgcctgtctccctgcctgccccaccgtgtcaggactactccgcagctccccggggccg

SEQ ID NO: 68637 - DNA, 601 bp, Human
cgcatggaggtgatcacttggggagagagaggggctgaccatggctaggggaagcagcagggagagacaggtgaagcaggctctcttgggtccctcaaaactagaccctgcttctaagcttctatgtgtctatgggtttgttagaatccaggccacctcctccaagaagccttctctgatctcctcagcccttccctgtccatccatcgcatcggctgtccagccctaggcagccgtgggagggtgttcagcttgtatagggagaagaggggacagcctcatgacctcatgcctgtctccytgcctgccccaccgtgtcaggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggtgagaggtgtgggatgcacagcagtgggcacaggacatgccagacagaggggctaggtgggatgggcgataggaaactgtccaaggggagtggaggggaggaggcaaggggcacagctag

SEQ ID NO: 68638 - DNA, 601 bp, Human
acatcatgaagatagctccagagagcatccccagtcttgaggctctcactagaaaagtccacaacttccaggtgtgtgtgtgtgggtgaaaagagtgggctgtctccctcccagggctgctgggaggagtgtccgaatggtggctatttgtcacctgtaaagcactgttcctcattggctgccagctgactgcccctctcctattcccctgcacgactcctttccttcccaccccactgccaagctgctgggctcagctgagtccactcactacctggtggcttctgactctagcacagcycctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggccc

SEQ ID NO: 68639 - DNA, 601 bp, Human
tcagttcagaagcaattctttctttactgattattatttatctttgtttattaattttaagcacagttgcttacatttgtagtaggctgaactgttttctttcctgactgatcttttccagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagtgtgcgtaagatctgaaaatcctaaaggataacrggcgcttcggaaacgttattctggttctctgtgtaggaatggcatgggatggcttctgttccctgatttttctaggtgtccctgacttattttcacttttaagaagtaccatacctaccaggttggcaaaacagccatacagtctcatcaagaaaatctctttgaacatgcatttctgttctgtaatttttcatcctaaatttccagaacttgttttctgcttttacatttaagtgccacatcctgtcctttccagaataagataggactgtagataaatgacctttgtgtttgtttatt

SEQ ID NO: 68640 - DNA, 601 bp, Human
tcttaaatttttatacctggtggtattatgtaatattaacataaatggatagtctgagggactaccatcttaaggactttctgtgtcatagaaaattgtccttgacccttgattaaaatactttaatgcttctgagcctgttcctgttttatggcattgtatataatatagccacatggaggaattcttccttaggcattttgatcacatggaatgctttgagtctccgtaaggttaaaacttgttaaacccacatttgagaatgtgataaagctattccattgcttaaggcataattctyctttctcacaaataaccttaagtttacttttaaactatcatatacattccccagcccaatagctgattgatagctgcgctgatggaaagatacaatttggagacaactatacagcatagtgtgatggtttcctctaatacttcttttcttttttccccaatatcatgccatagaaatattttgaggtgaaactgtttgaaatatcattataacagatactaaggggagatttcttggtttaaatgaggggagagattttttctaatctctatttttctgaaaagatgccctctagtgtct

SEQ ID NO: 68641 - DNA, 601 bp, Human
taaaatccagaggatcaaatctgccaaaactgattgccttttcttgaatctgagcagagatctccaagttaaaaaccttgtgactggcttactcaatacaattttaagtcctttttccctctcttttcacagtcctcttactcccagttactggcagctacatgccttaccaagcttgtatcacgcacaaacaaccccctaccattggaacagcgaatagatattcgtaagtggagaattttctgttctgtcttgaagaaaatagtttgtttagtgatgtgctagtaatagtcaaatgtaygtgtttgttcaatgatatgctgagattgctaaccatacaaaatgtctagaatccagttcgtttccagaatttggggcttatgaaagtgaagggcccgacgcaataacttctggataaagcctaagtcctcccttttgttatcgggagatttcttcattcatcttttctttactgccactaataactaagaaaaacattgttaatgattttgaattctgtgtagaccacgttctttagctacctagggatagagtcaaagcagctatactgcaaattcttcatgagacaaaataaaattct

SEQ ID NO: 68642 - DNA, 601 bp, Human
ttgggttaaatagtctaaatttataatttcttggccatttagcatgtctaaagatatacacccttctctggcagagctttctattatgtggattggttttgtttcttgtttttttttaatagggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggtacagtgtatrtatttgatgtaatgggaatgggagaaccagcatatacatatatataaacacacacacacacacacacacacaacttaacacgcttatctactttttaaacatgacacaaaatagaattatatgatatattctcttctgcatgttttttacccttaataggtcttggtagtgtttgcatgttggcaaaaacaaaccatgtctcagtctttcaaattcctacatatggtcccaagcaaaaatatgtttaattaattagttaatattttatagatgggcatttctttcgagtgttaaattaat

SEQ ID NO: 68643 - DNA, 601 bp, Human
aagatatacacccttctctggcagagctttctattatgtggattggttttgtttcttgtttttttttaatagggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggtacagtgtatatatttgatgtaatgggaatgggagaaccagcatatacatatatataaacccacacacacacacacacacacaacttaacacgcttatctactttttaaacatgacacaaaatagaattatatgatatattctcttctgcatgttttttacccttaataggtcttggtagtgtttgcatgttggcaaaaacaaaccatgtctcagtctttcaaattcctacatatggtcccaagcaaaaatatgtttaattaattagttaatattttatagatgggcatttctttcgagtgttaaattaatacttcagtgaatagcccagtacatatattttgaataagtgcgtttgtagg

SEQ ID NO: 68644 - DNA, 601 bp, Human
ctttctgtctccaggttgttttccccttttccatcttagcttttttttttttattggtactaattatcattttagagataaaagcgatcgcagcactttgggaggccgaggcaggcggatcacctgaggtcaggagatcaagaccagcctggctaacatgttgaaaccctgtttctactaaaaatacaaaaaattagccgggcgtggtggcatgtgcctgtagtcccagcgacttgggagacaggcaggagaatcgcttgaacccgggaggtggaggttgcagcgagccaagatcgcgctrttgcactccagcttgggcaacaagagcgaaactccatctcaaaaaaagcaaaatactactgccttgcccatgaaggagaatgacttcaaaaaagagaccataaaggtcgaccttttgtgtgccccttctgctcctatatactttaaattttttaaatggtcattgatgccacagaatactacagaggaaacaccagtggctttcttttgtcctggctatattttagtcatttacttttttatccagctaaaaatttgtgattatagaacaggcccttatcaatattagctataacatctc

SEQ ID NO: 68645 - DNA, 601 bp, Human
catgtgcctgtagtcccagcgacttgggagacaggcaggagaatcgcttgaacccgggaggtggaggttgcagcgagccaagatcgcgctgttgcactccagcttgggcaacaagagcgaaactccatctcaaaaaaagcaaaatactactgccttgcccatgaaggagaatgacttcaaaaaagagaccataaaggtcgaccttttgtgtgccccttctgctcctatatactttaaattttttaaatggtcattgatgccacagaatactacagaggaaacaccagtggctttcttttgycctggctatattttagtcatttacttttttatccagctaaaaatttgtgattatagaacaggcccttatcaatattagctataacatctcacccttaagttggaagcatattaatgatatcagcattactgttgctattgctcataattctgcagacatttttattaaccctgagaaatcttaactgtgagttggtcctatttcaaatgtgttagcttagagcctgtgaaaattgggagtccatgttgtgttttcttgccacatgcaatccccgttgtgatcagtaattaccaaaataat

SEQ ID NO: 68646 - DNA, 601 bp, Human
tataacatctcacccttaagttggaagcatattaatgatatcagcattactgttgctattgctcataattctgcagacatttttattaaccctgagaaatcttaactgtgagttggtcctatttcaaatgtgttagcttagagcctgtgaaaattgggagtccatgttgtgttttcttgccacatgcaatccccgttgtgatcagtaattaccaaaataataacagcttacacttttgagtgattactgttaccaccattctaagcactttatagtaactaattttattctcagaacagtmatatgaggtaggtactgtgtttatcccattttctggatcaggaaactgaggcccataaagatgaaatcatttgcctaaggtttcacaagcaacagatgtgattcaaacccaaatagtcttattctagggcctgtgttcttaacaactaatgtactatttaaccactcttatctttgcagcagaagagcagatgcattaactaaggatagagattgtggacttaatgttttcccctttgaagcttggccccacagagtacataaattttgatatatgtataataaaaaacttcaagatttt

SEQ ID NO: 68647 - DNA, 601 bp, Human
aaataggttagaaaaggaggtgaatattatgggctgttgtcatttgtaaattctgcagtaacttcagcgttgagggttttttttgtttttgtttttgttttgagttttgcttactgaaatcaaagagttgttactctgtctgtgggtgtttaagagactctgctgcccaggctggagtgcagtgcagccacgaatgcctgggctccaggccctcctgagtagctaggacttacaggcatgcaccaccacaccgatttttttatttttttatttttattttttttagtttttagaggtggtggggggtctcactgtgtctgcttctgggctcaaatgatcctcctgcctcaacctcccaaagttctagaattacagaggtgagtcaccacgcctggcccattaagccacagtacaacatgaaagtaattatcagtaacgtctgccaacaatttaagttttacctccctgaatacagaggaaaataagaatttgcagcagagattatccatccttttgttttccctctgtaagctagagagaaaggataccctggctattagcagtttactatcctccatcctttcactagatagcgtttcac

SEQ ID NO: 68648 - DNA, 601 bp, Human
tgtttttgttttgagttttgcttactgaaatcaaagagttgttactctgtctgtgggtgtttaagagactctgctgcccaggctggagtgcagtgcagccacgaatgcctgggctccaggccctcctgagtagctaggacttacaggcatgcaccaccacaccgatttttttatttttttatttttattttttttagtttttagaggtggtggggggtctcactgtgtctgcttctgggctcaaatgatcctcctgcctcaacctcccaaagttctagaattacagaggtgagtcaccacrcctggcccattaagccacagtacaacatgaaagtaattatcagtaacgtctgccaacaatttaagttttacctccctgaatacagaggaaaataagaatttgcagcagagattatccatccttttgttttccctctgtaagctagagagaaaggataccctggctattagcagtttactatcctccatcctttcactagatagcgtttcacaataatttaaatgttaaaaatgtattttatgtttatgttgctcttactggaaatccttctagcttataggaagtctacatgaaaaattc

SEQ ID NO: 68649 - DNA, 601 bp, Human
cagggctttctttaaataccaacttcatgtttttatagtaaatatgttttaatagtatataaggagctaggtattttcatagtcacaggtgatagaagtaccacatctttggagagaaggggacattttactgtgctaacatatagccctccttttctgacttaacagctttgttgagtctgggagcaagctgggaagagaggagtgattttggggactcattatgtggtaatttttacaggcttcaggaaagaatctaaacttgaatgatgaaagtcagcatggcttgctcatgcaactsctcaagctcactcataactgcctcaactttgacttcatcggcacttccactgatgagtcctcagacgacctgtgtacagtgcagattcccaccagctggagatcaggtaacagaacttcctccacctcaaaggctgtctgtcactcccctacagagtgtctgtagaatgatctaaagaactcctggcaactcctgtgtattctgagggagaattgagaaaaaattctaacgtctttttttgtttgtttgttttttaaagacagggtctcactctgtcacccaggctggagtgcagtggca

SEQ ID NO: 68650 - DNA, 601 bp, Human
aaatatgttttaatagtatataaggagctaggtattttcatagtcacaggtgatagaagtaccacatctttggagagaaggggacattttactgtgctaacatatagccctccttttctgacttaacagctttgttgagtctgggagcaagctgggaagagaggagtgattttggggactcattatgtggtaatttttacaggcttcaggaaagaatctaaacttgaatgatgaaagtcagcatggcttgctcatgcaactgctcaagctcactcataactgcctcaactttgacttcatyggcacttccactgatgagtcctcagacgacctgtgtacagtgcagattcccaccagctggagatcaggtaacagaacttcctccacctcaaaggctgtctgtcactcccctacagagtgtctgtagaatgatctaaagaactcctggcaactcctgtgtattctgagggagaattgagaaaaaattctaacgtctttttttgtttgtttgttttttaaagacagggtctcactctgtcacccaggctggagtgcagtggcacgatcacagctcagtgcatcctcaacctcctggactcaa

SEQ ID NO: 68651 - DNA, 601 bp, Human
gtcactcccctacagagtgtctgtagaatgatctaaagaactcctggcaactcctgtgtattctgagggagaattgagaaaaaattctaacgtctttttttgtttgtttgttttttaaagacagggtctcactctgtcacccaggctggagtgcagtggcacgatcacagctcagtgcatcctcaacctcctggactcaagcagtcttcccatctcagcctcccaagtatctggaactacaggcacatgccaccacacccggctaattttgtttgtttatgttttgtagaagtggggtctmacaatgttgcccaagctagtcttgaactcctgggttcaagtgattctcctatcttggcctcccagagtgctgggactacaggtgtgagccactgtgcccagccagtaacatctattttataatgttggggaggttgttggagtaatctcatagatcccccagtgtcaaagaacttttaaaattgccgattaataatagatatgtatttcacctttttgcattaattgcctagagacttctgtaatctatttagggtaataactatctttaaaaacaaaatcaaacacaacaacttgttct

SEQ ID NO: 68652 - DNA, 601 bp, Human
cagtcttcccatctcagcctcccaagtatctggaactacaggcacatgccaccacacccggctaattttgtttgtttatgttttgtagaagtggggtctaacaatgttgcccaagctagtcttgaactcctgggttcaagtgattctcctatcttggcctcccagagtgctgggactacaggtgtgagccactgtgcccagccagtaacatctattttataatgttggggaggttgttggagtaatctcatagatcccccagtgtcaaagaacttttaaaattgccgattaataatagatrtgtatttcacctttttgcattaattgcctagagacttctgtaatctatttagggtaataactatctttaaaaacaaaatcaaacacaacaacttgttcttatgtttgcctttgtattccagaaggataaaagttttaaattctttttatggacagaggtgttcaggttaagttctcagagaattgaaagaagaaatctgtttcttagagaagctaaaatagtactttcaaaaaaagaaaagaggccgggcgtggtggctcacgcctgtaatcccagcactttgggaggccgaggcaggca

SEQ ID NO: 68653 - DNA, 601 bp, Human
cagcctcccaagtatctggaactacaggcacatgccaccacacccggctaattttgtttgtttatgttttgtagaagtggggtctaacaatgttgcccaagctagtcttgaactcctgggttcaagtgattctcctatcttggcctcccagagtgctgggactacaggtgtgagccactgtgcccagccagtaacatctattttataatgttggggaggttgttggagtaatctcatagatcccccagtgtcaaagaacttttaaaattgccgattaataatagatatgtatttcaccttyttgcattaattgcctagagacttctgtaatctatttagggtaataactatctttaaaaacaaaatcaaacacaacaacttgttcttatgtttgcctttgtattccagaaggataaaagttttaaattctttttatggacagaggtgttcaggttaagttctcagagaattgaaagaagaaatctgtttcttagagaagctaaaatagtactttcaaaaaaagaaaagaggccgggcgtggtggctcacgcctgtaatcccagcactttgggaggccgaggcaggcagatcactatgtcag

SEQ ID NO: 68654 - DNA, 601 bp, Human
tactctgtaagataagtaggcagaaggatgtgctccctgatgtatagtgctggaagtatgccagcggcaatgttcatacttaataaagtgatgtcttttgtctttttcttccccagccttcttagattcttcaaccttgcagctgttttttgacctgtatcattccatccctccttcattttcacctctggtgagtcaggactaccgtttcttaaagcaaacctattcatagaagatagcaatggtgaatgaaccttatattcgttttgttttataaaattatacaagtaaagcatagaartactaggctagttatctagtcttttgagattaagcttgtagcctaaaggttccagccataaagtcttaattatttttaaattattcctgtctaaaggccaattcctgcagatggtcaagctcttttgggtctcatcgtgtatctgactttatgctgttcctcaaacggccacaggctagcacctggggattcacctaatactgtctagttgaactattaagattgtcctgactcagaaaaccccttaggtgtacattagattgtcataaatggaaactgtgatgagaaggctaatttgca

SEQ ID NO: 68655 - DNA, 601 bp, Human
tccatccctccttcattttcacctctggtgagtcaggactaccgtttcttaaagcaaacctattcatagaagatagcaatggtgaatgaaccttatattcgttttgttttataaaattatacaagtaaagcatagaaatactaggctagttatctagtcttttgagattaagcttgtagcctaaaggttccagccataaagtcttaattatttttaaattattcctgtctaaaggccaattcctgcagatggtcaagctcttttgggtctcatcgtgtatctgactttatgctgttcctcraacggccacaggctagcacctggggattcacctaatactgtctagttgaactattaagattgtcctgactcagaaaaccccttaggtgtacattagattgtcataaatggaaactgtgatgagaaggctaatttgcatacttaccctgaataacatttgaaagctattgggaatggtgtatttctcttttaaagccataattaacctaaaacctcaaaattcattcacgttctaaaatactattggtctggtatttcagattgttggtgtaaattaccggttggtgttatacacaaaata

SEQ ID NO: 68656 - DNA, 601 bp, Human
gcaagaaaaggtagcacagtcaagagggatgattaagagagtactacttgcaaaggtatgggtaaaattaagggacaccagcacggggtggtggtgcatgcccctggggctggcagtagtggggagcctcaaagggcaagtgaaggaaacctggagagagttgaagctgtgtcttagaggagggctggacaacaagaactacagccatcactagagaaactctgccactgcatagccagctggatggtcggaagaggggtaccctgttccctctgccctctaatctcctgctggtactttscattggttgaagccaactagaagccagagggcaagggagcttggctgctctcctcaacagaggtcagcctcctagggaatagggcagggtggaaaagggtcgaaagcagatctagagggggcaaacagagaatgtaaatatctaacacagtgggaacagagggaaatgtcttcagggataaagctgggttgtgtttttttgtttgtttgtttgaggcagagttttgatcttgttgcccatgctagagtggaatggcactacccatgggttcaagcgattctcctgcctcagcctcctgag

SEQ ID NO: 68657 - DNA, 601 bp, Human
gctgctctcctcaacagaggtcagcctcctagggaatagggcagggtggaaaagggtcgaaagcagatctagagggggcaaacagagaatgtaaatatctaacacagtgggaacagagggaaatgtcttcagggataaagctgggttgtgtttttttgtttgtttgtttgaggcagagttttgatcttgttgcccatgctagagtggaatggcactacccatgggttcaagcgattctcctgcctcagcctcctgagtagctggaattacaggcatgagccaccacgcccggctaattttrtattttcagtagagacagggtttctccatgttggtcaggctggtctcaaactcccgacctcaggtgatctgcctgtttcagcctcccaaagtgctgggattacgggcgtgagccaccacacctggccaaagctggcttttttagggcccagatgtgatatgcttatttcttttttttttctttttttttttcgtttttttttgtttttgagacggagtctctcactgttgcccgggctggagtgcagtggcgcgatctcggctcactgcagcctccgcctcccagcttcaagcgattctc

SEQ ID NO: 68658 - DNA, 601 bp, Human
cttcttctgtcacctccatagcttccactcctgaggattcggctggcttcagtgaggcattgttggggagtggttacatgtttgtaggctctggggccggatagccagttagtagctctgtactcttgggcaagttgctccatttctgtatttgtaaaattcaaataataataggcctgcctcataaggttcttacaaggattaaattaatatgacctggcacagtgtgtagcacatggtaagcacacagctagttttagtgctgctgctcctgctgctgctgctgctgccattatcataytgcagtgtaacaacagaagagctcctcattggacaagatgttaaaatctaggagctggcagataaggcaagacctagtacagggccacaatgccttgtctgcaattccaaagtcaaagatgtgacaaaagaaatttcctcatcagtttggcattagaattcacttgttacaaaaccggacgggagttggtatgagaccatttgtagtttttttaaaatcctacttagtatgaccatttataatattcataagttttgctacaggaacgttgagtttgatgtgccacaaagcccatcaagg

SEQ ID NO: 68659 - DNA, 601 bp, Human
ttacaaaaccggacgggagttggtatgagaccatttgtagtttttttaaaatcctacttagtatgaccatttataatattcataagttttgctacaggaacgttgagtttgatgtgccacaaagcccatcaagggttttatatgatatggtagaagcatcatactgccttcctccaatttgaacagttctgaattccaagacacacctggccacaatggcctcccacacaggactgtgtacttatcctacagtttactatagtcaagaacaagcgaaagactaagagtcaagaggtcagasagttgagaagggcaggactttgaggtttaaggcagaaaaacattaagagttgagaattcagattgtaagatttgacaccaacaagcagaatatacctaagggagactgatgctagggcgaagacattggccttctgcctcattaaacattcttccttgggaaaaagtaatgtcgggatgtagacctctacagtcagaaatggtggctaagtgaagaagtcagagagctgctatattgggcaaatcagtagtcatattttaagagagctgccttccttcttcccttgggaatagagatggc

SEQ ID NO: 68660 - DNA, 601 bp, Human
ccagtcgtaccaggagctgctacagagcgccagcgcaagcccaatggacattgcagtgcaggagggtgagtgtgcagcgtgctgggaactctagacctgtgaggagatgttgtctagtaccccttcgctcattgccacctctttcctacctccctgcaaaaggattctttcatcatctgttgtctccatatgcacaagaatctttatgaatgaataaatccctcaagggactagggaagaagaactgaaatcacatctgcagtgggattttgttttaagagatgaggtctcgctatgttgccacgtgggccttgtacttcttggctcaagtgatcctcctgcctcagcctcccgaagtagctgggactacaggcatgtgccaccacacctggctcctgtctgctttttaatgccccacagcacagctgggaccaggccaagaggtttatgactgctaaatcaagggccaggggaaacagggagataagtacagatagtaacctgggcttcctctttttaccgggcctggctggtgtttgtaacatggcactgtgcccagcttgggtgtttttaactctaaggaaatactacactaaaaata

SEQ ID NO: 68661 - DNA, 601 bp, Human
tctttcatcatctgttgtctccatatgcacaagaatctttatgaatgaataaatccctcaagggactagggaagaagaactgaaatcacatctgcagtgggattttgttttaagagatgaggtctcgctatgttgccacgtgggccttgtacttcttggctcaagtgatcctcctgcctcagcctcccgaagtagctgggactacaggcatgtgccaccacacctggctcctgtctgctttttaatgccccacagcacagctgggaccaggccaagaggtttatgactgctaaatcaaggsccaggggaaacagggagataagtacagatagtaacctgggcttcctctttttaccgggcctggctggtgtttgtaacatggcactgtgcccagcttgggtgtttttaactctaaggaaatactacactaaaaataatggccttgtctgatacaggaacattggttacctaacgaatttccctcttagcattgcccttaccaaagcagagaagtagccattctctgtaagaaaagtaagacttcatggtttcaccacagtgttcttaagattaaggaagttcagagtgaggaatgtcttca

SEQ ID NO: 68662 - DNA, 601 bp, Human
ctatgattacaggcatgcgtcaccacatctggctaatttttgtatttttagtgagacggggtttcaccatgttggccaggctggtctcgaactcctgacctcaggtgatccacctgccttggcctcccaaagtgctgggattacaggcatgagccaccgcgccccgccttcaatatatatatcttctgaaaatcctcatttgtctctttccacccccattttgtttatcagatgcccatttgcccagaggtcccttaatcctgacaaaagtctccgtagcattttcccactggcatttttygaagagttgagcagagctttaataagaatgaaatctaatgcctttctgattctgcagccgagttcaatactgtgtgtgtcataatataaatttagttcaaacaatgtcttgcagattggttctgagcttgagtgtagcaacacaatgatggagtctcattcactcatgatgtgtcacaaatagttaactattcccacactcaaatatcaaatgactcacttattatgacatctgtattcgcattcactcacttgcattccagtatcctttcttttggggagaaggtacagagaaaagaga

SEQ ID NO: 68663 - DNA, 601 bp, Human
tcaatatatatatcttctgaaaatcctcatttgtctctttccacccccattttgtttatcagatgcccatttgcccagaggtcccttaatcctgacaaaagtctccgtagcattttcccactggcattttttgaagagttgagcagagctttaataagaatgaaatctaatgcctttctgattctgcagccgagttcaatactgtgtgtgtcataatataaatttagttcaaacaatgtcttgcagattggttctgagcttgagtgtagcaacacaatgatggagtctcattcactcatgrtgtgtcacaaatagttaactattcccacactcaaatatcaaatgactcacttattatgacatctgtattcgcattcactcacttgcattccagtatcctttcttttggggagaaggtacagagaaaagagatgaagtcacaggtaatatttctgctagtaatccctggaagtgttacctacctgtgaacatcatccttcatgtgtctccaaaaagattgaaaactcctggtctagtcctgcctccctcatttatgtagatgaatttggttgcaggaggttgctgtacccaagtacaggca

SEQ ID NO: 68664 - DNA, 601 bp, Human
gtaaacaggatgtcctgctgttgagagaatcattgctcctcttcctccagggtgctccagctgatgaacctaacagattctcgtttggcccaggcgggtaatgagaagctagagttggccatgctgagcttttttgaacagtttcgtaagatctacattggggaccaagtgcagaaatcctctaaggtaacagcctctcaattggctccccttagttctcacttctcacttgtgggattgctgatggagggaaacagttgctgatagttcacataacctccagatttcacgtaataggacrgtccaaatgttttctcttagtctttaaattctgggagagtcatcaaagaattgggcccatttctttagtgctccatatgcttaacaaatggccagtccaaacatctgttgttctcccacaaatgggcaattcttagtctccatgcatgaattaatattcagaacagaagatttgggctgtctttttgcaatttcaggattgaaagggaccagtaagattgctcagcatctgtccagtaatacttggaaactagcttatcccttcagtaaagtcctctctgggattcttgtccattttctt

SEQ ID NO: 68665 - DNA, 601 bp, Human; identical to SEQ ID NO: 38669

SEQ ID NO: 68666 - DNA, 601 bp, Human; identical to SEQ ID NO: 38670

SEQ ID NO: 68667 - DNA, 601 bp, Human; identical to SEQ ID NO: 38671

SEQ ID NO: 68668 - DNA, 601 bp, Human; identical to SEQ ID NO: 38672

SEQ ID NO: 68669 - DNA, 601 bp, Human; identical to SEQ ID NO: 38673

SEQ ID NO: 68670 - DNA, 601 bp, Human; identical to SEQ ID NO: 38674

SEQ ID NO: 68671 - DNA, 601 bp, Human; identical to SEQ ID NO: 38675

SEQ ID NO: 68672 - DNA, 601 bp, Human; identical to SEQ ID NO: 38676

SEQ ID NO: 68673 - DNA, 601 bp, Human; identical to SEQ ID NO: 38677

SEQ ID NO: 68674 - DNA, 601 bp, Human; identical to SEQ ID NO: 38678

SEQ ID NO: 68675 - DNA, 601 bp, Human; identical to SEQ ID NO: 38679

SEQ ID NO: 68676 - DNA, 601 bp, Human; identical to SEQ ID NO: 38680

SEQ ID NO: 68677 - DNA, 601 bp, Human
aaactgccatcaccagtagacaagcttcctggtaatcctcacattgaattcatgtgatgcatggatgaggtatcaacatcagtcctgtcctggagcctgaggagtgaacccaatgatccctgagacccttctagtcttcaaagtccacactgaccagagtggttttaaaatattcatcatcttctttaactagtctcagaaaataatactccaaaatatgaacattcccactttcaggcccatgcacactctacacacttttccagggccagttcaaatgatatctcctcctccaggaagmcttccttgcttatctggctgaaattgaacttctcttgtttgaacacccagcccttggtttccccaagccattcactccctggtgcctctgtttagctttccctggccttggcttattctcagttacaggcaggacccagactgcacacacgctagggccccacccccagctccttgcaagcagatgtcattgttccaacattgattgatatgtttaatgaatcccatatttcaagaatgcaactgaccagacataactcaggagtggttttcgccatataagcggagctctgagtcacaa

SEQ ID NO: 68678 - DNA, 601 bp, Human
cttctccttttccacaccacaatacacccacatcaagagcatactgacttcaagacagccccgatggtaaacaaacaaacaaaacaacaaccctgagttcttattatgatcaagagtttgggccagggctttgcgggagggactaggaaagtcttcactcatttggggccctggcatgtatgtctcctctgattcttcaatgtacttcctctaaacttctcttgagaacttgagtttgaaagttatatctctgtgtccttagatcctgaatagtcaatatcttgagtgctactgctgctgmtgatgatgttggagaagacaacctccttgagtgcttaatacatgcctggcactttctaagcattaatctttgtgataactctaagttctattattacccccactttgtaggtgaggaaactgaggcacagagccatggagtaacttgccaagagcacagagccctaaccggcaggggctaggccaatcccaggcagtgaaactccagggcctccacccttacgctgtgtctgatctcactttgtgtctttatggggcctggcagataacaggtgctcagcaaagattatgcttctaagaa

SEQ ID NO: 68679 - DNA, 601 bp, Human
ttaaaagcagtggcccttctaatcccagcactttgggaggccaaggcaggcagatcacctgaggttgggagttcaagaccagcctggtcaacatggcgaaaacccatctctcctaaaaatacaaaaattagctgggtatggtagcacaggcctgtaatcccagctactcaggaagctgaggcagaagaatcacttgaacctgggaggtggaggttgcaatgagccgagatcatgccactgcactccagcctgggcgacagagcaagactgtctcaaaaaaaaaaaaaaaaaaaaaaaaaarggcagtggcctgggggtcagacaaatcccaacaatgcctcttactctatcgacatgaccttggatgagccttttaacttcctatgtgtaacctggaaatggcagaattgtagcagtgactttgtgcaactgtagcaaggccttattgagatgtgagaaagtgcttgacacagtgcctgacatcaatcaaatattaaatgatgggaagagtaataatgcttctgttagctgagggcttattgggtgccagacactgttctcagcacttgacacaaatgaattacatatggacatttaacct

SEQ ID NO: 68680 - DNA, 601 bp, Human
tcacctggcccggcctgactgacagaaggaacattgggagtgctctttgcagactatctagagctacgcccacttgcccatttcacaatttttccatggccttcctgaggcccagtcctctgatcttcagggaagaaacaggccctgaaaatccgcagggtcaggatttctggttgtctggcccagctgagtgatgctgctgggggaagaaagctgtcagccccagctgcgcaggcaggaaccccttctctgtgtcatcctgtttggaagcccggagtgcattgctatagcaacttgcctmattcaccccacatgccacgtggaaaaacctctgcccgctttagagctgcatcacccaagccacaagctgggttcttctatgttatagaacgaggctgcccatcagcaacaagggctggggtagggggtatctgaccagtgatggggcagggggctaagtggttggactacaccaggtaggtcttccagcctcacctatttcatctgctggctggccctggtgcctgacatcccaccattagccctttattccttgggctcaaggcacagccagttgaaatggaaatccctttgggtagaa

SEQ ID NO: 68681 - DNA, 601 bp, Human
acattttcattttgcactgggtccttcagattaagtaactggtcctgcatgtgtcatatgtggtttgaataaactcagagaaccctgtctacaaactattgatgggactttattatggccaccaatctctgaacgcaggggctatgcatagtgccagggagagagcaattccaggagatggagagggaatggagactgctttgtacccttctgcctggaggaggtggggcaagggcttcagtttctccatccatctaatggacacacctgtctcagcaggaactctggcctcacctggccyggcctgactgacagaaggaacattgggagtgctctttgcagactatctagagctacgcccacttgcccatttcacaatttttccatggccttcctgaggcccagtcctctgatcttcagggaagaaacaggccctgaaaatccgcagggtcaggatttctggttgtctggcccagctgagtgatgctgctgggggaagaaagctgtcagccccagctgcgcaggcaggaaccccttctctgtgtcatcctgtttggaagcccggagtgcattgctatagcaacttgcctaattcacccca

SEQ ID NO: 68682 - DNA, 601 bp, Human
tccagagcccaatgttgaagatgcagagatcccctaaaaaggttcccaaagcagtcttgaggcaataactggagacagaagtatcttaattccatggcttaaaaatgacctcacagctctggcgtgtgcctttagaactgctccacagacacccctgccctctgtgtacatcagtgtttggaatgagccctgcagtctgtgggatctgtggggtgccttctccatgtttcttgaggcagagaccgcgctttatctaatttggaattcccagaacttggaggtgcctggggcttagtgggcrctcagcacatgctggtgaaatggacaggccacttggttttttatcatctgtaaagtgggatcatggtgtcttccttgccaaacaacaggcccacggggagagccatgtgagcagggccggtttgatgagcgcttggcctgtacagtggctgagggcctcatgttcagaaaggccctgcacttggtgaatgccctgctgtggccatctagaaattcttagtaattttaaaacaaggggtctcacattttcattttgcactgggtccttcagattaagtaactggtcctgcatgtgtcatat

SEQ ID NO: 68683 - DNA, 601 bp, Human
ttttttttgcttgactggggctgggtttacattataccagtgatcctccattttggatgcccgttagaattattggacagcttcaaaaaatgtccctgctgggccccaatgtggagagtgatgatgtgttctggggtggggtctgcatgacagttttcttctacatcatcattctcaccctcacccaggatggaggaccactggatctgctggtccctgccttccctcctagtgctgaccctctacaattccatgccagaatgagatgcgaagcccatgtgggcaggtgaacaggagtcamcccttatttagaagtgctgaccctggaggactatgccaatacaaatactaggggctgccgaaaggccaggaattttaagtcccagcttctcaagtctgccaaggtggaagctccagagcccaatgttgaagatgcagagatcccctaaaaaggttcccaaagcagtcttgaggcaataactggagacagaagtatcttaattccatggcttaaaaatgacctcacagctctggcgtgtgcctttagaactgctccacagacacccctgccctctgtgtacatcagtgtttggaatgagcc

SEQ ID NO: 68684 - DNA, 601 bp, Human
gggacatagagagtatcaccaatgaatcactccacacctaccagctccaatctgcaaagtccaccttgcactcagcttctcaaactctcaaactgtgtctccagcccaacccagctgtgaatcctgtggcactgcaggctgggcagttccagaaggactgagagtcaggagaactggttaaatcttggctttaccactggtgttgtgtgaccctaggcaagtcattttccttccctggagagtgtttggttttttttgcttgactggggctgggtttacattataccagtgatcctccatyttggatgcccgttagaattattggacagcttcaaaaaatgtccctgctgggccccaatgtggagagtgatgatgtgttctggggtggggtctgcatgacagttttcttctacatcatcattctcaccctcacccaggatggaggaccactggatctgctggtccctgccttccctcctagtgctgaccctctacaattccatgccagaatgagatgcgaagcccatgtgggcaggtgaacaggagtcaccccttatttagaagtgctgaccctggaggactatgccaatacaaatactag

SEQ ID NO: 68685 - DNA, 601 bp, Human
agggttggaatgaccctaatggacttcgactaacccctgccaacatctctgagaaactcagagaaccccccgccccagtgccggtgcatctgtctgtggacagctctgactggcatcctcagccaaatcaatttatctatagctcctctttggtttttctggtctcccccttggggccacacagggatcaagtagcttatgccttgtaggggacatagagagtatcaccaatgaatcactccacacctaccagctccaatctgcaaagtccaccttgcactcagcttctcaaactctcaarctgtgtctccagcccaacccagctgtgaatcctgtggcactgcaggctgggcagttccagaaggactgagagtcaggagaactggttaaatcttggctttaccactggtgttgtgtgaccctaggcaagtcattttccttccctggagagtgtttggttttttttgcttgactggggctgggtttacattataccagtgatcctccattttggatgcccgttagaattattggacagcttcaaaaaatgtccctgctgggccccaatgtggagagtgatgatgtgttctggggtggggtc

SEQ ID NO: 68686 - DNA, 601 bp, Human
tgctgttggcgtgtgcaggtgcccaaacgtatggctctgttagaggtgagtcctgaatgcaggccagggctggccattcctacctggtctggttggctctgtcaaagagtctggactcaacccaatggtagtagagagctactaaggatttaaggaggaaagtaagacaactctgtttgtttttgagcctcactttgacggctgtggagaaagctctggatgaatgggggcaagagggacaatgaaacctgagctggggacctcagggaggtcctaggtgtccccctgcttgtcccacccygcaggccggcctcctccttcttgttgatggagtattccttcctcacccagcctgggcttggcgttgtcggtgtcccatcctgagtcaggtgcttccttcacctgaaccctcacttcaatttcagcagggcccaagatcacagggttggaatgaccctaatggacttcgactaacccctgccaacatctctgagaaactcagagaaccccccgccccagtgccggtgcatctgtctgtggacagctctgactggcatcctcagccaaatcaatttatctatagctcctctttggtttttct

SEQ ID NO: 68687 - DNA, 601 bp, Human
gactgcctggcttcaaatgccaggctgtgactttatcatccgggtgatcttggctaagttacttaacttctatgttagctagtattactgttgccattaagtgtcgagaccagtgttgaaaccttatgtcagtggaacaggctcctaatatggactttgttaggctcagactcagtctctccacctgtgcaatgggtttcatgtcatctcccaagccaccaggacagattctggcttggtggttcccagggattggactgtaatctggggtctatgttcagctcccaccatcttttctggrcactcccagctccttcttgggtgctaaacaacatggccacattctgtggcatatagatgatgtctgaatcactacccttttgtgggaaatgaggcatttaaaatttctgctgcatgctccctgcccccttgtttcctaggaagtcccattatataactaggttttcactgtgtaaaaacaaggccattcccctgtctccttgtgtcatctcagagtcatagtaaatagtgatgaatagcatggggccagctgggctgacctggactgcctgctgtgagccaatttactcctttctaaggt

SEQ ID NO: 68688 - DNA, 601 bp, Human
tgggtgtgtggatcaagagccctgtgcatgtgggatgagccccagcccagagagtgtttgggcaaaataagagcaagacaaggctcaggatatgcaatttgtggcagggctttccctcagacgagaggaagtagggtgaagaggactcagagaactactgggccagtctgccctgctctttgaatgcaaactaaaaaaaggaattgtgggggcccttcccttctaagcctgcagggcccgccctccagtggatatacccacacccatctgaaaagttctctggctgcatggaatttaacakagatccaccagatgccattgtctaggcttggtggggatggcggacttcggggagtggaagtgtttttgttctctgagggttatgcagaggtctttttggttttcagtacaggccaatttttcatggttgcaaaacgatctcaaatgtctactgctacttttaggtccttaaaggagtcgagggctcatgactccatctgcctttgctagaaaatgaaggactaccatgcaaagtggtgagcccccatcactggagggatgcaagcctagggtggccatttgtttgggatgttcaggctct

SEQ ID NO: 68689 - DNA, 601 bp, Human
ttttatgaaaactagtgtatttttccatcttacatcatttatcattttctctgtgtaggaaaagtgatcaaaatggacctcctctttttttttgagacagagtcttgctctgtctgagcgagtgtgtgggaccttggcctcaacatggcccgagctcctgaggaccccatatttcaccccacccagcccaggcctgccctttgagccccacaatcaatttcctggctgcttataggacatttcacttggatgtctcataacatctcacatttcacatgctggaaaaggaacccaggttttygcttcttaaatggttttgtccccattgcaggaaatggcattaccacccaccagatggctcaagccagaagcttggaagtcattccttatgattttcctttacttcccatcagcaaatcctgcaagttctagccctccattcctctccaatgtgcccactcctctctgtctcttctgccatacttggactaagccatcctcttcattttgtatttagacttgcactagagttttccaactggtccctcattccaattttgctcagcttcaagctatgctctttgcagcagccacagtgatc

SEQ ID NO: 68690 - DNA, 601 bp, Human
gatcatcttcttcaagaacaagggtcatggctgggtgcggtggctcacacctataatcctagcactttgggaggcggattgcctgagctcaggagttcgagaccagcctgggcaacatggtgaaaccccgtctctactaaaatacaaaaaattagctgggcctagtggcaggcatctgtaatcccacctactcgggaggctgaggtaggagaattgcttgaacccgggaggcagaggttgcagtaagccaagatcgcaccactgcactccaaaccgggtgacatatggagaccccatctcygtaaaaaacaaaaacaagggtcacagttttttatgaaaactagtgtatttttccatcttacatcatttatcattttctctgtgtaggaaaagtgatcaaaatggacctcctctttttttttgagacagagtcttgctctgtctgagcgagtgtgtgggaccttggcctcaacatggcccgagctcctgaggaccccatatttcaccccacccagcccaggcctgccctttgagccccacaatcaatttcctggctgcttataggacatttcacttggatgtctcataacatctcacattt

SEQ ID NO: 68691 - DNA, 601 bp, Human
acattatttttcctccgagccctggacagccatctcatgccttcagagaatatatggatcatcttcttcaagaacaagggtcatggctgggtgcggtggctcacacctataatcctagcactttgggaggcggattgcctgagctcaggagttcgagaccagcctgggcaacatggtgaaaccccgtctctactaaaatacaaaaaattagctgggcctagtggcaggcatctgtaatcccacctactcgggaggctgaggtaggagaattgcttgaacccgggaggcagaggttgcagtragccaagatcgcaccactgcactccaaaccgggtgacatatggagaccccatctccgtaaaaaacaaaaacaagggtcacagttttttatgaaaactagtgtatttttccatcttacatcatttatcattttctctgtgtaggaaaagtgatcaaaatggacctcctctttttttttgagacagagtcttgctctgtctgagcgagtgtgtgggaccttggcctcaacatggcccgagctcctgaggaccccatatttcaccccacccagcccaggcctgccctttgagccccacaatca

SEQ ID NO: 68692 - DNA, 601 bp, Human
ttcagccaggccctggcacatcctcatcacacacactgggtgcctgcaaccttggagcaccctgaccctggcctgcctccctctcttctacttcagtcttgtcatctcatcaaaagccttgcctgttatctgtcccatcccctcaatgtcctgttgtatggtagataaactaatgcttgttaacaagtgacttatcacaacagcctcccctcagccatcaaaagcatttgcagctctatatgaggaagaattctccaaatcagaaaaaaacaatcaatctggggctgggcagcctgtggargagtgagggtcccttccctggggttgcagaggagaacaaatgtcggctagggcaggtggcatgtaggctgaaacagagactcacagaagcatccggagacagggagacagagaacgagcaagggctggtgagagcctcggcagtcctttgtatctttttctgagaactcaggagtttgccaatgggctggttaagcagatgtcaagctcaaggaaaacaggcctaaaactttaaagcagcaaacagcacattgagactgactgtaattaacattatttttcctccgagccctggacagcc

SEQ ID NO: 68693 - DNA, 601 bp, Human
cagggaacatgtgagggttcttgctctgctgccagccagccttcccttctgcccaaggccatcatttcaaagaggcatctaggaaggcaatgctagatttgggagcattgctggaggcccaaggaccctagtctaggctcctgtagtaggcactagtgcgatagagcaagggaggggtgaggggacgtggtccctacatcagagaagcttctagctagttgagggaagaaggccttcattacagaagagcttggggagccctctgactctggggagaagcagggatactgcccttggggamctgctgctctcataggagacctagtaactctgccctcaccctgggaagcccccaggctggtggggagtgtgcggttccgcccccatgggcagctgcgtggccaacagggaactcacagtggactgtgagcatcccatgagcagcaactctgcctgcattgccacatggagggtgtggagtgaatatttaagtaataggattagacatgtacactgagcagagctgattccacacaatcttctccccatctaagactgagcaatgtgaggagaactggattctacttatccctttatccca

SEQ ID NO: 68694 - DNA, 601 bp, Human
ctcctgtctcccgcatcaggacgcaggctccatgagggcaggatggggtctgtttgctactcattgttgggtctagcacttagcacaggggatgagtggagggcaagacaagaagagagatgggtcctatcagcttgggagagtggctcacgggaagcacgtggagtgcaagtgtgccctgcaagcagatgccatggttgttagagagaaggaccctgtgggctgggtgctcaggaagcttctggaggtgtgattctggccttgaagggccatgtggaggaataggtgaagtggcccaaaggtgctaggcaggctttcctggtgcaaatgtggagccggggaaaagaagagaacagcctacctgggtggaggtgtcaggaattgcctggctcctcctgccatcctgccaggctccttgagagtcaggccagacatgaagagaggatgggctttcagttctgggaggacttggttagaagcctggctctagcactcattcataagtgggtgaccctggggagttactctccctttctggttttcagtttactcatctataaaacaggaataaaaatatctatctggaaaagtggttggcaag

SEQ ID NO: 68695 - DNA, 601 bp, Human
gtccatcaccaggccaccaaacaccccagggatcccttcctgtgctccatttttcctcatagcgtttatcacaaacatatgacatttgtttattgtcacatggctgatatttagaatattcctatagtctctaagtgccacgggactctgctgtgtcctcactgctctatcctcagtgccttgaatggaggtccagctcgtagatactggttgactgaacagttagagaccaggatcttcatttgtctgggacagtctctcccctcagtgaggaaaaggagaaaggaaataatgatgagcrctgatatattccaggcacgatcctaggcatctaaccgtgagttttacattaatcaattaaatctcacaccaaccccatgagacagatacaatcacacctctgggagattaaatagtttccccaaatcactcagctggggacacattagctggacacatgaccacatagcttggggtgccggggtgatgtgttctcttccctccctagatcagtttttcataagaaggactcactggggagaagggaagattccttttagagaagagggtctccgcttcctgccctaggtcccattgcctc

SEQ ID NO: 68696 - DNA, 601 bp, Human
acagaggagagagagagagacaccagtgtcacctgtgcagagctcggagcttggtgggcataggggggttactgaaggagtgttgcagtggcagagagaaacttaccctctctccaaatctgtcccaggaacgaacacacacgtatgcacacatgcacacgcacacagatatacatgtatgcatgcacgtgcacacacacacagacacacacatgcacaggccacatacaccctgattgtggacggcactttgcctggcttcctggtgcccactagagactaggacttccccttcctgcayctgacccagcaggaaaaggaaagtatgttctagctgtcaggaaatccagaccacctgccacttccaggcctgcagaggggtgagggccagtgaaggtgaagccacagattgtgtctttggggccttgtccaccccaagccctctatcagtgcttgttgtgcaaccatggccagagggacccttccaagacctgtgagatcccgtcacccctcagctccatcccctgtatcaatgagttttccaccccatcaaagccaaggccaaactcctcattgcaaggccctccataatctcaccgca

SEQ ID NO: 68697 - DNA, 601 bp, Human
cctggagtgggggttggggaagaagagtatatgaacccgttagtgctttgtttacaaatcccatgccataaatgaacttatcagcctggctagcagcgggcagccttggagaagaggactctgttccggtgagcacagggtcctgaagaacacaggtccctggccagtgaaggcatgtcacagaggagagagagagagacagcagtgtcacatgtgcaatgtcacagaggagagagagagagacaccagtgtcacctgtgcagagctcggagcttggtgggcataggggggttactgaagkagtgttgcagtggcagagagaaacttaccctctctccaaatctgtcccaggaacgaacacacacgtatgcacacatgcacacgcacacagatatacatgtatgcatgcacgtgcacacacacacagacacacacatgcacaggccacatacaccctgattgtggacggcactttgcctggcttcctggtgcccactagagactaggacttccccttcctgcatctgacccagcaggaaaaggaaagtatgttctagctgtcaggaaatccagaccacctgccacttccaggcctgcagag

SEQ ID NO: 68698 - DNA, 601 bp, Human
ttttttttttttttttttgctcagcaaacacataacagtagccaaaatttccatcattagagtcatagaattaaagtccccagagtaaaactgagggaccttcaagtagggatattagatacgtgttatcttattgaacatgccaatggatcattagcacttctggagcactgagttaggaaagattttgaggtcaagtctgggctcagtaggcaagaggagtgtgactgatagcactacctgctatgggtacaggggaggacagtggcagcacgtgactatgtagctgcccactctatcktcacgattcctaatctcccacatgaatttagtgtcatggccctggagtgggggttggggaagaagagtatatgaacccgttagtgctttgtttacaaatcccatgccataaatgaacttatcagcctggctagcagcgggcagccttggagaagaggactctgttccggtgagcacagggtcctgaagaacacaggtccctggccagtgaaggcatgtcacagaggagagagagagagacagcagtgtcacatgtgcaatgtcacagaggagagagagagagacaccagtgtcacctgtg

SEQ ID NO: 68699 - DNA, 601 bp, Human
ttcacatgtgggatacttatttagtttcaaagaccattcacatgtatgttatcattcgatctccatgacaagcagcaaagggaaaacagagggtcagagaggttagctgaccttcccaaggacccaagcccgctgggtagggcctctgaatttgaggcttggacccgcacacgagtgcgccactctccttcccctgggcactgaccccctgctcagtattcaactgtgaagccctggggcacctactttaataaggcctatcatacagaaacaagttatttttcccactgtctcccttttttttttttttttttttgctcagcaaacacataacagtagccaaaatttccatcattagagtcatagaattaaagtccccagagtaaaactgagggaccttcaagtagggatattagatacgtgttatcttattgaacatgccaatggatcattagcacttctggagcactgagttaggaaagattttgaggtcaagtctgggctcagtaggcaagaggagtgtgactgatagcactacctgctatgggtacaggggaggacagtggcagcacgtgactatgtagctgcccactctatcttc

SEQ ID NO: 68700 - DNA, 601 bp, Human
gctttacccctttgggcaaatcacaagaaacaacaaaatagcacctcacatctgtatagtacttttggtttctgggcctcctcacatctgccatcatttgctgtcacaggaccttggagaatgagtgagcatcgtcctcacttggcagatgcacttggtgcagtaccagagaggttaagaggattgtccagggctgcacagcaggtcagtggtagcatcagaactaggacctcagacacctactctgtgacgcctccccaccagaaggcattttcaggatacatctggccttgatacccayccacacttgggacgcattaaatttgaggggtgggatcttgccacgagccaaaacttttggataagtaaaaatgaattggcagaatagaccttttatcattgttgcccctttcacatgtgggatacttatttagtttcaaagaccattcacatgtatgttatcattcgatctccatgacaagcagcaaagggaaaacagagggtcagagaggttagctgaccttcccaaggacccaagcccgctgggtagggcctctgaatttgaggcttggacccgcacacgagtgcgccactctccttc

SEQ ID NO: 68701 - DNA, 601 bp, Human
gaagacctgtccttcccccagggaactcccgattctaccagggagagacagttgccctccttctccatcactccttcctcccatctgctgcttccagcttttgttggtctcctcttttttttccctctcattttcctcctctctcctgctctcccttctcttccctcctcctcccttcattaccgcctcccctatctgctgaagagtcaggcaactgacatccaccttcctctgcaagcctgaggtcccagtggccatgggcgccggcactgggctccccacttccctctgaaccagttgrcaaagctccgtctggcttcggcaggggcttctgcttggccggggcagctgaagcgagcacagaaaaagccctatgaccctttcgccctggccccaagggtcgcccctgtttgtttaagtcacctgtcagttaactaattcttcctggcaggaagcctgtgttaagccaaatgctttacccctttgggcaaatcacaagaaacaacaaaatagcacctcacatctgtatagtacttttggtttctgggcctcctcacatctgccatcatttgctgtcacaggaccttggagaatgagtgag

SEQ ID NO: 68702 - DNA, 601 bp, Human
cagtctccatgtgagggccagtggggcagccacagggcacaggggcaggatggagggggctgggtgtggaatggtacagggctgggtgtgggcggccgctctcactcaccacttattgccactgatgtcgtgctgctgcactgtgtagccaaagaaggcggtcctggagccagggatgacccggggcttcctggtgtccatgttgaaggtgtccgtgaaccctgaggcagggggagaggagaggagaagcaggggagtcagacaggcagaggtgtaggccctgggctgtgtcaggacccaytggcaggtcatgaaccttggagggtcttggctgtgggacaagcatgtttccccatcttggggagtccctgtatgaggtggctgatgtagtccttgcctggtagggcccacagtctgatgggagagattccacccccgtcctgggggagcctgatatggtttcaatgtgtatcccttccaaatctgacgttgaaacaggattcccaatgttggaggtagggcatggtgggagatgtttgggtcatgggggcggatccctcatgaattgcttggtgccatccccttggtgatgagtgagttc

SEQ ID NO: 68703 - DNA, 601 bp, Human
tacagggcttgagaaattgaacattcaagctttcatagtcaggagcagagcctgtgcagtctctgacctgctgggacagagtcaagtcactggaaacgtcagtctccatgtgagggccagtggggcagccacagggcacaggggcaggatggagggggctgggtgtggaatggtacagggctgggtgtgggcggccgctctcactcaccacttattgccactgatgtcgtgctgctgcactgtgtagccaaagaaggcggtcctggagccagggatgacccggggcttcctggtgtccatrttgaaggtgtccgtgaaccctgaggcagggggagaggagaggagaagcaggggagtcagacaggcagaggtgtaggccctgggctgtgtcaggacccattggcaggtcatgaaccttggagggtcttggctgtgggacaagcatgtttccccatcttggggagtccctgtatgaggtggctgatgtagtccttgcctggtagggcccacagtctgatgggagagattccacccccgtcctgggggagcctgatatggtttcaatgtgtatcccttccaaatctgacgttgaaacaggatt

SEQ ID NO: 68704 - DNA, 601 bp, Human
atggtggattggataaagaaactgtggttcatatacaccacggaatactacacaaccatgaaaaagaaagaaatcatgtcctttgcagcaacatggatgccattattctaagcaaattaacacagaaacataaaacctaatatggtgtgttctcactattataagtgggagcgaaacactgggtacacatggacataaagatgggaactatagacattgaggaccactagagtggggagggagggaaggagagaacaagagttgaaaaactacctattgggtagctcactacctgggtgaygggatcacttgtaccccaaacctccacacaatgcaatatacccatgtaacaaatctgcacatgtactccctgaatctaaaataaaagttgaaataaaaaagaagagaaaaccaaatatagagaattcacactacctgacttcgagacttattttaaagctgcagtaaccaaagcagctttttgtttgctcaagtttagataaatagacaaatggaataaaatagagtcaagaaataggcccatatatctatggtcacccgattttcaacaaagatgtcactagaattcaatggggaaaat

SEQ ID NO: 68705 - DNA, 601 bp, Human
aaaattgacaagctgacttaaaaatttatatggaaacataaaggatctatcatagctaaaacaatcttgccaaagaaaaacaaccccattaaaaagagggcaaaggacatgaacagacacttcttaaaagaagacatacaagccgccaagaaacatggaaaaatactccacatcactaaccatcagagaaatgcaaatgaaagccacagtgagctatcatctcacaccagtcagaatggctattattaaaatactccagagtaacagttgttggcaaggctgtagagaaaaggaaatgctkatacactgttggtgggaatggtaattagttcagagtttggagatttctcagagaactaaaaatagaattactatttgacccagcaatcccaattactgggtatattacccaaaggaagataaatcatttaccacaaacacatgcacttgtatgttttatcacagcactattcacaatagcaaagacatggaatcaacctaggtgcccattaatggtggattggataaagaaactgtggttcatatacaccacggaatactacacaaccatgaaaaagaaagaaatcatgtcctttgcagc

SEQ ID NO: 68706 - DNA, 601 bp, Human
tataaatataagtataaatatttttatggtataaaatgaatagtataaaatgaaataaaaatattttatttctaatagcataaatgcaaatatgaaaatatatttacattaaatatatatttattatgatataatttatattaactgtaaatataactatattcatagtataaaatgaaatgaatagtataaaatgaaataagaatagtttatttttaatagtataaaatataaatatattttatattttattaatgcaataagagatgtaaaacttacactgaatatttcaaagcattaytgagagaaatttttaaaaactgaataaatggtaggatatacatgttagtggattagaaaaaatgttattaagatttcattttcccctaaatttatccataaaattgaacgtataaattcagtataactccaataaaaatctcagcaaattttgttggaggaaaattgacaagctgacttaaaaatttatatggaaacataaaggatctatcatagctaaaacaatcttgccaaagaaaaacaaccccattaaaaagagggcaaaggacatgaacagacacttcttaaaagaagacataca

SEQ ID NO: 68707 - DNA, 601 bp, Human
atactccttgagaagggcaaccccaagacacatagttgtcagattcactaaggttgaaatgaaggaaaaaatgttaaggcagccagagagaaaggtcgagttacccacaaagggaagcccatcagactaacagcggatctctcggcagaaaccttaaaagccagaagagtgtgggggccaatattcaacattcttaaagaaaagaattttcaacccagaatttcatgtccagccaaactaagcttcataagtgaaggagaaacaaaatcctttacagacaagcaaacgctgagagattttgtcaccaccaggcctgccttacaagagctcctgaaggaagcactaaatgtggaaagaaacaactggtaccagccactgcaaaaacatgccaaattgtaaagactattgatgctatgaagaaactgcatcaattaaccagctaacatcataaccagctaacatcataatgacaggatcaaattcacacataacagttttaactttaaatgtaaatgggctaaattccccaattaaaagacacaaactggcaaattggataaagagtcaagacccatcagtgtgctctattcaggagacccat

SEQ ID NO: 68708 - DNA, 601 bp, Human
agaacaccacaaagatactccttgagaagggcaaccccaagacacatagttgtcagattcactaaggttgaaatgaaggaaaaaatgttaaggcagccagagagaaaggtcgagttacccacaaagggaagcccatcagactaacagcggatctctcggcagaaaccttaaaagccagaagagtgtgggggccaatattcaacattcttaaagaaaagaattttcaacccagaatttcatgtccagccaaactaagcttcataagtgaaggagaaacaaaatcctttacagacaagcaaaygctgagagattttgtcaccaccaggcctgccttacaagagctcctgaaggaagcactaaatgtggaaagaaacaactggtaccagccactgcaaaaacatgccaaattgtaaagactattgatgctatgaagaaactgcatcaattaaccagctaacatcataaccagctaacatcataatgacaggatcaaattcacacataacagttttaactttaaatgtaaatgggctaaattccccaattaaaagacacaaactggcaaattggataaagagtcaagacccatcagtgtgctcta

SEQ ID NO: 68709 - DNA, 601 bp, Human
acaaaaaggacatctacaccaaaaccccatctgtaggtcaccaacatcaaagaccaaaggtagataaaacctcaaagatggggagaaaccagagcagaaaagctgaaaactctaaaagtcagagcacttttgtcctccaaaggatcgcagatcctcaccagcaatggaacaaagctggatggagaatgactttgacgagttgacagaagtaggcttcagaaggttggcaataacaagcttctccgagctaaaggagcatgttcaaacccatcataaggaagctaaaagccttgaaaaaagrttagatgagaggctaactagaataaacagtgtagagaagactttaaatgacctgatggagctgaaaaccatggcacaagaacttagtgatgcatgtgcagcttcagtagctgattcgatcaagtgtatcagtgattgaagattaaattcatgaaataaagtgagaagacaaggttagagaagaaagagtaaagacaaacaaagcctccaagaaatatgggactatgtgaaaagaccaaatctacgtttgactggtgtacctgaaagtaatggggataatggaaccaagttggaaaacagt

SEQ ID NO: 68710 - DNA, 601 bp, Human
attcaagactactatgaacatctatgcaaacaaactagaaaatctagaggaaacacataaattcttggaagcatacaaccatcctagcttgaatcagtaagaaacagtaattttgaacagaccaataacaagcagtgagattgaatcagtaatttaaaatattgccaacaaacaactaagattttaaattatacagcagctctcttgaccaccatggaattgaattagaaatataatagaaagacaactagaaaatctccaaatatttggaaattaaaaaacacatttctaaataacccayggtccaaggaagaaatcatgatgagaattagaaattattttaacctgaatgataatgaaaacatcaaaatttgtaggatgcagctaaagcaatgttagaggaaatatatagccttatatgtatattttagaaaagaaaaagggtcaggaaatcaacaatttaagtaagaagctagaaaaagataaattaaataaaaaaatggaagaaataattaaaatgagaatagaaaccaatgaatgagaaatcagggattcaatagagaaaatcagtaaagcccatagttgatcctagaacacatta

SEQ ID NO: 68711 - DNA, 601 bp, Human
ccattcaagactactatgaacatctatgcaaacaaactagaaaatctagaggaaacacataaattcttggaagcatacaaccatcctagcttgaatcagtaagaaacagtaattttgaacagaccaataacaagcagtgagattgaatcagtaatttaaaatattgccaacaaacaactaagattttaaattatacagcagctctcttgaccaccatggaattgaattagaaatataatagaaagacaactagaaaatctccaaatatttggaaattaaaaaacacatttctaaataaccmatggtccaaggaagaaatcatgatgagaattagaaattattttaacctgaatgataatgaaaacatcaaaatttgtaggatgcagctaaagcaatgttagaggaaatatatagccttatatgtatattttagaaaagaaaaagggtcaggaaatcaacaatttaagtaagaagctagaaaaagataaattaaataaaaaaatggaagaaataattaaaatgagaatagaaaccaatgaatgagaaatcagggattcaatagagaaaatcagtaaagcccatagttgatcctagaacacat

SEQ ID NO: 68712 - DNA, 601 bp, Human
gcagacttataccacaagaaatactaagtagagttctttggctgtaagaaaattatctcaaatgagagcacagaattatataaaagagacgaagaacaccagaaagggtagctatgtggataagtagacataaatattaacaacttaaagcaacaataacaataatgtcttgtggaatttataacatgtgcaaaggtaaaatatatgacaaaaataacacaaaggacaggacaggggactggaatcaaactgtcgtaaagttattgtgttacttagaaagtggtaaaatactaattgcaartagattgtaaagctgtgttagaaatgaaaatggagatattacgactgacaccacagtggtataagagaccattcaagactactatgaacatctatgcaaacaaactagaaaatctagaggaaacacataaattcttggaagcatacaaccatcctagcttgaatcagtaagaaacagtaattttgaacagaccaataacaagcagtgagattgaatcagtaatttaaaatattgccaacaaacaactaagattttaaattatacagcagctctcttgaccaccatggaattgaattagaa

SEQ ID NO: 68713 - DNA, 601 bp, Human
accagaagcagaccagagatgatccagatattggagttaaccagccaggacttcaaaataattataattaatgtgttaaagaaaatagaacaaaagatggacaaatgggatcaagacagattattgtgacagaattagaatctataaaaaaagaatccagtggacattcaggagcaaaataaaatatctgtaataaagagtatatcgaatgggtttagctgcacaatggatacagcagaaagctggattagtgaccctgaagacagatgaatagaggatatctaaattgtagcacagcaaragaaaaatggaataaaaaactgaacagaaatatgagaaatatggcgagaaggcctaacatacacacaattcaagtttagaaagaaaaggagagaagaaatgggacaaaagctatatttttaaaaatgaaggtagagaattttccaaatctaattaaaagtatcaatgcagattcaagaagctttggaaaccctatgcagaacaaatacaacaaaactacatttagatacatcatagtcaaactgctgacattaaaggcaaataagaaagcaaccacaagaaaatgacatattacattcaa

SEQ ID NO: 68714 - DNA, 601 bp, Human
ataagggcaaaactgtaacatccacaatattcacaatatttacaaaatgagtaaataatcaggaaaaaatggataaccatgagataaaatagtcaccagaagcagaccagagatgatccagatattggagttaaccagccaggacttcaaaataattataattaatgtgttaaagaaaatagaacaaaagatggacaaatgggatcaagacagattattgtgacagaattagaatctataaaaaaagaatccagtggacattcaggagcaaaataaaatatctgtaataaagagtatatcraatgggtttagctgcacaatggatacagcagaaagctggattagtgaccctgaagacagatgaatagaggatatctaaattgtagcacagcaagagaaaaatggaataaaaaactgaacagaaatatgagaaatatggcgagaaggcctaacatacacacaattcaagtttagaaagaaaaggagagaagaaatgggacaaaagctatatttttaaaaatgaaggtagagaattttccaaatctaattaaaagtatcaatgcagattcaagaagctttggaaaccctatgcagaacaaat

SEQ ID NO: 68715 - DNA, 601 bp, Human
gttcatacccagtcagaaaggagagaccttaatgaatactctgggatttcatttgagaccccagaaaatctatgctctaagagtaaagaccacatcctaggaataagggcaaaactgtaacatccacaatattcacaatatttacaaaatgagtaaataatcaggaaaaaatggataaccatgagataaaatagtcaccagaagcagaccagagatgatccagatattggagttaaccagccaggacttcaaaataattataattaatgtgttaaagaaaatagaacaaaagatggacaawtgggatcaagacagattattgtgacagaattagaatctataaaaaaagaatccagtggacattcaggagcaaaataaaatatctgtaataaagagtatatcgaatgggtttagctgcacaatggatacagcagaaagctggattagtgaccctgaagacagatgaatagaggatatctaaattgtagcacagcaagagaaaaatggaataaaaaactgaacagaaatatgagaaatatggcgagaaggcctaacatacacacaattcaagtttagaaagaaaaggagagaagaaatggga

SEQ ID NO: 68716 - DNA, 601 bp, Human
agctcaatacttgtaagaagggaaatacagaagctgaaaccctgttcaccccagcttttcctctgagggcattttctttgctgaagcacagggaaatggatgcagagagtagaagtcttgctggatggaggaaatagggattggagttggggctgcaaagatgactaggatttgggaagggcagcataccagaaaggagagaacaacaggaaaagagtctcaaaagctctgttgaaagtttccctcaggttcttggctgactcctaagctgtgtatgcatagtatgatacactggaaaatmtatcagaaaacagccaatgggagcagagattttagaggttgcctcctattctgggaggaaggtgttggggttcatacccagtcagaaaggagagaccttaatgaatactctgggatttcatttgagaccccagaaaatctatgctctaagagtaaagaccacatcctaggaataagggcaaaactgtaacatccacaatattcacaatatttacaaaatgagtaaataatcaggaaaaaatggataaccatgagataaaatagtcaccagaagcagaccagagatgatccagatattgga

SEQ ID NO: 68717 - DNA, 601 bp, Human
ctcttgcatctctgaacttgcctccttctgctcttgccctagctcactctactccagccacacttgctgttccttgaacatctcaagcatgctcctacttcacttgccatttgcacttgtcattccttctgcctggaattccttctcagataaccatgattctctcagattcttcctttccctcatgtctctaatgactatcatcctgtcatggcggcatcctagacagcctgtataaagttgagccctcaattcaaccactgttcccaagcccacttaccctgcttaatgtttttccatggcacagataactatctgacagatgatggacaaactaatcatactttttgcccctccagaagaaaaactccatcagagcagagaccttgcaattctattcaccattgagtttccagaacccattacaggtactcaagaagtattaatggaatgaatgaatgaattactgctgctcataaagcatgcccctttctcaagcccccaccccttagcttgagcatcctctttgctcacctagacttctacagccttcccacttgactcctcacctccagggtctcctccctcgattccatcctcc

SEQ ID NO: 68718 - DNA, 601 bp, Human
tgcacatgtgggtctcagccctaatttccctgccaaactgaaggccccctcccctgcacctggatggcccttggatcctccaaaccaatgagtccaaagctcagctcacctgaacttccaaagcctgcaccctgttgctggattttgcttttgtgtaaaggataccacaatcttcctagtcagcaagatatgtcctcaatcatcctgcagcctcttgcatctctgaacttgcctccttctgctcttgccctagctcactctactccagccacacttgctgttccttgaacatctcaagcaygctcctacttcacttgccatttgcacttgtcattccttctgcctggaattccttctcagataaccatgattctctcagattcttcctttccctcatgtctctaatgactatcatcctgtcatggcggcatcctagacagcctgtataaagttgagccctcaattcaaccactgttcccaagcccacttaccctgcttaatgtttttccatggcacagataactatctgacagatgatggacaaactaatcatactttttgcccctccagaagaaaaactccatcagagcagagaccttgc

SEQ ID NO: 68719 - DNA, 601 bp, Human
gctgctgctttccctcctagagctggaagtccttacgatgctgcacccaccttcgtcttcctcacaatcctctcctcttctgcccccggacacagcacctcctctgacccttctctctccgccttctctttctccttcctcctcatacctatggacgttctgcagtctatcgttcatcccaagccccgcttccttctccctgctgaatggagctctcctgatgcacatgtgggtctcagccctaatttccctgccaaactgaaggccccctcccctgcacctggatggcccttggatcctycaaaccaatgagtccaaagctcagctcacctgaacttccaaagcctgcaccctgttgctggattttgcttttgtgtaaaggataccacaatcttcctagtcagcaagatatgtcctcaatcatcctgcagcctcttgcatctctgaacttgcctccttctgctcttgccctagctcactctactccagccacacttgctgttccttgaacatctcaagcatgctcctacttcacttgccatttgcacttgtcattccttctgcctggaattccttctcagataaccatgattctctcaga

SEQ ID NO: 68720 - DNA, 601 bp, Human
agagtgaggcttaaaatgctccctttttcccaagagaagcttctatttcccattaggacaccccaggattcaggaaaccgaggctccggtcagttctgcagggggcagcccatctcccaacttcctttctctcctgctccaccaggatcccctttctcctttttctcctggtccagggaccctccctctggctgctcttgtacccttctctgtgcacactctccttgcccagccttgggagtctgcaggcccactgctgcaggtgggtgctgggagcctggatggggctctttatccttcyctcctctcgtgggtacaagacaggctgatgagactaaagacactggcagctgctgagagaagcagggagaggtgggacagggcagcctcccttcgccttggccgccccctcaccccctatctcacccatgtctatcagagactcaggcgagggagtaaagaggggaaggaagaacgagaagggatgggggaggaggggatgagggggaaagggaggagaatgaggagaaaagatgagaaagtaaggtgagaaatctggcaaagtgaaggaacagggatggaaaagtagaagaaggtaggg

SEQ ID NO: 68721 - DNA, 601 bp, Human
tgctcaaacaacaagccccagaggccctttcctcaaaacctgtccctggacaccataccctttctccagggcataggccagtgtagggaactcactcattcagcctctgccccatggtagacacttaaacaccatctcctatttcttcctcataagaaccctttgggattcacatcaccatacccattttacagatgaagaaactgtgatccagaaagtggatgtgatgtgcttgagttttcattgcttggaaagtagccaagctgggaagggagctcagttctgtgatttcgaagcctakattctccctgtagtgaggagctactcggacatgcctttgctgcctctgctgaggcagaaggcctgtgtgtgccccgagacagcactctatgcctgtgggaaaggactgcaatgggagctgggaaacctctgggttgggagaggaggaagtggcagtgccagagggcaacactcttgggcctaggctccacggctggttttgtggatttactcttcagggattgcctttgcagtcaacccaaattccaccatagttggcctctggttttagacatggaagaccctagtgaaaatgcaaatt

SEQ ID NO: 68722 - DNA, 601 bp, Human
gcctggcagcctgcactgtcactgatgaaaaagggcagacttgtgtaagatgcatctttctgctcaaacaacaagccccagaggccctttcctcaaaacctgtccctggacaccataccctttctccagggcataggccagtgtagggaactcactcattcagcctctgccccatggtagacacttaaacaccatctcctatttcttcctcataagaaccctttgggattcacatcaccatacccattttacagatgaagaaactgtgatccagaaagtggatgtgatgtgcttgagtttycattgcttggaaagtagccaagctgggaagggagctcagttctgtgatttcgaagcctatattctccctgtagtgaggagctactcggacatgcctttgctgcctctgctgaggcagaaggcctgtgtgtgccccgagacagcactctatgcctgtgggaaaggactgcaatgggagctgggaaacctctgggttgggagaggaggaagtggcagtgccagagggcaacactcttgggcctaggctccacggctggttttgtggatttactcttcagggattgcctttgcagtcaaccca

SEQ ID NO: 68723 - DNA, 601 bp, Human
tctctttgcaagatgcctgacaaacccttgcttatttttccaagtcatgctcagaggtttttttctttccactttatagcagctttctcctccaaaaatgaaacataaacacagcaatagtttggacagatgtttctcagcagaatgtacagctttaatttctggtatgtgtaggtctgacagcttctcagccattgcatggtaggaaggaaaggggcctaagcatttcctgctctctgatctgggctggtgtgcttgctttggctcataaataggatggtgactctttaaatgtggccartgaggtgtacacacccaactgtctccagcaaaccatggccaggcaggtggtccagcaaggaagatattcccattagactggggaagaaagcaaggcccagagaatgtcaggattggccccaaatcacgtggtcaggtagaggctgaggcacaactggtaccctcattcttccagctgtgtctaccagccacagggatttgggtaacgcagaaaaaggagatggcctggaggtgaaaggacagatactcttttcttgttcgtgggcctgttgacatgttcatggctatctctaacctatcc

SEQ ID NO: 68724 - DNA, 601 bp, Human
ttttaaccgttctcctgttcagggatactgaaataaatagtttcatccctttttctactgatagacgttcaggtgctttgaacaatttttcttgaagctgggcatggtggcacatgtctataatcccagctactagggaaggtgaggcaggagcatcaattgagaccaggagttcaagagcagcctgggcaacatagcaagaccccatctataaaaaaataaaaaattatccgggtatggtggcatgtgcctgtagtcccagctactcaagaggctgaggcaagagggtcacttgagtccgggtcaaggctgcagtaagctatgatcatgccactgcactgtagcctgggtgacagagagagatcctgtctccaaaataaataaataaataaatttctattgcatatcttttatcaatactaataaataaaaggcctccacacataagtagctatgggtagtcatgaagtcggtagatacaaagcctacaggctaccctgatggctggacatagaggcggcccctttcagcttgggcacacacctgttgacaagtatcatcacaaacgtcaacttcataatcaacatttgggtctctggtt

SEQ ID NO: 68725 - DNA, 601 bp, Human
ctctagacctgcctttctgatagagaagcatacttctgatggtagtagccaaggagtggccatttgcagggctgtagagagagcttgggtgtgcaggctggagtgtctacatgtgtaatgtcccccaattattgagagagaaccagcggtgggaagaaaagatggcaggccgtgggccagagcctctgtttactttcttgcctcaggcccctcagatgttagaggtgggcctggtatagatagataatatagttctgcctcattctttatagtggcttcacagtgttatactttttaaccrttctcctgttcagggatactgaaataaatagtttcatccctttttctactgatagacgttcaggtgctttgaacaatttttcttgaagctgggcatggtggcacatgtctataatcccagctactagggaaggtgaggcaggagcatcaattgagaccaggagttcaagagcagcctgggcaacatagcaagaccccatctataaaaaaataaaaaattatccgggtatggtggcatgtgcctgtagtcccagctactcaagaggctgaggcaagagggtcacttgagtccaggtcaagg

SEQ ID NO: 68726 - DNA, 601 bp, Human
tccagggcctgtgcaggcctctcctctagacctgcctttctgatagagaagcatacttctgatggtagtagccaaggagtggccatttgcagggctgtagagagagcttgggtgtgcaggctggagtgtctacatgtgtaatgtcccccaattattgagagagaaccagcggtgggaagaaaagatggcaggccgtgggccagagcctctgtttactttcttgcctcaggcccctcagatgttagaggtgggcctggtatagatagataatatagttctgcctcattctttatagtggctkcacagtgttatactttttaaccgttctcctgttcagggatactgaaataaatagtttcatccctttttctactgatagacgttcaggtgctttgaacaatttttcttgaagctgggcatggtggcacatgtctataatcccagctactagggaaggtgaggcaggagcatcaattgagaccaggagttcaagagcagcctgggcaacatagcaagaccccatctataaaaaaataaaaaattatccgggtatggtggcatgtgcctgtagtcccagctactcaagaggctgaggcaagag

SEQ ID NO: 68727 - DNA, 601 bp, Human
aaatagcctaggcctgagtccagggcctgtgcaggcctctcctctagacctgcctttctgatagagaagcatacttctgatggtagtagccaaggagtggccatttgcagggctgtagagagagcttgggtgtgcaggctggagtgtctacatgtgtaatgtcccccaattattgagagagaaccagcggtgggaagaaaagatggcaggccgtgggccagagcctctgtttactttcttgcctcaggcccctcagatgttagaggtgggcctggtatagatagataatatagttctgccycattctttatagtggcttcacagtgttatactttttaaccgttctcctgttcagggatactgaaataaatagtttcatccctttttctactgatagacgttcaggtgctttgaacaatttttcttgaagctgggcatggtggcacatgtctataatcccagctactagggaaggtgaggcaggagcatcaattgagaccaggagttcaagagcagcctgggcaacatagcaagaccccatctataaaaaaataaaaaattatccgggtatggtggcatgtgcctgtagtcccagctactc

SEQ ID NO: 68728 - DNA, 601 bp, Human
tgctggtcatcaggatcaccaggggaggtacaaatgcaggttcctgaaccccacctccagaaggttctgactcagccagtgtgggacacgacccaggaatctgcagatcctctggggtgtacaggcaggatgggaagccctgtttgaaggatctgctaaggaagcaggtaggaggccctctggccaagtaaagcagcacttctaccctgggaactttcactgtatctggggatcatgaccacagccatctctgaccatctagcgcacccagattgattttatctatttatttttgaaaaakttgttttacttctttcggtcataagaaaatatgtaataaataatcctttaattggttcaaaaaattcacttatttaaaaactgtgattctttgtgtattaaaggtaaaatacacatttgttatctagtgttcatgttgcagaactgtgcaaactaatacttttgttttgtttttttgagacagagtatcgctctgttgcccaggctggagtgcagtggcgggatctcagctcactgcaacctccaccccgctgggttcaagcaattctcctgcctcagcctcccgagtagctgggattac

SEQ ID NO: 68729 - DNA, 601 bp, Human
tttctctcaacacagcccccgctcccttaaacccacatggtccctttgtctcttttttctcctggctccattttccttttctgaaatcagataggggcatcagggaggggtttcactggaggagccgagagctcgagggaacaaaggagagattattcctttagtgaggcctttctctccctctctctccatggaaaatggaatctcctccagcccctgtgagtttggtggctaatgggttcaagatgggtctggggaagcgctgagagcagcaagtccaaatgcctgcccagtggggacsccggggctgccctgcctgggggttgggtgtagatggagaatctggcccaggacctgcccaaggggagaagttggcacctgcaggtcttcctggactgactgcaggggcttgtggttcaccttggctcacacatctggtgaggcctggcctcgtgggggctagggaaacgagagcccctctgtttgcacatcccttactctccctccataaagtcctatcagacactggaaacctttgtgtgcattttaaacagggacatatacatgatgattaattttatgtgtcaacttgactgggcca

SEQ ID NO: 68730 - DNA, 601 bp, Human
tccctgatgggcctcccagcctccctctgcaaggcctcaacctcacatcccgggaaatccaattatcattggttatccttttcatttgaatgaatcactttcaatgcaatttaattgcacttgattttgatctccaggacagctttggggctggcagagcagtttgtgtctgaggctcagaatgtaggtatgatgagcctgcagagagacactgatcagtttcacagccaggactcctcgtcctgtgctctttttttcattgtgaagaagtggaaggctcagtgctcagagaggagtgagrcctgtcctctctagggccagcagggcctgtccccacaggagcctctcacctctctcctctctcaccccattcccttcctcacctgttcctttctctcaacacagcccccgctcccttaaacccacatggtccctttgtctcttttttctcctggctccattttccttttctgaaatcagataggggcatcagggaggggtttcactggaggagccgagagctcgagggaacaaaggagagattattcctttagtgaggcctttctctccctctctctccatggaaaatggaatctcctcc

SEQ ID NO: 68731 - DNA, 601 bp, Human
gcattgacagtgggagagctgagagaagcatgaagagaaggagctgaagtcctgctgatgctttgaacccctggatcaaactgtacctgcagcctaactaccactgggcttttcagacataggctcaatgactaccttttactgcatagtaagtctgtgagtttttaggtacttataacttaaaacatcctaatgtttagagtgtacaaggcaaaaaagtgcacatagttaaaattactcttagaaattccatatgttattatgctataagagaaacatggcaaccaagaccaatgagggagaagcagattcatatcccctagctcatgctccacctggggcctggacttactgagtaagtggtgggtggaatcaccagcaccatgtatattatttctctcttgttgtttaactgaatgcataaaactttcccctggcctagccttgtggcaacagaaacccttttgtcctgtgtgcattccacatataacagctgcttagacagggaaccctgcattccagatgtttctggttacctgggaacaggcctcgagaccatcagagctgggaggaaacatgcaggttccttgggccagcctca

SEQ ID NO: 68732 - DNA, 601 bp, Human
ataaacctaaatagaactcacatttattttatttctgtactccagtatacagtccagcatagtccctgtggtgtgtgtaccccaccctggagatcatccctttaaaatccagcataaattcccacctgctccaggaagccctcggtgattaccctggcctttctcacataaactggcttgtaatccctgctgcctggtgtggccaatgtcgtagtgtcatgattccttgaggtctgagatgtcctggactgccctactgcaccagagtagggtggtcctgaaggcactcggcaaagaggtscccagtgaccaacctaaccttctgtgtgacagtctgcagcaggagcaactgtgggggcttttggctttgcctcaggcctaagagaagcccctgaattcaatccttggaaagagggttgttgagaaatcgagtactttccatgcataggagttcaatggagtgacccagcttccatgctaaagtcaatgttgactgcttccctggtttccatttcctccttcccaacagtactcatttctgtttgaggatccagggattctgactctattcccagttgcagggatggagcacatagctcag

SEQ ID NO: 68733 - DNA, 601 bp, Human
aagtgtatatgtaaattataccagcataaactgtccaattttaataaactgtatattaaatgttagtaattctatttttttcagataaaatataaacctaaatagaactcacatttattttatttctgtactccagtatacagtccagcatagtccctgtggtgtgtgtaccccaccctggagatcatccctttaaaatccagcataaattcccacctgctccaggaagccctcggtgattaccctggcctttctcacataaactggcttgtaatccctgctgcctggtgtggccaatgtygtagtgtcatgattccttgaggtctgagatgtcctggactgccctactgcaccagagtagggtggtcctgaaggcactcggcaaagaggtccccagtgaccaacctaaccttctgtgtgacagtctgcagcaggagcaactgtgggggcttttggctttgcctcaggcctaagagaagcccctgaattcaatccttggaaagagggttgttgagaaatcgagtactttccatgcataggagttcaatggagtgacccagcttccatgctaaagtcaatgttgactgcttccctggtttcc

SEQ ID NO: 68734 - DNA, 601 bp, Human
ctggctgcgggctcccggcattcttcctgcggaggcgcagggagcagggcttcggtggatgggaaaatgggcaacaggcattccagccacagccctgtaggaccctttccctgttgaccaacctctaagaagggccttgccaagagaggatggtccctgtggagactgcactctggaaggccggacatggcactctggaagccctctgctgggctccttggctccctgcaggacccagactaagacaaagggcccctggctccagtgccctcccacctgactctacctcacaccctctccwacaaggctctttggggactcatcctgaattctgcttatcctcagctccattcttccaggcagttttggtctctaaacttttaaaattcaatctcctgtaagaaaaaagatgatatgtacccctaattatgtgtaagtgtatatgtaaattataccagcataaactgtccaattttaataaactgtatattaaatgttagtaattctatttttttcagataaaatataaacctaaatagaactcacatttattttatttctgtactccagtatacagtccagcatagtccctgtggtgtgt

SEQ ID NO: 68735 - DNA, 601 bp, Human
ctacgcctctcgggggcttgataccctatacctcctggcgtgggcaccagacggcacagcaaaccccaaaggtcgtggcgagcatccggccctttccattggctgtgtgctgtgagtcactggctgcgggctcccggcattcttcctgcggaggcgcagggagcagggcttcggtggatgggaaaatgggcaacaggcattccagccacagccctgtaggaccctttccctgttgaccaacctctaagaagggccttgccaagagaggatggtccctgtggagactgcactctggaaggcyggacatggcactctggaagccctctgctgggctccttggctccctgcaggacccagactaagacaaagggcccctggctccagtgccctcccacctgactctacctcacaccctctccaacaaggctctttggggactcatcctgaattctgcttatcctcagctccattcttccaggcagttttggtctctaaacttttaaaattcaatctcctgtaagaaaaaagatgatatgtacccctaattatgtgtaagtgtatatgtaaattataccagcataaactgtccaattttaataaa

SEQ ID NO: 68736 - DNA, 601 bp, Human
tgttcacgtcaccactgagaccagccaaattgcctggggtctggcagcccctgccaccccctgcagcctcaggcttatacagccttctgcagcctcagggcctgctacgcctctcgggggcttgataccctatacctcctggcgtgggcaccagacggcacagcaaaccccaaaggtcgtggcgagcatccggccctttccattggctgtgtgctgtgagtcactggctgcgggctcccggcattcttcctgcggaggcgcagggagcagggcttcggtggatgggaaaatgggcaacagrcattccagccacagccctgtaggaccctttccctgttgaccaacctctaagaagggccttgccaagagaggatggtccctgtggagactgcactctggaaggccggacatggcactctggaagccctctgctgggctccttggctccctgcaggacccagactaagacaaagggcccctggctccagtgccctcccacctgactctacctcacaccctctccaacaaggctctttggggactcatcctgaattctgcttatcctcagctccattcttccaggcagttttggtctctaaac

SEQ ID NO: 68737 - DNA, 601 bp, Human
aggtttggaggacatgattcagtcccagtttgagaggataactgccgaagcgcagggaaaatgttcacgtcaccactgagaccagccaaattgcctggggtctggcagcccctgccaccccctgcagcctcaggcttatacagccttctgcagcctcagggcctgctacgcctctcgggggcttgataccctatacctcctggcgtgggcaccagacggcacagcaaaccccaaaggtcgtggcgagcatccggccctttccattggctgtgtgctgtgagtcactggctgcgggctcccrgcattcttcctgcggaggcgcagggagcagggcttcggtggatgggaaaatgggcaacaggcattccagccacagccctgtaggaccctttccctgttgaccaacctctaagaagggccttgccaagagaggatggtccctgtggagactgcactctggaaggccggacatggcactctggaagccctctgctgggctccttggctccctgcaggacccagactaagacaaagggcccctggctccagtgccctcccacctgactctacctcacaccctctccaacaaggctctttgggg

SEQ ID NO: 68738 - DNA, 601 bp, Human
gaaaagaaaaagaaagaaaggcaccgagaaacagaaggggccatatctaggcaagctatgcgcaaagactggtggcttccgaaaagtcacgtgtcctggcagtggctgagatgggacaatctggtagtaaattcactaagtcactgtgacctcaaatttgcaatgagaccggttttgtccttttcaaagaacaagggccactccctgggtcccatctccactctcccagacctcatttctctgggagtccatagtacttcatgaggtaggagggcagggcttactgtcgccataatatagmtgcagaaactgaggccccaagaggggagctgacccagccccacagttggtttgctgcggggctgggactggagttctcctgggacagcttcctctgcattgccccaaatgtttctttgccatgaagagagggcctgggtcagcccttctctccattcttgagtctgggcattacgtgtgcctgttgggcttgaggtttggaggacatgattcagtcccagtttgagaggataactgccgaagcgcagggaaaatgttcacgtcaccactgagaccagccaaattgcctggggtctggcag

SEQ ID NO: 68739 - DNA, 601 bp, Human
caagaccagcctggccaacatggtgaaacccccgtctgtactaaaaaatacaaaaaaaagtagccgggcgtggtggtgggcatctgtaatcccagttacttgggaggctgaggcaggagaattacttgaatctgggaggaggaggttgcagtgagccgagatcatgccactgtactccggcctgggtgacagagcgagactctatctcggggaaaagaaaaagaaagaaaggcaccgagaaacagaaggggccatatctaggcaagctatgcgcaaagactggtggcttccgaaaagtcaygtgtcctggcagtggctgagatgggacaatctggtagtaaattcactaagtcactgtgacctcaaatttgcaatgagaccggttttgtccttttcaaagaacaagggccactccctgggtcccatctccactctcccagacctcatttctctgggagtccatagtacttcatgaggtaggagggcagggcttactgtcgccataatatagctgcagaaactgaggccccaagaggggagctgacccagccccacagttggtttgctgcggggctgggactggagttctcctgggacagct

SEQ ID NO: 68740 - DNA, 601 bp, Human
ctcatgcctgtaatcccagtactttgggaggctgaggtaggtggatcacctgaagtcaggagttcaagaccagcctggccaacatggtgaaacccccgtctgtactaaaaaatacaaaaaaaagtagccgggcgtggtggtgggcatctgtaatcccagttacttgggaggctgaggcaggagaattacttgaatctgggaggaggaggttgcagtgagccgagatcatgccactgtactccggcctgggtgacagagcgagactctatctcggggaaaagaaaaagaaagaaaggcaccragaaacagaaggggccatatctaggcaagctatgcgcaaagactggtggcttccgaaaagtcacgtgtcctggcagtggctgagatgggacaatctggtagtaaattcactaagtcactgtgacctcaaatttgcaatgagaccggttttgtccttttcaaagaacaagggccactccctgggtcccatctccactctcccagacctcatttctctgggagtccatagtacttcatgaggtaggagggcagggcttactgtcgccataatatagctgcagaaactgaggccccaagaggg

SEQ ID NO: 68741 - DNA, 601 bp, Human
cacctctcagggtgcctctgggagaatcaggcgcagcatgttctagattagaaaagccacggccagctgggtgcagtggctcatgcctgtaatcccagtactttgggaggctgaggtaggtggatcacctgaagtcaggagttcaagaccagcctggccaacatggtgaaacccccgtctgtactaaaaaatacaaaaaaaagtagccgggcgtggtggtgggcatctgtaatcccagttacttgggaggctgaggcaggagaattacttgaatctgggaggaggaggttgcagtgagccragatcatgccactgtactccggcctgggtgacagagcgagactctatctcggggaaaagaaaaagaaagaaaggcaccgagaaacagaaggggccatatctaggcaagctatgcgcaaagactggtggcttccgaaaagtcacgtgtcctggcagtggctgagatgggacaatctggtagtaaattcactaagtcactgtgacctcaaatttgcaatgagaccggttttgtccttttcaaagaacaagggccactccctgggtcccatctccactctcccagacctcatttctctgggag

SEQ ID NO: 68742 - DNA, 601 bp, Human
cgttcctcccgggcactgttgccagatggaggagcacctctcagggtgcctctgggagaatcaggcgcagcatgttctagattagaaaagccacggccagctgggtgcagtggctcatgcctgtaatcccagtactttgggaggctgaggtaggtggatcacctgaagtcaggagttcaagaccagcctggccaacatggtgaaacccccgtctgtactaaaaaatacaaaaaaaagtagccgggcgtggtggtgggcatctgtaatcccagttacttgggaggctgaggcaggagaattrcttgaatctgggaggaggaggttgcagtgagccgagatcatgccactgtactccggcctgggtgacagagcgagactctatctcggggaaaagaaaaagaaagaaaggcaccgagaaacagaaggggccatatctaggcaagctatgcgcaaagactggtggcttccgaaaagtcacgtgtcctggcagtggctgagatgggacaatctggtagtaaattcactaagtcactgtgacctcaaatttgcaatgagaccggttttgtccttttcaaagaacaagggccactccctgggtccc

SEQ ID NO: 68743 - DNA, 601 bp, Human
catcccccatctcccagggagacccaccccactgctctggggtggagaccccgctcctcgaaggagggaggcccagggtcctggccctagggaagtccagtcctccagggcaaagcctagaattgcagcttgtcagccaaaatggaactttttctcccttctgagagcagagcaagcaatgacccagctgctgtctgacctttaggacaagtgggagcactttagtggactggtgtgtgcgcttagtggatacacatttgcacacacataagcagatacacacatgcatgcaaacacacaygagtagattttaggagggcttcggaggctgggggctgttcacagcatctccctgttccagaatatgcctgaaagctctttggcgaggaaaagcttgcatttccgaagggcagtgctgcatggtggttaaagggaggccatagcctgcatgaactggacgccaagccctgctccttgtgagctgagtgaccccgggcaggtcccctcacctctgtatgctgtcatttcctatctgttaaatggttaaatcccatatgggtgttgtgaggattaaatgagtccaaatgtgcctcacacatgg

SEQ ID NO: 68744 - DNA, 601 bp, Human
cctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccagctatgctgggttttgaacttcccacccatggtgctgatacagatgtggacagygggagcctccgggaccatgtgacagacggctggctgccctggggagttctttgggctttcttttggatgctgaccttttcatccatcagcttatctcttgaacctctgccattcccgcccagtgagaccctgctgcccttcccatcccccatctcccagggagacccaccccactgctctggggtggagaccccgctcctcgaaggagggaggcccagggtcctggccctagggaagtccagtcctccagggcaaagcctagaattgcagcttgtcagccaaaatggaactttttctccc

SEQ ID NO: 68745 - DNA, 601 bp, Human
ggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccagctatgctgggttttgaacttcccacccatggtgctgatrcagatgtggacagtgggagcctccgggaccatgtgacagacggctggctgccctggggagttctttgggctttcttttggatgctgaccttttcatccatcagcttatctcttgaacctctgccattcccgcccagtgagaccctgctgcccttcccatcccccatctcccagggagacccaccccactgctctggggtggagaccccgctcctcgaaggagggaggcccagggtcctggccctagggaagtccagtcctccagggcaaagcctagaattgcagcttgtcagccaaaatg

SEQ ID NO: 68746 - DNA, 601 bp, Human
gtacagtgtttggtacacgctaggtgcccattaaaggttcggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccrgctatgctgggttttgaacttcccacccatggtgctgatacagatgtggacagtgggagcctccgggaccatgtgacagacggctggctgccctggggagttctttgggctttcttttggatgctgaccttttcatccatcagcttatctcttgaacctctgccattcccgcccagtgagaccctgctgcccttcccatcccccatctcccagggagacccaccccactgctctggggtggagaccccgctcctcgaaggagggaggcccagggtcctggccctagggaagtccagtcct

SEQ ID NO: 68747 - DNA, 601 bp, Human
gtaaccttctcaaaaactacctgctcagagaagccttccctgatcaccttctatggtagaaatccctctccacttccatcaccccctagccactcttattacagcacctggtttattgcacagcattgatccctgcctaaaattatcctgcttcctaatttgcctacccgattactgtccccttccttggcctcttgctccccaccatatccccaataaatagtacagtgtttggtacacgctaggtgcccattaaaggttcggaaacagattagacctggaatggatcctaagggttgtygagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccagctatgctgggttttgaacttcccacccatggtgctgatacagatgtggacagtgggagcctccgggaccatgtgaca

SEQ ID NO: 68748 - DNA, 601 bp, Human
tagggcgtttgcacttgctcctcctttgtctggagtgctccgcccccacctgtaaccttctcaaaaactacctgctcagagaagccttccctgatcaccttctatggtagaaatccctctccacttccatcaccccctagccactcttattacagcacctggtttattgcacagcattgatccctgcctaaaattatcctgcttcctaatttgcctacccgattactgtccccttccttggcctcttgctccccaccatatccccaataaatagtacagtgtttggtacacgctaggtgcscattaaaggttcggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccagctatgctgggttttgaacttcccacc

SEQ ID NO: 68749 - DNA, 601 bp, Human
ttcctaccttagggcgtttgcacttgctcctcctttgtctggagtgctccgcccccacctgtaaccttctcaaaaactacctgctcagagaagccttccctgatcaccttctatggtagaaatccctctccacttccatcaccccctagccactcttattacagcacctggtttattgcacagcattgatccctgcctaaaattatcctgcttcctaatttgcctacccgattactgtccccttccttggcctcttgctccccaccatatccccaataaatagtacagtgtttggtacackctaggtgcccattaaaggttcggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacgatttcctcactgaagtttgggccccagctatgctgggttttgaa

SEQ ID NO: 68750 - DNA, 601 bp, Human
aaccacatggcctttctttatcttctccaacagggcagacttgttcctaccttagggcgtttgcacttgctcctcctttgtctggagtgctccgcccccacctgtaaccttctcaaaaactacctgctcagagaagccttccctgatcaccttctatggtagaaatccctctccacttccatcaccccctagccactcttattacagcacctggtttattgcacagcattgatccctgcctaaaattatcctgcttcctaatttgcctacccgattactgtccccttccttggcctcttgytccccaccatatccccaataaatagtacagtgtttggtacacgctaggtgcccattaaaggttcggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacctggaaccatatgccaccaaccaggcaccctcttcccttagacga

SEQ ID NO: 68751 - DNA, 601 bp, Human
tgcccactcttccaccacaccccaacctcattgcctctgtcccaaccacatggcctttctttatcttctccaacagggcagacttgttcctaccttagggcgtttgcacttgctcctcctttgtctggagtgctccgcccccacctgtaaccttctcaaaaactacctgctcagagaagccttccctgatcaccttctatggtagaaatccctctccacttccatcaccccctagccactcttattacagcacctggtttattgcacagcattgatccctgcctaaaattatcctgcttcytaatttgcctacccgattactgtccccttccttggcctcttgctccccaccatatccccaataaatagtacagtgtttggtacacgctaggtgcccattaaaggttcggaaacagattagacctggaatggatcctaagggttgttgagtccagcctccttgctttacacacgagtaaactgaggctcagagagaggatgtgaactccgcatggacacacagcaaagaatttgtacagctggaaggggactccaggttggccagtttcagaagcctgtgttctcagggtgctgatgacct

SEQ ID NO: 68752 - DNA, 601 bp, Human
aagcagtggcaggtggctcttaccaggaagctgttgtccttggggttggtggcgagactaaggccgaggcgcatgttgtctttccgctcggacacgttggacagggtgacccttcctggggttgggggagaagttcagcttgcagccccctcctgcccgccctctgcccagagcctgctgctggtctggtcacccgaggtgcctccccgattctccctgaccctggggacctctggctctcagggtttacaaaggccttccccagacgtactctcaggacttcctcacaactgcctgtgakatgagaaaaccgagtctcagagaggcaaacaacctgcccaaggtcacacagtgagcactcaccgagccttctatctcctagcccacagcttttcctcctccagccatccgactggagccccacttccccgtgtgcccccaagcatgccatggcatcccacctgggctggcttcctttgtgcagtatccccgctacgctttcttccaagttgacccccatccacacttaaccagtcctgtgcccaactctttctgtgtccacttctctgctcatctgaacaatcaacatgtgacagctgag

SEQ ID NO: 68753 - DNA, 601 bp, Human
ctatcctgcaactgtttctaggaaccatcagtctcagaaggatcctgtttgaaccccaagcatcgcccatactcaacgcagctcactccaaggtggtggcaaggagcaggcagtgccaatccattgtgctgcccacactcactaccatgtgcagagtccatatgtgctcacctgggcacagaacagagacctgtaagcagagcctgctgctgtctgtcccccaaagtcctattagacattactcgtttgcttgtcgcctctctttccaccacagtgtaagctccagcaggacagggtctctattcattgctgaatcccggtgcccagcactgggcttagcacatactatggtaagtgctcagaaacatcattgtttaaatgaatgaatgtttctaccacctcaacccagacatgcccttttcttccttgcgaaggcctgtctcttctttaaaaacaaaacagaaacctcctccagccttcttcatctaatcctggatagttgagacggcttgtcactctgtagcccttccctcggctgtggtagtctgtgtttactcatttatggcatcccttccaagtcttctttgggtgtgtggtgcag

SEQ ID NO: 68754 - DNA, 601 bp, Human
tcgtcttatctttatgtcttatttgtcttatctaatttgtcttgtgattcatgccccagatgtctcatttgtcagcagaaatagaccagaacaaagactgacacaagcaccccatctaaaaatgggcagtaatttgtactgggctttctggggtaaattttctctgaagtcctatcctgcaactgtttctaggaaccatcagtctcagaaggatcctgtttgaaccccaagcatcgcccatactcaacgcagctcactccaaggtggtggcaaggagcaggcagtgccaatccattgtgcygcccacactcactaccatgtgcagagtccatatgtgctcacctgggcacagaacagagacctgtaagcagagcctgctgctgtctgtcccccaaagtcctattagacattactcgtttgcttgtcgcctctctttccaccacagtgtaagctccagcaggacagggtctctattcattgctgaatcccggtgcccagcactgggcttagcacatactatggtaagtgctcagaaacatcattgtttaaatgaatgaatgtttctaccacctcaacccagacatgcccttttcttccttgc

SEQ ID NO: 68755 - DNA, 601 bp, Human
ggccaggggtcctgctttgcctctggttatggctaataaagggctgtgggctgaatatacatcaaggcacctcatgactttccctggcagggccactatgcactcaagtccccttgcatcccagtcatcgtcttatctttatgtcttatttgtcttatctaatttgtcttgtgattcatgccccagatgtctcatttgtcagcagaaatagaccagaacaaagactgacacaagcaccccatctaaaaatgggcagtaatttgtactgggctttctggggtaaattttctctgaagtcctmtcctgcaactgtttctaggaaccatcagtctcagaaggatcctgtttgaaccccaagcatcgcccatactcaacgcagctcactccaaggtggtggcaaggagcaggcagtgccaatccattgtgctgcccacactcactaccatgtgcagagtccatatgtgctcacctgggcacagaacagagacctgtaagcagagcctgctgctgtctgtcccccaaagtcctattagacattactcgtttgcttgtcgcctctctttccaccacagtgtaagctccagcaggacagggtctctat

SEQ ID NO: 68756 - DNA, 601 bp, Human
accctccataaaacgggcagcagctgcttgggtgatggtatttagtgcagaggaaatagtgaggctcagagccaagaagtctgggcttgtgggaggcagggtctgagcagtaattccccaggttttcttcgcaggtgggcaatgagcaagaggttttacgttccatgaggctctggacgagctggacagaactccctgctgtccaggagcactgatttggtggaactactaccaaggagatttctgttctccctgttccttcatctacaaggctactgcattgcacaacatcagggggcgycattcatatgtctaagtgaacaattcccccagaattgtgcagtgcacagcttgtctgctgcatgtgcttgccaggtaacctcctatatacccagggtttctgcagtgagcctcccttgaggctgggattgtctttgaaaccttagctcatttgctctccaccatcacacttgggagagggaggccaggattatgactcccacagaggcccagagagtggagtgatacattccaggtcatccggagagctggggcaggacagtgctagagtccaaatactgctttctagccacaggttgtt

SEQ ID NO: 68757 - DNA, 601 bp, Human
aactggctaatttcagtggggggtgagcacaatgttttgagcaacaacattactggaataagcatgtagccttctgcatagacaacatctagggataacatttatctggatgagtgagttctggtgtgattttattttattttatttttttgagacggagtcttgctctgttcaccaggctggagtgcagtggcaccatcttggctcattgcaacctctgcatcctggattcaagcaattctcctgcctcagcctcccaagtagctgggactacaagcgcatgccgccatgcccggctaattttttttttttttgtattttagtagagacggggtttcaccgtgttgcccaggctggtctcgaactcctgagctcaggcaatctgcccaccttggcctcccaaagtgctaggattacaggtgagagccaccactcctggccgagttctggtgtgatttttaaggaatcagcctcactactatacagtctcaggtgtcagatttgactgcattctttccactccattgatgactaacactccataagaagaccccatcctcacagaacctacttcttatagagtgtctgtggcagaagctat

SEQ ID NO: 68758 - DNA, 601 bp, Human
atgggctgcctcccttacccaagccatttcacaagggcctgctgggagtctcgggtctcaccccgaagaaggcaaaacaaaaacagaaaaatggcccattccttatgaggatgagtaagacagccaccttcacatggagaaatgctcatttaggaaaagcttgagcaagttttatcagcaaacagaaacacgctagttgagcaatgacttaattataaagagttatgaggttggaaaagtcttaatcttttgagcctacgaattcacaatactactaaatagttctttttttctttttttyttttttttttgagacagggtctggctctgttgcctaggtggagtgcagtggtgtgatcttggctcaccgcagcctctgcctcctgggctcaagtgatcctcccacctcatcctcctgaatagttgggactacaagcatgtaccaccatgcctggctaatttttgtattttttgtagagatgaggtctcatgcttctgcccaggctggtctcaaacttatgggctcaagcaatcctcccacctcagcctcccaaactgctgggattacaggtctgagccactgcacctggcctaaatagct

SEQ ID NO: 68759 - DNA, 601 bp, Human
tggaagtttgggaagatcagaatttgaggtgaagattgcaacctcagcggtgctcatgagtcactgatggttcaaactacctggtgagtcacacacggataactgaccaggggttggtgggttgtaaagtgaggtccaaacagtgggctttatccctgtatgagtcagttagcttcacactgagaaagtgagagctggtggttatgggctgcctcccttacccaagccatttcacaagggcctgctgggagtctcgggtctcaccccgaagaaggcaaaacaaaaacagaaaaatggcccrttccttatgaggatgagtaagacagccaccttcacatggagaaatgctcatttaggaaaagcttgagcaagttttatcagcaaacagaaacacgctagttgagcaatgacttaattataaagagttatgaggttggaaaagtcttaatcttttgagcctacgaattcacaatactactaaatagttctttttttctttttttcttttttttttgagacagggtctggctctgttgcctaggtggagtgcagtggtgtgatcttggctcaccgcagcctctgcctcctgggctcaagtgat

SEQ ID NO: 68760 - DNA, 601 bp, Human
aacacttgtcacagccctcccatcagtggccaggacccacagattaccgacatctttataagccctcatgttcatggcctggatctttgccctttcataggtgcataggaaaaaacatgcattaagaataaactgagtgaggacagaaaacctttcaccttaaaaggcaccagctgtagtttgggacttgaatttggaagtttgggaagatcagaatttgaggtgaagattgcaacctcagcggtgctcatgagtcactgatggttcaaactacctggtgagtcacacacggataactgascaggggttggtgggttgtaaagtgaggtccaaacagtgggctttatccctgtatgagtcagttagcttcacactgagaaagtgagagctggtggttatgggctgcctcccttacccaagccatttcacaagggcctgctgggagtctcgggtctcaccccgaagaaggcaaaacaaaaacagaaaaatggcccattccttatgaggatgagtaagacagccaccttcacatggagaaatgctcatttaggaaaagcttgagcaagttttatcagcaaacagaaacacgctagttgagcaa

SEQ ID NO: 68761 - DNA, 601 bp, Human
tttctagtatgctgttatttatttatttatttattgtctgcccctctctctagaatgtcagctcacgatggcacggtatttgtacctattttgttcactgatctagccttggtgcctaaaatagtgtgaggcacatagtagaggctcaataaagtgttatgtggacaaaggtagaatcacaccacattgttcaggggccctctccacttccctgctgtacatagctgccaggctcattttttttaacgtgcatatctgatgattacactcctgtactcaagaatctgcagtggccacccaygctggttttaactacaacatcatcactcccaccatctttacatggctcacttcccaccaacatgaaccccttgctgtggtcaaaaggagcacatctctgaatgcaaatgttccttgactttccctctcctctgctgttctcagggtggaatgtcttgtgtggcacgtcttctgttcacctctttttgttggaatcccagggtcttcccaggacaggtccagtgccgcctcctcctggcagttctccttggccactccatgggggcccctccctctctcatcctcaccgagttagggttag

SEQ ID NO: 68762 - DNA, 601 bp, Human
cacggctttggtatcagaggtatctcttcttacgcagcacgctgaggaactgatgcatacaatttaggagttgaggaatttacaaaagctggaatacattagtttagaacatcttcaaactaccagcaaagagaaaaaacatccaccattctcttagcaattctccgatatgctggatatgttgccttaaaaaacccactaattttagtatgtgctgtggactgaaacctgcagaggcacgtgccacatgacgagagcaggtttcgagctcaagcgcaacccagtagcaggagaactctgytattctttccaaggggattctagatgcttccatgactgcatggaagggccaggcccaggaataaaacaccctgcaaaaaagcatggcaggagcaaaacaggttttattatatatggacccaagaaaaatgtcaggatcatatttccatagagtggaatagtgtgaatgtcatatgaatctgtaatcgtgcgaatatcagcatgaatcatcagattttaaattcggattctgcactgggtaaagggacttggatttgttcctttgtaaattagattatacattccttgagagcagcaagag

SEQ ID NO: 68763 - DNA, 601 bp, Human
gccacacggctttggtatcagaggtatctcttcttacgcagcacgctgaggaactgatgcatacaatttaggagttgaggaatttacaaaagctggaatacattagtttagaacatcttcaaactaccagcaaagagaaaaaacatccaccattctcttagcaattctccgatatgctggatatgttgccttaaaaaacccactaattttagtatgtgctgtggactgaaacctgcagaggcacgtgccacatgacgagagcaggtttcgagctcaagcgcaacccagtagcaggagaacyctgctattctttccaaggggattctagatgcttccatgactgcatggaagggccaggcccaggaataaaacaccctgcaaaaaagcatggcaggagcaaaacaggttttattatatatggacccaagaaaaatgtcaggatcatatttccatagagtggaatagtgtgaatgtcatatgaatctgtaatcgtgcgaatatcagcatgaatcatcagattttaaattcggattctgcactgggtaaagggacttggatttgttcctttgtaaattagattatacattccttgagagcagca

SEQ ID NO: 68764 - DNA, 601 bp, Human
caggacaggccacagatttaagctctgtagtgacaggttaaagagccacacggctttggtatcagaggtatctcttcttacgcagcacgctgaggaactgatgcatacaatttaggagttgaggaatttacaaaagctggaatacattagtttagaacatcttcaaactaccagcaaagagaaaaaacatccaccattctcttagcaattctccgatatgctggatatgttgccttaaaaaacccactaattttagtatgtgctgtggactgaaacctgcagaggcacgtgccacatgacragagcaggtttcgagctcaagcgcaacccagtagcaggagaactctgctattctttccaaggggattctagatgcttccatgactgcatggaagggccaggcccaggaataaaacaccctgcaaaaaagcatggcaggagcaaaacaggttttattatatatggacccaagaaaaatgtcaggatcatatttccatagagtggaatagtgtgaatgtcatatgaatctgtaatcgtgcgaatatcagcatgaatcatcagattttaaattcggattctgcactgggtaaagggacttgga

SEQ ID NO: 68765 - DNA, 601 bp, Human
ctggtgagcatccagagttgagactcactttctttagtactgaaaacaggatgtgccagggtgactcagcatccagacaacactaacccataaaatgcgtgcgatgaggcctgacagagctctgacttcctcacaaggactactttgattctattttgggaaacattaaatatcaaattccatgacaaatatttctctttctcactttttattttgttttcagtgcccagagcatgagctcagcccacctatcaggcaatccagcccaggagacagcagggctggcacctcgaccgtcaaytggcagagaggctcttgtaacaggccattgggctacaaagcatgaaaaactggctcccaaatcaccactggcttttggtgtccctgtggccggccctcctttagaccatgaggttctgaggggtatagacatggtctcaccgaggagtctggcccagaagttatagtctgccaataaggatctaaaaataaatgttagtcttagactctgaggttattcctcatgggtctgacccacagcaaggcaggacaggccacagatttaagctctgtagtgacaggttaaagagccacacggctt

SEQ ID NO: 68766 - DNA, 601 bp, Human
tagtctcttcgtgtgtctgtggcttgtcatttccaatgcactgcagacttctcaggctttatactgccttctatttccttttataatcctcccatatgcccaaagcccgatattggaagggcccactgtagcaatttatggtggaaatgaaatttatgcaaatcagaaatggagcttaaatcacaaggagagaggcaatctgaaggactctgcccaaaataaaaaatgcttttggtggagtggaagcagttggcatatagggattaagggtttcagaatacggagtcagactctgctaggyacaagctagggttgcctgatgcaatataggatgcccaattaaaactgaatttcagagaacaaataagttttaacctaagcctgccacacccactgtatcttatttttgcgaaatttggcaaccctagttcaaagcccaccatgctcccaagctgtgagaactttggcaggtcactcaactccgttgagtttcagttttcccagcgataaaaatgagaacattagcaaagcaacctttcagcattgttcataaaacgcacagcctcacgtccggcacggagtaatactcaattgttggcat

SEQ ID NO: 68767 - DNA, 601 bp, Human
aagcctctccccacagagggactccctgaacacatcattggatcgaatgttctcatcactcaaggcgaccgttttgaggagaaatacagatttggatatttgagttctggagtgggtgtcaaagctcacgttcagactttatattcatctgcccttgtttacgagggccattttagtctcttcgtgtgtctgtggcttgtcatttccaatgcactgcagacttctcaggctttatactgccttctatttccttttataatcctcccatatgcccaaagcccgatattggaagggcccactrtagcaatttatggtggaaatgaaatttatgcaaatcagaaatggagcttaaatcacaaggagagaggcaatctgaaggactctgcccaaaataaaaaatgcttttggtggagtggaagcagttggcatatagggattaagggtttcagaatacggagtcagactctgctaggcacaagctagggttgcctgatgcaatataggatgcccaattaaaactgaatttcagagaacaaataagttttaacctaagcctgccacacccactgtatcttatttttgcgaaatttggcaaccctag

SEQ ID NO: 68768 - DNA, 601 bp, Human
catgtatactatgagactgctaaaactggagggaaagtaagcaaaagtgcacagaaatagtgtacgtttttggccagaaatggaatttcccactttgttcattccttttattcactagctttggttccagatgtctttggatggaactcaaacatcaaatccaccctcagagggaggtctgtcaccactgcagatttgcgtaagaaatcccatgagtgctgaaagcctctccccacagagggactccctgaacacatcattggatcgaatgttctcatcactcaaggcgaccgttttgagragaaatacagatttggatatttgagttctggagtgggtgtcaaagctcacgttcagactttatattcatctgcccttgtttacgagggccattttagtctcttcgtgtgtctgtggcttgtcatttccaatgcactgcagacttctcaggctttatactgccttctatttccttttataatcctcccatatgcccaaagcccgatattggaagggcccactgtagcaatttatggtggaaatgaaatttatgcaaatcagaaatggagcttaaatcacaaggagagaggcaatctgaagg

SEQ ID NO: 68769 - DNA, 601 bp, Human
ttatattacagggcatgtatactatgagactgctaaaactggagggaaagtaagcaaaagtgcacagaaatagtgtacgtttttggccagaaatggaatttcccactttgttcattccttttattcactagctttggttccagatgtctttggatggaactcaaacatcaaatccaccctcagagggaggtctgtcaccactgcagatttgcgtaagaaatcccatgagtgctgaaagcctctccccacagagggactccctgaacacatcattggatcgaatgttctcatcactcaaggygaccgttttgaggagaaatacagatttggatatttgagttctggagtgggtgtcaaagctcacgttcagactttatattcatctgcccttgtttacgagggccattttagtctcttcgtgtgtctgtggcttgtcatttccaatgcactgcagacttctcaggctttatactgccttctatttccttttataatcctcccatatgcccaaagcccgatattggaagggcccactgtagcaatttatggtggaaatgaaatttatgcaaatcagaaatggagcttaaatcacaaggagaga

SEQ ID NO: 68770 - DNA, 601 bp, Human
acacaccttccaggtgcccatgtgggttgttactggtagcccacttacttctgaaaagggctcgggacaacttatattacagggcatgtatactatgagactgctaaaactggagggaaagtaagcaaaagtgcacagaaatagtgtacgtttttggccagaaatggaatttcccactttgttcattccttttattcactagctttggttccagatgtctttggatggaactcaaacatcaaatccaccctcagagggaggtctgtcaccactgcagatttgcgtaagaaatcccatgagygctgaaagcctctccccacagagggactccctgaacacatcattggatcgaatgttctcatcactcaaggcgaccgttttgaggagaaatacagatttggatatttgagttctggagtgggtgtcaaagctcacgttcagactttatattcatctgcccttgtttacgagggccattttagtctcttcgtgtgtctgtggcttgtcatttccaatgcactgcagacttctcaggctttatactgccttctatttccttttataatcctcccatatgcccaaagcccgatattggaagggc

SEQ ID NO: 68771 - DNA, 601 bp, Human
attcgcttctaaagagcaaatgaactgtggctatttctctgctgtcctacagattgtacgttatttgtgggaaggatcacctgggtgtttactcattgtctggtggcttaagacaacataaataggtggaagacctcgactcccctcttccagcccacagaagatgggaggcagagagaccccaagaaagagagaaagtgaggagaagagccaacccatctgtgaaggtggatgacagatccagagagctagaaaggggaagagcatgccctcgagagacagaggctgggctctgtgcccrtacctccaccacatacctccaccacgtgcgaggaaaagcccgtctgtgacatctccagcccaaaggaggtctcgttcttgttggtgcctgcaacagagtgacagagagatgtcagctccatgcccaatcccttagcgccagacagatctgctgcccaacccacagctcctgcttcctgggggcatcgtcaggaggtggggctctctttcgaggggggctctgaagctgaggccagtagtgtgccagcctcctcagccctccccagcaccctgtgcagtggggggcaccacacaccttcca

SEQ ID NO: 68772 - DNA, 601 bp, Human
gagggcaacaggatgacagtgacatataactaggatgcactaatgggccttctctggtaaattaggaggaataagtacactctcatggtgccagcccaggcagaacacacatacacacacacacacacacacttgcacacacatgcacctgggacacctgtctgtgcaaagcacacccacaggagcacgtatcgatactgacagatgcagtcggtacgttttcccacatgacaatcctgggcaggactttacagtacattaagcatattcacagacatcgactcttctgtcccccttgcartcctgggaggctccagcccctccttatgaaccagcaccaggtgaagcacacagcgggggagtgatgcagagccccagatgtcacatgttgcttgtgacaccacacccctccctctgtgggccagccccaccccaggacctctgcaatctgatgcagcacccacacagtggggggggcctatgagtcacctgccagagcacagctggaacatctggataccctcccaacattgacatggggcctggcatgtgcaggccgccttgggcactggagctatccaaagcacgtgccattggcttt

SEQ ID NO: 68773 - DNA, 601 bp, Human
atattttttctgaagaattttactccagcaggtcacttaaccttctcatgccttgaattctttatgtgtaaactaggaacaaggagtcctgccctatccacctcacagaggagttaggagagggcaacaggatgacagtgacatataactaggatgcactaatgggccttctctggtaaattaggaggaataagtacactctcatggtgccagcccaggcagaacacacatacacacacacacacacacacttgcacacacatgcacctgggacacctgtctgtgcaaagcacacccacargagcacgtatcgatactgacagatgcagtcggtacgttttcccacatgacaatcctgggcaggactttacagtacattaagcatattcacagacatcgactcttctgtcccccttgcaatcctgggaggctccagcccctccttatgaaccagcaccaggtgaagcacacagcgggggagtgatgcagagccccagatgtcacatgttgcttgtgacaccacacccctccctctgtgggccagccccaccccaggacctctgcaatctgatgcagcacccacacagtggggggggcctat

SEQ ID NO: 68774 - DNA, 601 bp, Human
tcatcctactctcaaagctaagaactgccgttcaggattgtttacaagttgactcctggtggcaagaatcatttccgggtcctttcagcactttagtggcacttgacaaatgcatgtagatttaattaaattgcatttccttgttgcgttttctaatcagctctgacgtcagagtctggagaccagggctggtcctgccagagcacatgactctgctggcccccacgtgaatggatgctctcacctcgctgtgctgggctctttaccctcagactctgagctccttgagggcagggctccygcctctgattctcctggcatcaggctcaggacccagcacagagaaggcactgaaaagagtggctgatccaaccacctaaaatgggataactatcatcacctgccaaccttgtagggctgttctggtgtgaaatgaggtgcaggaatttcctggagaagtttaaaccgctgtgcacatgtaacagggctgttattaggatagggcagctatatttacatcttgctgttattcaagacagtgggcatgaaactgtccagatgcagctcagaaaagtctgagtgtgagtggcatttccgtcca

SEQ ID NO: 68775 - DNA, 601 bp, Human
aaaatggctgtgaatggacaaaggaaacattgggacattcattttctcttctgtccccaacaccagggctgacctctgagctgtgccaggatgtcacccagtgtgtgtccataatgctctctgttctcctgcttactgccacccaggactgctgaaatccgtgtcctttaggggcagctcgagtgccaagccctctccggatctttccctgaccaccccttcttttagtggaggcccttccttctatactaccttgatcacgttgctttggttaacattagacatgtgcatgtctcccccyatcccctgcattgagcagggggtcttcacaggggatcttcggatgaggggggcctccaggtattgtacacttttacctagaaggcatctatagtttctttcatcctactctcaaagctaagaactgccgttcaggattgtttacaagttgactcctggtggcaagaatcatttccgggtcctttcagcactttagtggcacttgacaaatgcatgtagatttaattaaattgcatttccttgttgcgttttctaatcagctctgacgtcagagtctggagaccagggctggtcctgccag

SEQ ID NO: 68776 - DNA, 601 bp, Human
tgaagatactcaaaaaatggctgtgaatggacaaaggaaacattgggacattcattttctcttctgtccccaacaccagggctgacctctgagctgtgccaggatgtcacccagtgtgtgtccataatgctctctgttctcctgcttactgccacccaggactgctgaaatccgtgtcctttaggggcagctcgagtgccaagccctctccggatctttccctgaccaccccttcttttagtggaggcccttccttctatactaccttgatcacgttgctttggttaacattagacatgtrcatgtctccccctatcccctgcattgagcagggggtcttcacaggggatcttcggatgaggggggcctccaggtattgtacacttttacctagaaggcatctatagtttctttcatcctactctcaaagctaagaactgccgttcaggattgtttacaagttgactcctggtggcaagaatcatttccgggtcctttcagcactttagtggcacttgacaaatgcatgtagatttaattaaattgcatttccttgttgcgttttctaatcagctctgacgtcagagtctggagaccaggg

SEQ ID NO: 68777 - DNA, 601 bp, Human
ttgtttttgtttttgtttttaatactaaagagtctcagattcaaatgcgatcgttgtctctcttaaagtcaaattagatgaaaatatcaggggtgatggaagaactagggtatgaggaagagtcaagctaggtccctgtgtcaggggtgatggaagaactagggtatatgggagaggcaagctgcatccctctgcctggggaacagagaagttgagcatatgtggaaggggctgcacatggcagtcatgaccttgacgtgaccgaagtcttgtgctgaggctgtgagctcctgggtctccycactctggaagctggggaacctgttgatcctgcaaggactcaccttgctcaacactgaactgctggagccattttcaaggctcagctcaagcttccctgagtccctgaagcccattttaatgtcctcctctttttagattccccgattcctaggcagacacagatcatgattttagaagcaggacagtgagctgattatttaagagtctttctccccagctaggctatgaatggctgtcagctgaaatgtttctttaatgtacctggtacagagtctgacacacatgaagatactcaaaa

SEQ ID NO: 68778 - DNA, 601 bp, Human
ggcatcagcggcctggcactgaaagacgtctgtgctctaaaatagcccccagtgcccggtcacagagccagccagcccatcatgcttgcaccattcctgtgcatttgaaaggtttttgtttttgtttttgtttttaatactaaagagtctcagattcaaatgcgatcgttgtctctcttaaagtcaaattagatgaaaatatcaggggtgatggaagaactagggtatgaggaagagtcaagctaggtccctgtgtcaggggtgatggaagaactagggtatatgggagaggcaagctgcrtccctctgcctggggaacagagaagttgagcatatgtggaaggggctgcacatggcagtcatgaccttgacgtgaccgaagtcttgtgctgaggctgtgagctcctgggtctcctcactctggaagctggggaacctgttgatcctgcaaggactcaccttgctcaacactgaactgctggagccattttcaaggctcagctcaagcttccctgagtccctgaagcccattttaatgtcctcctctttttagattccccgattcctaggcagacacagatcatgattttagaagcaggac

SEQ ID NO: 68779 - DNA, 601 bp, Human
ggtcccttctctctcctgttgtttttacccttgctaattcaaagactgatttccttgctcattaagacggcagcaaaccaagcaaggaggagccgggcctttcttctgccatctgagaacattctactagggatctctccttctaccagaactaaacaggcccggggaagcccctcaggctccttcagtatctcttcaggcagcagctgtttgagaccatctgtggcgcttctggcagggaggaagcctgggggcttgcctgggagacagacatgctcagggcaaagtggaaaggctggayccaatagccctgatccccagagaggcctaactgaccctgagagctgaggagttggactcctggggacaggatggctgtggccattcatgatggcatcagcggcctggcactgaaagacgtctgtgctctaaaatagcccccagtgcccggtcacagagccagccagcccatcatgcttgcaccattcctgtgcatttgaaaggtttttgtttttgtttttgtttttaatactaaagagtctcagattcaaatgcgatcgttgtctctcttaaagtcaaattagatgaaaatatcaggggt

SEQ ID NO: 68780 - DNA, 601 bp, Human
cctggggagagggccaggagaccatcttgactgcccgcccagcctggcaggtgaaggagtctattgtttaggtctaggggggcacaggaggggtttacagcttccacaggtcaactcctcaattcaccattatccatcagcttctctcattttttgttgaatcagatacgcaaaaccagttcaaatgcgaaacccttagggaagattacacctctaaagcttcagccactaagaaccttagcgaatagccaatacccttcattgtctagacctcaatcccaggagggcctgtgggatgggyacaggctgaagaggcaggagggtggctggggtagctcatctgggatgtttatacctccagagggggactagactcgaagactctgtaatcccatgggccttgaggggaagaagcggagggagaaagaggactacaaataattgatgcgcatgggtgatggtgctgcagaggaccctcccacacagggctcagctgaacttgacctgcttcataacagaactgagcactggtcctgttaggtcatcacgtgcagggtaagtgacctcacctttaggtacaagagaaaaaggatctcttccc

SEQ ID NO: 68781 - DNA, 601 bp, Human
aaacccttgggaccagcgtggcagaggacctcagctgctgtgtcctggacccctggggagagggccaggagaccatcttgactgcccgcccagcctggcaggtgaaggagtctattgtttaggtctaggggggcacaggaggggtttacagcttccacaggtcaactcctcaattcaccattatccatcagcttctctcattttttgttgaatcagatacgcaaaaccagttcaaatgcgaaacccttagggaagattacacctctaaagcttcagccactaagaaccttagcgaatagcyaatacccttcattgtctagacctcaatcccaggagggcctgtgggatgggcacaggctgaagaggcaggagggtggctggggtagctcatctgggatgtttatacctccagagggggactagactcgaagactctgtaatcccatgggccttgaggggaagaagcggagggagaaagaggactacaaataattgatgcgcatgggtgatggtgctgcagaggaccctcccacacagggctcagctgaacttgacctgcttcataacagaactgagcactggtcctgttaggtcatcacgt

SEQ ID NO: 68782 - DNA, 601 bp, Human
ccggcagctggggtgagcagaaggagccgcggggacctgggcgtgctacactgactgctcattccccatcagagttggttgcctcctgtcagaggccctgggaaagaggcccaggagtgggcactagggcacagcctgaggatatggggccaggcttaggaggacccgaatgaaccagaaatgattcctgccaccaggagacaactcgcaaacccttgggaccagcgtggcagaggacctcagctgctgtgtcctggacccctggggagagggccaggagaccatcttgactgcccgcccrgcctggcaggtgaaggagtctattgtttaggtctaggggggcacaggaggggtttacagcttccacaggtcaactcctcaattcaccattatccatcagcttctctcattttttgttgaatcagatacgcaaaaccagttcaaatgcgaaacccttagggaagattacacctctaaagcttcagccactaagaaccttagcgaatagccaatacccttcattgtctagacctcaatcccaggagggcctgtgggatgggcacaggctgaagaggcaggagggtggctggggtagctcatc

SEQ ID NO: 68783 - DNA, 601 bp, Human
tttagagggtggattatgctttttcactaatggcttggagtcttagaaggcttgtttcaacaagcttgaagtggacctgaggaagggatgaatggccaggaggcttaaatggggtgtgggcaggaaaggcccagaaacagcccctctgcctttctgtggaggaggggccctcaccatgtgcggtgctggaatccggcagctggggtgagcagaaggagccgcggggacctgggcgtgctacactgactgctcattccccatcagagttggttgcctcctgtcagaggccctgggaaagagrcccaggagtgggcactagggcacagcctgaggatatggggccaggcttaggaggacccgaatgaaccagaaatgattcctgccaccaggagacaactcgcaaacccttgggaccagcgtggcagaggacctcagctgctgtgtcctggacccctggggagagggccaggagaccatcttgactgcccgcccagcctggcaggtgaaggagtctattgtttaggtctaggggggcacaggaggggtttacagcttccacaggtcaactcctcaattcaccattatccatcagcttctctca

SEQ ID NO: 68784 - DNA, 601 bp, Human
ccaaactcccgagagtccacgtcagagtggctgtagaggggtgaggctctgttcccaggagccccttctaaggcacatacaccatttagagggtggattatgctttttcactaatggcttggagtcttagaaggcttgtttcaacaagcttgaagtggacctgaggaagggatgaatggccaggaggcttaaatggggtgtgggcaggaaaggcccagaaacagcccctctgcctttctgtggaggaggggccctcaccatgtgcggtgctggaatccggcagctggggtgagcagaaggrgccgcggggacctgggcgtgctacactgactgctcattccccatcagagttggttgcctcctgtcagaggccctgggaaagaggcccaggagtgggcactagggcacagcctgaggatatggggccaggcttaggaggacccgaatgaaccagaaatgattcctgccaccaggagacaactcgcaaacccttgggaccagcgtggcagaggacctcagctgctgtgtcctggacccctggggagagggccaggagaccatcttgactgcccgcccagcctggcaggtgaaggagtctatt

SEQ ID NO: 68785 - DNA, 601 bp, Human
ggagcaggtgaacaactgagaagagggggtgagtacatagtagggttaggaaaggcttttaagaaaatcttacttgatttattagtaagtctcaaaacgaacacttccagttccaagccttgattcgatttcacaaatattcttcagacatctactaagacaagctcagacaggtcaaatgatttttctgagcccacatgccagacagtgcttccctcttgcccagcagtcacggaattaggataccaggtgccagtaattcttccttctagctctttttggcttttgtgaggcaagacgrtggagccaggtggaggtagtcgctggtggtgctgtgggctggtgtgatgggagacccctagaggacaccgaggctgtcctcccccgccaaactcccgagagtccacgtcagagtggctgtagaggggtgaggctctgttcccaggagccccttctaaggcacatacaccatttagagggtggattatgctttttcactaatggcttggagtcttagaaggcttgtttcaacaagcttgaagtggacctgaggaagggatgaatggccaggaggcttaaatggggtgtgggcaggaaaggc

SEQ ID NO: 68786 - DNA, 601 bp, Human
gtcacgttcgtcattgcggtagcatgtgagaagtgctctgatggagtcagggaccggttattttggcagtcccaggagcaggtgaacaactgagaagagggggtgagtacatagtagggttaggaaaggcttttaagaaaatcttacttgatttattagtaagtctcaaaacgaacacttccagttccaagccttgattcgatttcacaaatattcttcagacatctactaagacaagctcagacaggtcaaatgatttttctgagcccacatgccagacagtgcttccctcttgcccagyagtcacggaattaggataccaggtgccagtaattcttccttctagctctttttggcttttgtgaggcaagacggtggagccaggtggaggtagtcgctggtggtgctgtgggctggtgtgatgggagacccctagaggacaccgaggctgtcctcccccgccaaactcccgagagtccacgtcagagtggctgtagaggggtgaggctctgttcccaggagccccttctaaggcacatacaccatttagagggtggattatgctttttcactaatggcttggagtcttagaaggcttgtt

SEQ ID NO: 68787 - DNA, 601 bp, Human
gtgtgtgaccatatctctcaaagccctgtgttccggccagtccatgtcccaagccagggttggaccacagccccggcagtgaaggcagcatggtctagggcagtgctgctcagccggggcaggtttgtgccctaggtgatatttgcttgttacagctgggggtagtggtgggggtgctactggtgtctagtgagtcgaggccagagatgctgctaaccatcctacaatgcaccagatggtcccttacggcagagttatccagcccaagatgtcactaggacagaggtggaggatccctggygtggtggtgagagcaggaaggagttctggagtcagaggcttctgagttccacttccagctcagagcttctagctgtgtgaccctgggcaagttcttctctctctctctctctctctctctctctctctctctctctctgaaccttgagttcctcagctgtaaaatagttctgttgtgaaaatcagcatttttaattcttagcagggcacttggcagccagtgagtacttggtacatggtagctcttctcgttcatgaatccatctgtaagcatctccccagtggtcgggagtcgaagaat

SEQ ID NO: 68788 - DNA, 601 bp, Human
cttggccaggcgatcgcttacagtctcccacctcatcccattttaaccctgacagcagctgcagtcttgggcctgcagtgggaggccctttcctgagagtgaatttgttgtggccagggagagtcttctgaggatggggacactgtgaggagtagacaggttaaggccactgaagcaagccttagtatgtcacaatctcttcccagctggggaagcccagacattttgagtttagaaaaatctagaagggtggggcaaaaaaagagaagggaccaaatccttaataggggaagtcaggcaygtgggcccagctggcaaacaaacagtgggcattcccgggaagagctgtgtcccccgctctgcaggcctcgcactggcttcctgttttatagcctcctttcctatgtggggccacctgggctcccaccagatattaccagggtgtgcctgggtggccttgcacgaggggaccttccccacaagctgattttcctggcgttctgtgtagacatgaggtctcaggcttggcagctgtcagaaggtctgaggccacgctgtgccttcccaaaggacgttgtagccctagcacctgcagtgtgtg

SEQ ID NO: 68789 - DNA, 601 bp, Human
acacttggccaggcgatcgcttacagtctcccacctcatcccattttaaccctgacagcagctgcagtcttgggcctgcagtgggaggccctttcctgagagtgaatttgttgtggccagggagagtcttctgaggatggggacactgtgaggagtagacaggttaaggccactgaagcaagccttagtatgtcacaatctcttcccagctggggaagcccagacattttgagtttagaaaaatctagaagggtggggcaaaaaaagagaagggaccaaatccttaataggggaagtcagrcacgtgggcccagctggcaaacaaacagtgggcattcccgggaagagctgtgtcccccgctctgcaggcctcgcactggcttcctgttttatagcctcctttcctatgtggggccacctgggctcccaccagatattaccagggtgtgcctgggtggccttgcacgaggggaccttccccacaagctgattttcctggcgttctgtgtagacatgaggtctcaggcttggcagctgtcagaaggtctgaggccacgctgtgccttcccaaaggacgttgtagccctagcacctgcagtgt

SEQ ID NO: 68790 - DNA, 601 bp, Human
aggcagtgactgtggctaaggcatgacagctgggcctcatgagtgtccatcagccaagctctaccctatcagggtcttctgggaggggaagcagggtggctttgctgggccagggggatattcatcctgctgagctctcactcagatatgttcagctccctgttgccaacatgaaaaactcaaacgtcttaatctggcattcgaggcctcctgctacagtctatcccaaccttccctctcctccatgttcccacttctgccccctgctccagccacactcatctacttcttgggtcctgarataacctggtatttcccacatgttcctccttttcttggcccttcttggcttatttgaaatggcccctgcggtggagacctggtgtaggctccagctcctacacagtaggtcccgagtgtaccagctcgctggaccatggccaaccacttcgtttctctgactcacttggaattaacctcatgggccctgggacaccctgatgtgatctgccttgctgtttaatgcctcgaggcacctgcaccttgcaccccttctttggtttcctcacttccagcacagggctgtacacttgggaggaaa

SEQ ID NO: 68791 - DNA, 601 bp, Human
cctaggggcagctggggaggcctggaagaggcaggacccaggaagggggtttggagggtagggagaactcactgcaccccagcccctgctggagaaaataaaggaagccaggtgggactgctaaaagactaacttgaaatgcacacatccctccttcacctgctcatgagcacagcagagggcaatggggagtagggcagactctagcctcacttcagttaatactggggagactttgttttggttccccaccaatcttcactcttggagactaaccagggttctctttattaccacaaaygcctgctaagtggctcactgaggactagagtgtgagccgtaaatgtggaaggagttggtctgcttcagatatttacatggggtctcagggattcttgcagccccaaagctttgcagactcaaaggtggaagctcctaggctcttgtcagccccatacatacagcatgccaaagagaaagaaaaggaaccccaggggctcttttggaaaggctgccaatccccgctcccggtatggctgtgcctgatcactgtgaatctcaagtcgcccacccagtacccaggaagcaaatgtgcagcaac

SEQ ID NO: 68792 - DNA, 601 bp, Human
gtggcattgttaaggtgatggcaggctgagtgatttttttttccttgttttataaatgttctttatgttattatatttatgatgaaaaatatctcatcaacatatatgaaaaaatactcaaggtctttttttttttttggctcaaaaagcagcaaacatatggtaaaataaatgggtgtttaggaagcatgaaaatgaggccctgaagaaaggaagcaagaagtcagagcgctttggaggaaagaaatctctgtactagataaacattcctccacgccaggggagaaggaaaggtccttcyagatggtaaaaacacgctcaacttgcccctgcgagtgttatagcttgaaaagctgaagtggaagacatgcttgagtagccataacttttaggacaaattctaagagcgggggcttttggacaggacttcaatttatattgaatttacactgattccaccaaaaggaaatgtgtaagcaagatgggataagaacagggtgggtctagctgagggcagttaaagacaagagacaaagatcctgaagcctatctttaaaacccctggattcattgtgactttcaggagagcccaggaggtggg

SEQ ID NO: 68793 - DNA, 601 bp, Human
gctggaaccaacacagtggacacctttacacaccttgcaagcccaggctgctgttgctgccaccaccaccaccaccaacaaggacctaagagcccccacatgcagcacagaccttcgaagagacagaccctgctcctgtacactagctgggctgcacacgcacaggccctggcttcccagtgctgcctagagggctggggcaccaccgggactgttgggcagcagatgctctggccatgacaaatgagggatctgagggagccacaagtctgctgctgccccttcttcccctacaatgggatgttttacgccacacgggaaatgctgagacactgagcaaagagcagcacgcgtggtgaggacaggctggctcgctcggcatcggtgctctcttccggcttcacttctgcttctaggattgctcccactcccaaagcattcacagaggcttttgcctcaggctgttttctagggaacctggaggaagacatttcccccttgggttgtagtattcttgtgaacaggagcctgtcctttcctttattctccctgtgaagttatatatttctgttcaatgcctttttaaagttgtaggcaaata

SEQ ID NO: 68794 - DNA, 601 bp, Human
tgatctttgcaatgggggattgtgaggatcagaggaggtgagaatgtcctttgacagtgtagagtgctgtgtcaacatagtgggttacatctgaagttctcaaacttgacttcccattggaatcacttggggagtttaaaaaaaattactgctgcccaggtccctccacagaattctgcttaatgggtgtgggtaaagcctgggcaatgacattttaaaagctcccctggtgatcctaatgggcagtcatgtttgagaactatggggcttgaccatagtcttcccagagggctctcgcccrcaatttcatcagtatttaggtagcacataggtgtagacttcaaaagctagagcttgatccaatcatttctgtgagaccgattctcttgaggggtgtgtgtgcacatgtgtatcttgcttcctgtagagaagtttatatgttactttaaagacctgctaggttctgtgtacctcctccccgggccttggtcatctgccatgctttcttggctggaaccaacacagtggacacctttacacaccttgcaagcccaggctgctgttgctgccaccaccaccaccaccaacaaggacctaagag

SEQ ID NO: 68795 - DNA, 601 bp, Human
tgccaatactctgttcttcttagcataaaggtgaacagcacccctgcactgtagcgtgaaagagtggatttgagtcttggctccacgggctcctcattggaccttggcaggtcacatgatctttgcaatgggggattgtgaggatcagaggaggtgagaatgtcctttgacagtgtagagtgctgtgtcaacatagtgggttacatctgaagttctcaaacttgacttcccattggaatcacttggggagtttaaaaaaaattactgctgcccaggtccctccacagaattctgcttaatkggtgtgggtaaagcctgggcaatgacattttaaaagctcccctggtgatcctaatgggcagtcatgtttgagaactatggggcttgaccatagtcttcccagagggctctcgcccgcaatttcatcagtatttaggtagcacataggtgtagacttcaaaagctagagcttgatccaatcatttctgtgagaccgattctcttgaggggtgtgtgtgcacatgtgtatcttgcttcctgtagagaagtttatatgttactttaaagacctgctaggttctgtgtacctcctccccgggcc

SEQ ID NO: 68796 - DNA, 601 bp, Human
tgtgaacgttccatggaccacacttcgaagagcgaggcgttaaagcaccccaggtgattccaacgtgcagccagcatccatctaacccccacactaccccatccaggtaaccaaggaaatacaaatttacccttataccggcctaagtcaaatgtaattaggaacggaaacctattgcctctcccaaccatgaatgtatataaaaagaaatagaagtagagtggcttagaggtttcatagcttcaacatgatgatctgtgccaatactctgttcttcttagcataaaggtgaacagcaccyctgcactgtagcgtgaaagagtggatttgagtcttggctccacgggctcctcattggaccttggcaggtcacatgatctttgcaatgggggattgtgaggatcagaggaggtgagaatgtcctttgacagtgtagagtgctgtgtcaacatagtgggttacatctgaagttctcaaacttgacttcccattggaatcacttggggagtttaaaaaaaattactgctgcccaggtccctccacagaattctgcttaatgggtgtgggtaaagcctgggcaatgacattttaaaagctcccc

SEQ ID NO: 68797 - DNA, 601 bp, Human
cgtttgggaaaggaacttagttcaggataggggctttacggcattctagcaccaaagttcatcctggtgagttcaagtctcaaagaaaaaacagccagctcccactcagcatactgtttaagaagtttgagaactatataatgaccttcagaagaatttctatctggctgattaaaataaataatttaatgtaataagcaactgttacactcaataatatgggatggctcacttccccaacaggccagatattatggtattagaacagcgctgggcatttagtagaggcaaagtaagactytgtagaatgatgggaagaatgtgtctcacttgctgggggctagaaatccagataaatcagagttttagaaacttagctgctctacaaagttttcagctctgtttctcaccttttctttataaggtgagaaaggggtttacctgaagctgcatcctgcctttcctatttccctgccttggtgatgctgtcagctctcccggaataaaagcccatcctccctgtctctgcatgtctgaatcctgcctagcctttaaagtctggccaaaggctccctcctccaggaaggccctctgacctatc

SEQ ID NO: 68798 - DNA, 601 bp, Human
agcccaaaccaggggagaggaaacaggtgtcacaaagtcatgtgtatcttaaattcattaacttttcttgaaggagagctctctggccctcagtcagatccacacgctcttgctttaggcatggatctacccatctcgcccctcagctccccaccgcaaggtggatctgccgactgcaatggtagccagcgaagccatatccaggggtcaccgtggagccgtttgggaaaggaacttagttcaggataggggctttacggcattctagcaccaaagttcatcctggtgagttcaagtctcraagaaaaaacagccagctcccactcagcatactgtttaagaagtttgagaactatataatgaccttcagaagaatttctatctggctgattaaaataaataatttaatgtaataagcaactgttacactcaataatatgggatggctcacttccccaacaggccagatattatggtattagaacagcgctgggcatttagtagaggcaaagtaagactctgtagaatgatgggaagaatgtgtctcacttgctgggggctagaaatccagataaatcagagttttagaaacttagctgct

SEQ ID NO: 68799 - DNA, 601 bp, Human
gacagagggagataccatttcaaaaaaaaaaaaaagaaagtaggggttaagtgagaagttcagtgtggggcatgttgagtttgaagtgcctgtggcccacccagggcgaggacctcagcaggcagatggatattcaagcctggagctgaggggcagtaactgtcactaccgacaacacagcccaaaccaggggagaggaaacaggtgtcacaaagtcatgtgtatcttaaattcattaacttttcttgaaggagagctctctggccctcagtcagatccacacgctcttgctttaggcatkgatctacccatctcgcccctcagctccccaccgcaaggtggatctgccgactgcaatggtagccagcgaagccatatccaggggtcaccgtggagccgtttgggaaaggaacttagttcaggataggggctttacggcattctagcaccaaagttcatcctggtgagttcaagtctcaaagaaaaaacagccagctcccactcagcatactgtttaagaagtttgagaactatataatgaccttcagaagaatttctatctggctgattaaaataaataatttaatgtaataagcaactg

SEQ ID NO: 68800 - DNA, 601 bp, Human
tgggtgacagagggagataccatttcaaaaaaaaaaaaaagaaagtaggggttaagtgagaagttcagtgtggggcatgttgagtttgaagtgcctgtggcccacccagggcgaggacctcagcaggcagatggatattcaagcctggagctgaggggcagtaactgtcactaccgacaacacagcccaaaccaggggagaggaaacaggtgtcacaaagtcatgtgtatcttaaattcattaacttttcttgaaggagagctctctggccctcagtcagatccacacgctcttgctttargcatggatctacccatctcgcccctcagctccccaccgcaaggtggatctgccgactgcaatggtagccagcgaagccatatccaggggtcaccgtggagccgtttgggaaaggaacttagttcaggataggggctttacggcattctagcaccaaagttcatcctggtgagttcaagtctcaaagaaaaaacagccagctcccactcagcatactgtttaagaagtttgagaactatataatgaccttcagaagaatttctatctggctgattaaaataaataatttaatgtaataagc

SEQ ID NO: 68801 - DNA, 601 bp, Human
ctatttctctttattatctatgtcatggtatatatgttttctatctaaatcatctcatagttggatcaaagttgagcataaattattggaaaatatgttacataaattaagaatatgatattgttcattattttcccttgtatgttcgtttgtctcttccaggggattgtaggtcccctgctcaccctcggctggtgtccctggcatctttccatcagaaggattggaaagcccaaggtgttcagccagcgggcctagaggtcacctcatctgggggctgaaggacaagcacccagaactscagagactcctgtctctacctttcatctattttgtaatgtgggctccgaagaaagggtttctttttttttttttttttaacaaaatttgaaattagattagactagtagtttcatattacagaagagactttcctgaggttatgcaggagttggtggcagagcctgggctagaacgcaggctccaagtgcaatgtttgatccatgctgcctgtgaggaggatgtccaggaaataatccagggccccaggagccccagagcctctggcagtgaaggggaaggggcgagggtgggggtggaa

SEQ ID NO: 68802 - DNA, 601 bp, Human
agggtattcctccctgtgttcccaaagggctcagactcccctagtgccggtggttctcagccctggctgcacactgaagtcactgagggagctttaaaagcctcccgatgccaggcccaaccccagagcaaatcagttaggatctccagaggaggagtctgggggcaggctttttaaagctctcctgtgatttttttttttatttaattactttatatatttttgtagagatggggtctcactatgttgcccaggctggcctcaaactcctgggctcaagtgatcctcccacctcagcctmccaaagtgctaggattacaggcatgagccactgcatccagctttcttgtgattccaacatgtagccaggagcccacctggccttccttttcctctgtgccaggcagaggcagtctgggcaggtcgctgaggtcttaccttctggatcaagctggcaaactgcaggtttgctgactgcgagatatttaggaccgtgctgtaggcgttctcgcccctgttctccagtgtggcctccaccgccactcgctggcgtgtgctctctatgatgaagactgtggtgtcgaaggacagcgtgtatgcg

SEQ ID NO: 68803 - DNA, 601 bp, Human
aaggaccttccgagcaagcctgcagggtgcactgttggtagaacgtgtggatggctggtggcacatgcgtggtgtgtgtgcccctaaccagggcccaggagtcgggctgaagggtattcctccctgtgttcccaaagggctcagactcccctagtgccggtggttctcagccctggctgcacactgaagtcactgagggagctttaaaagcctcccgatgccaggcccaaccccagagcaaatcagttaggatctccagaggaggagtctgggggcaggctttttaaagctctcctgtgatttttttttttatttaattactttatatatttttgtagagatggggtctcactatgttgcccaggctggcctcaaactcctgggctcaagtgatcctcccacctcagcctcccaaagtgctaggattacaggcatgagccactgcatccagctttcttgtgattccaacatgtagccaggagcccacctggccttccttttcctctgtgccaggcagaggcagtctgggcaggtcgctgaggtcttaccttctggatcaagctggcaaactgcaggtttgctgactgcgagatatttagga

SEQ ID NO: 68804 - DNA, 601 bp, Human
aggtggcccgtggcacagttagaggagaagtggcaggaggtgggtgagatgggccttgaatgccacaatgaggagcctggagtttgttctgacagcagctgggagtgatcagaagttttaacctggggaagaaccggttctgattcttgtcagaaggaccttccgagcaagcctgcagggtgcactgttggtagaacgtgtggatggctggtggcacatgcgtggtgtgtgtgcccctaaccagggcccaggagtcgggctgaagggtattcctccctgtgttcccaaagggctcagactmccctagtgccggtggttctcagccctggctgcacactgaagtcactgagggagctttaaaagcctcccgatgccaggcccaaccccagagcaaatcagttaggatctccagaggaggagtctgggggcaggctttttaaagctctcctgtgatttttttttttatttaattactttatatatttttgtagagatggggtctcactatgttgcccaggctggcctcaaactcctgggctcaagtgatcctcccacctcagcctcccaaagtgctaggattacaggcatgagccactgcatc

SEQ ID NO: 68805 - DNA, 601 bp, Human
cattgatgtctgagtttactcaacaaacttgtcttgagggccttctatgtgcccagctctggacacagacatggctaagacagggctcttgccacctgggagtcaagggtttcaagaggccagcacttggagactgatgtttcttcagagcacatgaagggctgtaccagatgctatgcgggctggagggccgcctgtggccttggagagctttgggaaagataccccagagagcagggctgaggactatgctttgtcacatagcgcaggctcaggcgccagctgtggggtgggaattccrctctgcggctcaccagctgtgtggtcctgggcaggccttaacccctccctatgcctcagtttcctcctctgtaaaatggggacaccaccaccaccactaccaccactactgctatgtctgaggttgctgcaagggttaaatgcatgccaagtgctagcacagcgctggacgccgtgagtaggcaatatgtggatggtcaccaagtgggagcaggagcctgttgggcagaggagagaggagtcccaggtgggggccatggtgggaaccagcagggcgtgctgggaacaaggtggcccgtgg

SEQ ID NO: 68806 - DNA, 601 bp, Human
ttggggaggggtgctgggcagtggttctggggtggagaggacagactggcctggcacctgtcttgcctggcacactgggttccacattgacactgagatcctcgaggacagaggctgtgtctgagggccctaggacccccgcaacacccacacatgacattgatgtctgagtttactcaacaaacttgtcttgagggccttctatgtgcccagctctggacacagacatggctaagacagggctcttgccacctgggagtcaagggtttcaagaggccagcacttggagactgatgtttcytcagagcacatgaagggctgtaccagatgctatgcgggctggagggccgcctgtggccttggagagctttgggaaagataccccagagagcagggctgaggactatgctttgtcacatagcgcaggctcaggcgccagctgtggggtgggaattccgctctgcggctcaccagctgtgtggtcctgggcaggccttaacccctccctatgcctcagtttcctcctctgtaaaatggggacaccaccaccaccactaccaccactactgctatgtctgaggttgctgcaagggttaaatgc

SEQ ID NO: 68807 - DNA, 601 bp, Human
ggtgtggggcttgattccctccgtatacctgaaatccagacagacacaagtccctggacaggaggggacttcgagagaccatcaggtgggctcttcatcatcagcctgggctgtcactctgggcagtggagagggagtgggattggggcccaggcctgggcctgacagaaggaactgtggctgcagataggccttgaggtctgtttgaggatgggggagcccactgaggaggaagggggtacccgagtaggcagctcctcgctttcctggggtggcctccctccactcagcttcccctccyggctataggaactgctcctgtgtgtgtggcaagcaaggggggggcacttggggaggggtgctgggcagtggttctggggtggagaggacagactggcctggcacctgtcttgcctggcacactgggttccacattgacactgagatcctcgaggacagaggctgtgtctgagggccctaggacccccgcaacacccacacatgacattgatgtctgagtttactcaacaaacttgtcttgagggccttctatgtgcccagctctggacacagacatggctaagacagggctcttgccacc

SEQ ID NO: 68808 - DNA, 601 bp, Human
tgtcagtgcatgtgtgtgcatgtacctgctgcatgtacacagagcatgtgcatttcccaggacaaatatgtaggctgctgtgtttttgcatgtgtgtgcaaaaagtgtgtgatcagactaacacatctgcatttggctgagaggggtgctttctctactagagttccccttggctggatgttggggagagagaggagaggaatgctgacctcacagccatgagcgtttcctgggttggggatgggtggtggcacctgtgaaggaggtaggctccaggctaactctgcaccccacctgctaygtgtggggacacagcacttcacagaacatgtctcccacttctctttacctccactcatttccaaaagctcttctgagccacagaaactatctccatgattccctccccaggattaggagcaagcatgagactggccttgtgaagtctgggccagggaagcaggggaaggcggatgctggtgtggggcttgattccctccgtatacctgaaatccagacagacacaagtccctggacaggaggggacttcgagagaccatcaggtgggctcttcatcatcagcctgggctgtcactctggg

SEQ ID NO: 68809 - DNA, 601 bp, Human
ttgtcatcactcgtatgtggcagctacagttatgatgattatttgtccctgctgtgttctctgcactgttgggcattacctgggcacatggctgtgtatgtctctgggcatgcatgcacccgtgtggatgtgagcatgtgtctgtggagactctgtgtgtgtctgcgtgtcagtgcatgtgtgtgcatgtacctgctgcatgtacacagagcatgtgcatttcccaggacaaatatgtaggctgctgtgtttttgcatgtgtgtgcaaaaagtgtgtgatcagactaacacatctgcattkggctgagaggggtgctttctctactagagttccccttggctggatgttggggagagagaggagaggaatgctgacctcacagccatgagcgtttcctgggttggggatgggtggtggcacctgtgaaggaggtaggctccaggctaactctgcaccccacctgctatgtgtggggacacagcacttcacagaacatgtctcccacttctctttacctccactcatttccaaaagctcttctgagccacagaaactatctccatgattccctccccaggattaggagcaagcatgagactg

SEQ ID NO: 68810 - DNA, 601 bp, Human
tggggcagcggactcagtgtcgggaggagcagttgctagcagccagagagctgggccccggaatagcaagctttggggagaaggagcaggcacggccctgacctgcctgcagcgagctcgatctccaggtggtgtaggaagatggatttgctgaactcaaaatcaagacggaaagccacctgcaaggaagcagtcgcatgtctgggcattgctgggaccagccccgcccactccccacagcccactccccacagccccctgctggcttggggagagggagcttgctgggggttggggagcwgctggctgggaacaggctgggaaagggaggaccaggtgctacagaacatgagctgagcttcagggctgctgtggggacacagccaaagacaacagctcccacaatggggtttctcggggctgagccagcccccctccctcttcctcttcttttgtttttagcaaaaggcaaccagaaagcagcaagtccagctccagactctgtctgcagggtttttagggtaggggtccttgatggcaggaagggccgatggccatcgccatgcaccacaggatgtgggggccagaaacgtttggtagg

SEQ ID NO: 68811 - DNA, 601 bp, Human
ctaggagaggaagggccagaagcagggatggatgacactagctctacctgctgcccctttaggtggagtcaggggagggctctgggctggacctgggaggcctgtgcctggcctggcacggactggaccccagcctgtttgcctccctcacccagatgccccgtctgtcaggcgggccaatcctgctgcctgctggactcaggggctgtgggagatgacacctgtggcaaaggctgtgcccacggaggagggatggtgaggaattcacagtagagtcattcatttatccctggactgaccrggggcagctcctacagggcggccaggggcactctgctgccacaagaaggctgggagtgaaattcagagacatcttccgggggggttctgtccagtgtgcctccctttatatctgagcaccatgaactaccggggcaaatcattttagacataaaaatgtacagttcttgcttgttatatagactgagtttgattccctttggaagccttaccccaggataggggtttggttagaaaagggagacccaacacacacagatgtgcctccagagccccctcctacacacacctaattctcaga

SEQ ID NO: 68812 - DNA, 601 bp, Human
aagagggagagggcatgtgccggcctcccccgggccacgaaaaacaggttcccgcttgtgtcggctgggagtgagtgtcatgttggaaggattctgagcctttgcaggaatcagcgctgccatgggtgagcaatgtctgcctcctgagtgggtgggcgtgagtcagaagagccagttatctcatccctgccccagcgtctctgcctaggagtgtagctacttttcggagtgaccatgccactgtgctcccttccaccctctagggatggctggcgtgggagggcctgagcttcctctccgyatctgctgttctgccctgacttctccatctgcccatgagctctcagaggacaggggctgtttcctccatcagattgggggccagtagcatgccaagggggtgggggtgggagcagtctgtcctttggggaagagtcttttcccactgacattgtttagatgtgctggcataatatgataacaaaaagcagattgacttacgatagatattatttctgtttttaaattctctacagaccatgcatccacttgttgcctatgccaggggtggacgcctcccactgcccccaccctcccttct

SEQ ID NO: 68813 - DNA, 601 bp, Human
gacccactcctgaatgactttgtgaagctgccaactctgggcttcttttatgggagagagtaaaccctagtgtgtttaaaccactgtttaaaaaaaatttaagaattttaggcaaccacaccctatcttcacccatacatcccccactgcagtccagttgtttttcaaaagaagactgagaggcccagagaggagaagtgacttgactaaagtcgcacagtgggtgggtggcagggttgaggctggactccgggcactagcgatgattccacattcctcccctccaggatgggggtgctcmgatcccgtccttccccctctacccggctcccctccagcctcaccctgaagatgcagctgaagggaggcccgataccatcgtatctctccagcgagctgttgagcttgacctcgtagtggctcaggctgctgctcctgcggagacagaggacagggctgtcgtgagctcagtcagggctggctggatggacagatgaatgaaagagggagagggcatgtgccggcctcccccgggccacgaaaaacaggttcccgcttgtgtcggctgggagtgagtgtcatgttggaaggattctgagcc

SEQ ID NO: 68814 - DNA, 601 bp, Human
cattcttaaatgactaagagtcctgggaatgtaaccatgtcaatacagtccttttttttttttttttttttttgagacagagtcttgctctgttgcccaggctggagtacagtggcgccaacttggctcattgcaacgtctgcctcccaggttcaagagattctcttgcccagcccgagtcgctgggactacagacgcccaccaccacacccggctgatttttgtatgtttagtagagatgaggtttcactatgctggccaggctggtctcgagctcctgacctcaagctcctgacttcaygatccacctgcctcggcctcccaaagtgctgggattacaggcatgagccaccgtgcacggcctaatgcagttttgtttacattattagctgaggaataatggttgccctttaaagattttttttaagattagcaaaccaaaagaagttagaaggagccaaatcaggactggaaggcggacgcctaatgattttgaaatcccctcatgtgtgaagcctagggcaatgatcatatttaacaatcaaaataaaaataaattcctttaagtaatcatgattaaggtaatcctgattattctgtc

SEQ ID NO: 68815 - DNA, 601 bp, Human
agaacattttgcttgttgactttctggagggccaaagaatgagaacatctggttattatgacagtgttgtgagaaagttaatcaaagctttagcagaaaaatggctgggaaaatgtcaccagagactccttctccaccatgacaatgctcctgctcgctcctctcaaagggacttcaaaaagtttgtggaaaaatggaattaaaaggtaaaaattaaaaattaaattttacttctcaacataagcccatcaagttcaagacacttttgtaagcaatgataccaaccatgtagtccattctyaaatgactaagagtcctgggaatgtaaccatgtcaatacagtccttttttttttttttttttttttgagacagagtcttgctctgttgcccaggctggagtacagtggcgccaacttggctcattgcaacgtctgcctcccaggttcaagagattctcttgcccagcccgagtcgctgggactacagacgcccaccaccacacccggctgatttttgtatgtttagtagagatgaggtttcactatgctggccaggctggtctcgagctcctgacctcaagctcctgacttcacgatcca

SEQ ID NO: 68816 - DNA, 601 bp, Human
cccttatcaccagttgataacgtttatatttatgtttattgcctgcctggaatgtcagctgtaggagagtgggggctttgtctgttttgtccctgctctatcctcagaacctggagccgtgccgggaatgtagcaggagctcagctaacacgtggagtgaatggaccacctgcaacagcagacagagccatgtggagtgaatggaccacctgcaacagcagacagagccctcctttggccactgactcactgttcaacttgaggcaagtcactgtccctcctgcctcatctcacatgcctyggtgtgcatacctgagagatgggggtggggacagtgcctcacagtgttgagaggtctgtcaccatgttcagcacacagctgggggccagcaaatggcagggcccttatgtgtgctctttctgtccctcaaggcgggcacctggctctgcctccccagcgccagcacctagcacacagcccagcatacaggggcttaattttggggttgctggatttctaaaagagaaatgaggcatggccgggcacggtggctcatgcctgtaatcccagcactttgggaagccgaggcgggcagatcat

SEQ ID NO: 68817 - DNA, 601 bp, Human
aggacagggtgggcaaggcctgccccagctttccctccactacctttccttgggattcctccctcagggcttccttgagtacccccagctcattctgagcaccccctcctccagaactgcctctgtggactggaacacagtggatgagaccatgggctgcatgcaagaagtcatactagtgcccatcttgctgtgtgaccagccccagccaacatccctctctgggcctccttcatctgtaacaggaggaggctgagaccaggggtttgtaaccagagcttcagagacagagatggacttygggaggtttgttaacagcttgacattgtgggagaaattttgtgcagttgtttgtacttgctttttttttttttctctaataataggaaccttagttttcatcaggttctcaaaggcatccacaaacaggttagagccatagtctgagtgccgtctgttggccctaaccagtgtgtctgctatggcgaggggtggggtgccagctcccctggagaggagaacgtggcagcggccacgaagttccaggggctggagcctgggcccaccagccaggatgctgctccttccctcccctgccagg

SEQ ID NO: 68818 - DNA, 601 bp, Human
cctcaccttccccctcctcaggggtaagctttcgctcgagcctcgcgattcccacccgtgtaagtttcctccggccgtgctcccgccgctgcccaatcaataacggcggctagcgggcaaactcccatcctagagctgcgtgtttgccatgcccgcataaacgtggacccagccagtacccaccacgggcgccagctccgggcagctcgcgtcctgacaaagtttcccgtgcccatttattaagcaggcgccgaatggctgccgacaagcccagcactgagaaagacgggccgggggttckagctggggggcaccagggcccaaaggctggcatcttggggaagccggaaggagctggggcgagggggcaccgggacgtagcctttgggcaacttgcaccagcgatcgctggaggcagggagacgcggggattatctgtgccttagcacgttcgaaaatccctccccctccttctaatttatcctcccttcggaaggaaaggaagaaacatcagcatctggcccgaaggtggggtggaaagagtgagggagaaagaggaggagaggaagggaggcagagaaagggagggagggagagaaag

SEQ ID NO: 68819 - DNA, 601 bp, Human
gtacaattttttttttgtaacgagatctgttaacgagacaagtggatttcttattttttgggagaataacatttcaagtcattgggattcaaagagtgttccataccatcaaattgactgcaacgtttatatgtacaaataattcttagctcatgactgtacaaaaattgggagctcagttatagtttggtgattgctgtggtactcctgtgattggggtggagcccaggaatctgcattttacatgcctctcacatgattctggtaatgggccatggacccaatggactatccaatcctsggaatctctgtccaccaaaggggcctgtggttttgcagtgcgagaacccggctgtgccacctaccagttgctcaacctctccaaaaatcagatgattcatcctcacaacaggggtggcattgcactgcttggcctacccttaaagagttgctgggatgattaagtgagatgatccatgaggtgctatgagcatactatgtcccagatactaaagacatgccagttatgttgagtttttttggctgcagatgcagactgcctgagcagctcctgcttgtcttctccttactcaaaatgtgt

SEQ ID NO: 68820 - DNA, 601 bp, Human
cgatatcggctcacactgcaacctccgtctcccaggttcaagcgattctcctgcctcagcctccagagtagctggaattacaggcacctgccacgacacccggctgattttttttttttgtatttttagtagagacaaggccagcctgttcttgaactcctggcctcaggtgctctgcctgtcttggcctcccaaagtgctggaagtacaggcgtgagccactgcgcctggccctaagttggtttttttttttcttaagtgaatgccaggtatggtattctagctatggtgttctaacggmaacaacagctaacatttcttgagagcttactgtgtgccagacagtgcggcaggcactattacaacctcattttgcggagacaaaaagggaaggtgccctgagaggggcgtgcccaagtgccacagttggaagtggcggaagcaggacatacccccacgcagtctatgtgggggaaaccaggtgcactgtcctctctccacaatcttccctgacccagcatgcaaagtgtgcaatgcactgaaggatggggccctgggtgacaagagtgtggagaaggggctgggggaacatggctgatgg

SEQ ID NO: 68821 - DNA, 601 bp, Human
cactggcagccaggcaagaggctggagaaccacatctgccatcgtcacagagctcttctatgtccccagctgcaggagagtcacactgggctctgtacaccctcaatgctgccctctggcagggggtatggacatataaaggagcactgaccagacagagagaaagccacagatgcacacctaagtgagtgctattggacttggctgagaggcgaacgctgctgcgtgccctggaagtccccaggacttttacctttatgtcacctaggtggacacagtttgctccctttcttccagtgarttgaggagggcttcccagaaaaggggacctctcaggagctgtatgaatgaaagataaaggactgggagaggctggcccagacttctgcagccagaggggagtttaaaggcaagaaggctagggtcacggagcaactgctatgggaaaggtgagccagcgcgacagcccccaccccagaagaggcccggggcaaggggatgcctgcagcttggctggtattcctcccgccccacctccacagaaaacgggggggggggagtctctcctttgcccagagcctccctgcccctcccctccgct

SEQ ID NO: 68822 - DNA, 601 bp, Human
agcatctaaccccctaaaccaggtccagatggaatccagaaagtacaaatgggggtcctccaggaaacactgctatttcagaaacaccaatggaaattccactctgacagtgacggcagctggtggtacaaaattgggcggtgtctccgcctaggcaggaaaaacaccagctccaggcagtcagccgttgccttacctggagggctgatcaaccgtcacaaatgtgtttaaaatttctaccccctccccacacccagccatgagaaaataaatgtattattgttaataaatgcaatttggmagtctaaatctttcaaagggctgagtcttgaagataataaaacacattctgggatgaaaaggcagagggctggagcccaaggctggtgtgagcagagcagtggccggctattatacttgtccttcttgggtttaatttcatctttcccatgaatcaccccatgaattcacaccttaagctcactgggccttagcttgtttattgggaagaggacttctagaggtacttctagatcagatatcctaagttccagctcatggggtcagaagtccagtgtaaggcacttgagtgctcaaatgc

SEQ ID NO: 68823 - DNA, 601 bp, Human
gtagggtctctccagcccccattcaaaagcatctaaccccctaaaccaggtccagatggaatccagaaagtacaaatgggggtcctccaggaaacactgctatttcagaaacaccaatggaaattccactctgacagtgacggcagctggtggtacaaaattgggcggtgtctccgcctaggcaggaaaaacaccagctccaggcagtcagccgttgccttacctggagggctgatcaaccgtcacaaatgtgtttaaaatttctaccccctccccacacccagccatgagaaaataaatktattattgttaataaatgcaatttggcagtctaaatctttcaaagggctgagtcttgaagataataaaacacattctgggatgaaaaggcagagggctggagcccaaggctggtgtgagcagagcagtggccggctattatacttgtccttcttgggtttaatttcatctttcccatgaatcaccccatgaattcacaccttaagctcactgggccttagcttgtttattgggaagaggacttctagaggtacttctagatcagatatcctaagttccagctcatggggtcagaagtcca

SEQ ID NO: 68824 - DNA, 601 bp, Human
tgaaattattggccaattatagctcagtctggtccttgggagaggtggggtctgctgctgtatttgtgacctctgatttaactgtgggcttctctctccctaaaataaaccctgggggccctgtgagtcctgcctcaccatctctggtcagaggcatcagtagggtctctccagcccccattcaaaagcatctaaccccctaaaccaggtccagatggaatccagaaagtacaaatgggggtcctccaggaaacactgctatttcagaaacaccaatggaaattccactctgacagtgacrgcagctggtggtacaaaattgggcggtgtctccgcctaggcaggaaaaacaccagctccaggcagtcagccgttgccttacctggagggctgatcaaccgtcacaaatgtgtttaaaatttctaccccctccccacacccagccatgagaaaataaatgtattattgttaataaatgcaatttggcagtctaaatctttcaaagggctgagtcttgaagataataaaacacattctgggatgaaaaggcagagggctggagcccaaggctggtgtgagcagagcagtggccggctattat

SEQ ID NO: 68825 - DNA, 601 bp, Human
aagcccagttaatttttgtatttttagtagacatggggtttcactgtgttggccaggatggtcttgatctcctgacttcatgatccacccacctcggcctcccaaagtcctgggattacaggcatgagccactgcgcccggcccacaataaaacatttttaaaaatcagaacttttggcataatctatttcgctttcccaggaaaagaaatgtagcagattttataacagagaagagaaagtaaagtcaagtcaagagtctaaggtatttccatattatcatcaaagttgccgggagaagkttgggggtcaaagctaagattccaggttggatgacctggttttgtatccaagcacagctcctcagtactacctgaccttaggttggttacttaacctttctgagccttggttccctcattggcagagtgagcataattccattcatccagcagcatttctgtatagattaaagaataaatatggtgcctggcacattggcatgaacaaacagttaaaaacaaacaaaacacatttttaaaaagatattactttttctatttagtacaaaaatgaaaatctagtgtcttcccttgttttct

SEQ ID NO: 68826 - DNA, 601 bp, Human
ctcccaaagtgctgggattacagacgtgagccattgtgcccagcccagagtcctactatctaatgtctaagttacttaacctccattcattcaatacacgctcctcagaactactaaatcccaggcactacaccaggtgctgagggtacaatgataaaggtgtctttgacttctgctcccaaagtgtccagcctggaagggacaaacagaagggaacattccgacacacaagggccgctcagtgtgccccggaagccatctgacctttgtaggccaatctctgtcaggaaatgggtggccwtacctacacctcaggggtgttttaaaaggtaaaaaagataatgcttgccaagtacctagcaagcaaggaccacacaaagctcatggcagatactcaataaggggtaagcctcctcttgtcccagaatgggtcttagtgatggcagcagcaaggtgttccaggcaaaggcactgcattgccatgcctgttccacaatgagcaattctcttttcttagaggagtctggaatacactgctacttattttttaaagcagcacctaagcccctaattatgtcttagcctacttttattggaaagc

SEQ ID NO: 68827 - DNA, 601 bp, Human
tggtcaggctggtctcgaactcctgacctcaggtgatccacccaccttggcctcccaaagtgctgggattacagacgtgagccattgtgcccagcccagagtcctactatctaatgtctaagttacttaacctccattcattcaatacacgctcctcagaactactaaatcccaggcactacaccaggtgctgagggtacaatgataaaggtgtctttgacttctgctcccaaagtgtccagcctggaagggacaaacagaagggaacattccgacacacaagggccgctcagtgtgcccyggaagccatctgacctttgtaggccaatctctgtcaggaaatgggtggccttacctacacctcaggggtgttttaaaaggtaaaaaagataatgcttgccaagtacctagcaagcaaggaccacacaaagctcatggcagatactcaataaggggtaagcctcctcttgtcccagaatgggtcttagtgatggcagcagcaaggtgttccaggcaaaggcactgcattgccatgcctgttccacaatgagcaattctcttttcttagaggagtctggaatacactgctacttatttttta

SEQ ID NO: 68828 - DNA, 601 bp, Human
cgggcagtgacgccatctcggctcagcgcaacttccacctcccaggttcaagtgattctcctgcctcagcctcccaagtagctgggattacaggtatgtgccatcatgcccggctaattttttatatttttggtagagacggggtttcaccatgttggtcaggctggtctcgaactcctgacctcaggtgatccacccaccttggcctcccaaagtgctgggattacagacgtgagccattgtgcccagcccagagtcctactatctaatgtctaagttacttaacctccattcattcaayacacgctcctcagaactactaaatcccaggcactacaccaggtgctgagggtacaatgataaaggtgtctttgacttctgctcccaaagtgtccagcctggaagggacaaacagaagggaacattccgacacacaagggccgctcagtgtgccccggaagccatctgacctttgtaggccaatctctgtcaggaaatgggtggccttacctacacctcaggggtgttttaaaaggtaaaaaagataatgcttgccaagtacctagcaagcaaggaccacacaaagctcatggcagatact

SEQ ID NO: 68829 - DNA, 601 bp, Human
ctcctggaaaagtccatgaaagcctgagaaatacaatattcacaacattccacttcagactaaggagtctcaatctggtccaactgcctcaccatacggatagggaggctaacacacaggtcagtggactcgctggttcaaggtcacctctttttttttctccttttcaattttttgactaacacattcattctcatggttttaaaaccaaaatatataagatatacagttaactctccctcctatcttatcctctgtctgcccagtcaactataccacctgctaagcatctctctagaaygttcacacacatacaagcaaattcagaatcttatttcttctctcttttattaaaaacctagcatattatactaatcattgccttgcctttttttcatggagtttgtgtaagagtacataaaaaccctcttcgtttcttctttgcaactacatagtgtgtcatcatttttcttaaccagtctcttattgatgagtatctgggttgcttccaatcttttgtgtaataaataattttgcaatatcaataagcttgggcatgtcagtttgcattcacctagcttacggataagagctggaatca

SEQ ID NO: 68830 - DNA, 601 bp, Human
ggccaggccaggctaccaacggaagggactgcagattaccctagcacaaggtcaggatctcctggaaaagtccatgaaagcctgagaaatacaatattcacaacattccacttcagactaaggagtctcaatctggtccaactgcctcaccatacggatagggaggctaacacacaggtcagtggactcgctggttcaaggtcacctctttttttttctccttttcaattttttgactaacacattcattctcatggttttaaaaccaaaatatataagatatacagttaactctccctcytatcttatcctctgtctgcccagtcaactataccacctgctaagcatctctctagaatgttcacacacatacaagcaaattcagaatcttatttcttctctcttttattaaaaacctagcatattatactaatcattgccttgcctttttttcatggagtttgtgtaagagtacataaaaaccctcttcgtttcttctttgcaactacatagtgtgtcatcatttttcttaaccagtctcttattgatgagtatctgggttgcttccaatcttttgtgtaataaataattttgcaatatc

SEQ ID NO: 68831 - DNA, 601 bp, Human
tgagatcatgggtaagccaggctgtcctagaggttactatgataaattttataagcatgtttcttacccaagactttgcaccccagaaagcagaggtgaggtattatgcaactgattcccccacactgccttgcacttagctttcaataaatgtttgcagaactgaaaagcattaaaaataacccggaaaatgttctgccatttttttccttcctattaaactgtagcactttgccagaatgctccagaacagtctctcttcactgtaatccttcactttggaggaagaaccaactgagtaacaccagaggtgtgtgctcagaggataaactctgaggaatggggacaggaacaaggcctgactcctctggggaaggctccttgctctctgtgcccccaacctttctcaaacatcctgagagggccaggccaggctaccaacggaagggactgcagattaccctagcacaaggtcaggatctcctggaaaagtccatgaaagcctgagaaatacaatattcacaacattccacttcagactaaggagtctcaatctggtccaactgcctcaccatacggatagggaggctaacacacaggt

SEQ ID NO: 68832 - DNA, 601 bp, Human
agacttcactgagattcagtttcttcacctgtaaaatgggacgagtccctaccaatcccacctgtctccatgggacccaatgagatcatgggtaagccaggctgtcctagaggttactatgataaattttataagcatgtttcttacccaagactttgcaccccagaaagcagaggtgaggtattatgcaactgattcccccacactgccttgcacttagctttcaataaatgtttgcagaactgaaaagcattaaaaataacccggaaaatgttctgccatttttttccttcctattaawctgtagcactttgccagaatgctccagaacagtctctcttcactgtaatccttcactttggaggaagaaccaactgagtcacaccagaggtgtgtgctcagaggataaactctgaggaatggggacaggaacaaggcctgactcctctggggaaggctccttgctctctgtgcccccaacctttctcaaacatcctgagagggccaggccaggctaccaacggaagggactgcagattaccctagcacaaggtcaggatctcctggaaaagtccatgaaagcctgagaaatacaatattc

SEQ ID NO: 68833 - DNA, 601 bp, Human
gataaagccctgcaaagagagctctgagtcttttcccctcttaaaatgctatgatttgattctttcttcttaagcattacttgctttaggatgcaggcccgatacaatcattcaacagtccgtacagagtatttactacatgccatgccaggtactatgctaggtgttaaagataccgtggtaaacaaaactaggtgcctgtctcacagatctacattctagcaggggagccaaagaataaaccaataaatgtatacacatgtatataatgtgtatgaatgctgcaaagaaaaaaaaaaaaggacagaaaggcaccgggcgcggtggctcacgcctgtaatcccagcactttgggaggccgaggctggcggatcatgaggtcaggagatcaagaccattctggctaacacggtgaaaccccgactctactaaaaatacaaaaaattagccaggtgtggtggcgggcacctgtagtcccagctactccggaggctgaggcaggagaatggcgtgaaccagggaggcgaagctccagcctgggcgacacagcgagactccgtctcaaaaaaaaaaaaaaaaaaaaaagaaagaaaaggacaga

SEQ ID NO: 68834 - DNA, 601 bp, Human
ttctctcaagactccaaacttagggcccacaccctcaaagtcacaggactctccatcctccttgaagcaagaggaaagaaaggtggaaaataaaattagctgttaggaagagcccagacctgagctcagcccctgctctccccaccaccaccttccacacatccatgcagagctgcaagtggagaagaggcagggaaagctaaatggcctcacagaagaaacctcgaccttggcctccttccctgccacctctatgcaaaatgacagcagcatcagcaatgacagaagcagagcaaacgcygcctcggcactgaagccctgttgtccaaccaccaatgggaaatcgctgatttgggcagaaatgggaaccaatcatgcagaagaacctaaggctggggctgaaagttttttctatccaaggccacaaaacaaattagccaggggctacacataagaagcaatttaacattagttatttctcccttagacaagtgtgaaatgtgcagcttccttaaatctgtgaaatacacaggtatggcaaaaattattagtgaaggaagtgcaagaaatgctagcagtatatgttaactccatatttcta

SEQ ID NO: 68835 - DNA, 601 bp, Human
gttttcaggttccagtctttgcacacaagagaagactcatatcaaattgaccctgtgttttttggtgctcgtgggttttaaataggtcagcttttaaatgggccatcccctgttgcagatcccatttcagctagaaggccaaactgtctgagacaccaaggttttagactggggtgatagatgcttgtgattttgttgttttaaccataaaatcgatggttttgctgaacagccagtgtggcaaaacctgcagaaatcagtcaggttccatgttggggaaaagtgaaagctctgacagaaagttagacattttgaaagctagaagggccttagggatctcctaggccagtggctttctacattttacaccgtggctcagtacacacgtttttgtgtgtgtataggcatacacaactgaaaacaaaacttaacacttgcaattactttcttatgttacttagaacaaaatatgtgtaacgtgacctacagtctgcaaaactctggtgtaggtcagttctcttttttcagaggaagaagcaaggtccaaagttggggccagagtcactgtgagctgggcgattcgtttccctgcagcacacac

SEQ ID NO: 68836 - DNA, 601 bp, Human
ttcacactaaccctgaccacccttgattttcttttccttcacggagcaagaattcaatacatatttgtagctttggtttcaaccttgtcagtccctgaccaatttggttttcaggttccagtctttgcacacaagagaagactcatatcaaattgaccctgtgttttttggtgctcgtgggttttaaataggtcagcttttaaatgggccatcccctgttgcagatcccatttcagctagaaggccaaactgtctgagacaccaaggttttagactggggtgatagatgcttgtgattttgttgttttaaccataaaatcgatggttttgctgaacagccagtgtggcaaaacctgcagaaatcagtcaggttccatgttggggaaaagtgaaagctctgacagaaagttagacattttgaaagctagaagggccttagggatctcctaggccagtggctttctacattttacaccgtggctcagtacacacgtttttgtgtgtgtataggcatacacaactgaaaacaaaacttaacacttgcaattactttcttatgttacttagaacaaaatatgtgtaacgtgacctacagtctgca

SEQ ID NO: 68837 - DNA, 601 bp, Human
aagcttagagtaagaactgctccttctttttctagtacttcctgaggcaacatggaaaggtggacagaaggcaggctctcgagtccgagagaactggctcaagttcaatttttcttctttttagcccagcttacctttctgagcttccgtttcctttagtgactataatgtccatcacctagggttggattaaataagaatgtacttggagcatccccagcttggaaaaagccacttgccttcccctttttccatggctatctttactgttgcgtacagtcaaggcacaagaatggaaacraagggcaggttagcagatttgagtcaactaagctgtctgtacggcttccttatagtaaatacgaggcctcttaacctgttggggaaccaggaatggtgtgcttaaaaccgacccctttggatttttacatccacaccttgttttgtttttcacactaaccctgaccacccttgattttcttttccttcacggagcaagaattcaatacatatttgtagctttggtttcaaccttgtcagtccctgaccaatttggttttcaggttccagtctttgcacacaagagaagactcatatcaaa

SEQ ID NO: 68838 - DNA, 601 bp, Human
caggtctccagccctctccacatggggcacacctgcgacactgttggctgaggagacacggaagaaacagtaagccaaggtcggggtccttgccagcaagaggtgtggtggccggctgggaggagacagccaccagtaaacaactccagtccagtgtgccaggtagcaggactggggccgggccagggtgcattcttcaaatgcctctaccagatagaacaggcatgctaaaggcagatgagggggacccagaaggaccaacggaggagatacactatatcaaaagccaggactggcttasagggcccagcataaaatgaaaaacacggagccccttgcttaaaaattaagaattccaagacagtgacagcagcgcattaaaccaagtgcgtgctgcacgggtcacatgcctgtgaagctggccctgattaaagtggacagtttgggcctgaaacagagccctttgaaggacaggaccagagagaaggaagcttagagtaagaactgctccttctttttctagtacttcctgaggcaacatggaaaggtggacagaaggcaggctctcgagtccgagagaactggctcaagttcaattttt

SEQ ID NO: 68839 - DNA, 601 bp, Human
ttaagcatccgatcctcctagaggtcagggactgtcctccgtaatcagcctaccagggagcggagaccagagcaactgcttaacaaatgtcctgtttattgcgccaggtataacattaggtgctgggaatatagaggtgagtcaaactgtcatgaaacgtattcaacagtatgacgaataaatgttgaatgaaccctatcttttataaacaccagtggttttttggagtctttcttgtgcccaagacaagcataagcccctgagaggcaggtcagctgtgcacactccccctgacctgaaygacccagtgctctgcatgcaggtctccagccctctccacatggggcacacctgcgacactgttggctgaggagacacggaagaaacagtaagccaaggtcggggtccttgccagcaagaggtgtggtggccggctgggaggagacagccaccagtaaacaactccagtccagtgtgccaggtagcaggactggggccgggccagggtgcattcttcaaatgcctctaccagatagaacaggcatgctaaaggcagatgagggggacccagaaggaccaacggaggagatacactatatca

SEQ ID NO: 68840 - DNA, 601 bp, Human
tcactgccttgggaaaaattcaagttcctacacatgacctccaaggttctccattcttggagctccctcctctttatccaacctcagcacccccaatctctcactcttaccctacaaatccagttccccttcccaggaagccttctccaacccagctctgtgcatcctggggcaccaagggcagctgctgcatgaatcatttactcgtgtattaagcatccgatcctcctagaggtcagggactgtcctccgtaatcagcctaccagggagcggagaccagagcaactgcttaacaaatgwcctgtttattgcgccaggtataacattaggtgctgggaatatagaggtgagtcaaactgtcatgaaacgtattcaacagtatgacgaataaatgttgaatgaaccctatcttttataaacaccagtggttttttggagtctttcttgtgcccaagacaagcataagcccctgagaggcaggtcagctgtgcacactccccctgacctgaatgacccagtgctctgcatgcaggtctccagccctctccacatggggcacacctgcgacactgttggctgaggagacacggaagaaacagt

SEQ ID NO: 68841 - DNA, 601 bp, Human
cattcctggcttctcactgccttgggaaaaattcaagttcctacacatgacctccaaggttctccattcttggagctccctcctctttatccaacctcagcacccccaatctctcactcttaccctacaaatccagttccccttcccaggaagccttctccaacccagctctgtgcatcctggggcaccaagggcagctgctgcatgaatcatttactcgtgtattaagcatccgatcctcctagaggtcagggactgtcctccgtaatcagcctaccagggagcggagaccagagcaacygcttaacaaatgtcctgtttattgcgccaggtataacattaggtgctgggaatatagaggtgagtcaaactgtcatgaaacgtattcaacagtatgacgaataaatgttgaatgaaccctatcttttataaacaccagtggttttttggagtctttcttgtgcccaagacaagcataagcccctgagaggcaggtcagctgtgcacactccccctgacctgaatgacccagtgctctgcatgcaggtctccagccctctccacatggggcacacctgcgacactgttggctgaggagaca

SEQ ID NO: 68842 - DNA, 601 bp, Human
tgccacccctgcccacagcccaaggggctgctgctggggtaggctgcctaggaatgctacagatagacataggtttcggagccctgacgaggccagtccctggctcctaccacaacaccaaaactggtggctgctcctctggaggacaatactcaagcaatcactattaatgctttgattaaaaataatcgtcatatctttctcaagcactcgctaggcacactctaggtgcttcatacacagtctcgtttaatccccataaccactccttggggtgtgttctctccgttttaaaggcacrtccgaactgcttatcctaaaatcccaaaagaaggtcacaggagggtgggtgtctactgcactcaggtggctagtgttagccacaagatgaggaggggcccctgttggcttcttgggactctccccagacccccaagtcaattctacaagttcttggctgtgctggggctcagaacacaatacccaaatgtaaggggctttggcgtgctgggtactttgaactaaaggagattggaaggcctcagaagcaagctctgtgaatttctcttgccctcctgtctctcaccctctctccccagaa

SEQ ID NO: 68843 - DNA, 601 bp, Human
gggagacagacgcaggaagcagtcagtcactccgtcacttcttctagctttccggatcactgtgctgccaacgaccacaggatggatttgcccaccctgacttttctgccttttcaacatctgggtgagaggaggcctgtggtgagccgagctgcagaaccagggggccactccagacaggggccttggctgtaccgcagaagacaaacccagtaagccctgctgcctctgcaaggttggtggtctcattccaaccctgctctcgcattctcccaaaacccacatgcaccagccacagcaytgttagggacttctgggccttgccccgccaccccaatgcccccacaagacccccacatgcccagttgctttcacccactcctgccatcacagcagagcctgccgctgtagctggcattcacatggcagtacccatgtggcctgtcctgaggcaggcgcagcagaccaggggctcctccagctctcccacctctagcccagcactgtccaacagaacttccttcaaggacggaaacggtctgtactgttcaagacaggggccactagtcacatgtggccacggagtgcggccagtgagact

SEQ ID NO: 68844 - DNA, 601 bp, Human
ccaccatcctcatcctcctcctcatcatccaggccctccacgtagccctcagcatccgagtcaggggcctccttgtcgtcccggtcatagccgtcgagatatgtgagttgcgggaggagcttgaacacattttctcggtagtcgttcaggttggttacctcgcaattgaaaaggtctaagctcttgaggttttctaactttttctgcaagcggaaaaatgaagccaacagtaagtgatttgtgggaggaaggtggaggaacagccctagcaaacaggcaaggatgccatgagatagcatgsgcagaccatgacttccaggtgataaggaagcttggatttggctctgcttagccacagtgtttgcccagacatatcacctgcagtttgtgggcctcggcgtctccatctggaaaatggggggttggactggaggatctttgaagccttatccaatgttaacacttttattctgcaattacagcttctgtcttaacagtgattgacttgaaattagcctggggctttcttggtgcatgagccaagaggtttactgcctctccctgagactaaggagccagagggaaaccaaaagtcaacttg

SEQ ID NO: 68845 - DNA, 601 bp, Human
ggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacggggcaagcgcgggcctcgcgggcaggctgggccagyccctcaggggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgt

SEQ ID NO: 68846 - DNA, 601 bp, Human
agctgggacccgacggggcaagcgcgggcctcgcgggcaggctgggccagtccctcaggggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaackcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgc

SEQ ID NO: 68847 - DNA, 601 bp, Human
tgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttyccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgc

SEQ ID NO: 68848 - DNA, 601 bp, Human
tgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgakctcttgaggttttattggataatgtggcaaagggaaggcccgggggccctgcctctcccttgcggtgggatgtggtgccacggtggcacgttctagccttgcctgctccctctgcgtcccactttcatgctgtttttaaggtggaacataaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttcca

SEQ ID NO: 68849 - DNA, 601 bp, Human
ctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacgttctagccttgcctgctccctctgcgtcccactttcatgctgtttttaaggtggaacakaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccag

SEQ ID NO: 68850 - DNA, 601 bp, Human
gttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacastaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttcca

SEQ ID NO: 68851 - DNA, 601 bp, Human
tccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcawgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgag

SEQ ID NO: 68852 - DNA, 601 bp, Human
ttaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctcycttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacgaaacaaatctattttctaagccaggcacagtgg

SEQ ID NO: 68853 - DNA, 601 bp, Human
attagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatgggracgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgaga

SEQ ID NO: 68854 - DNA, 601 bp, Human
accatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagatwctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacacctt

SEQ ID NO: 68855 - DNA, 601 bp, Human
ggcagagtgactcccatcccatcattgatgtctggctttgacttggcatgggagacattgcctctccagatctcagttctctcgtttgacaaatggggcttagggttgaacagcctctaaatcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggygggcaaattacgaagtcaggagttcaagaccagcctggccaacatggtgaaaccccatctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactg

SEQ ID NO: 68856 - DNA, 601 bp, Human
agaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggcttaygcctgtaatcccagcactttgggaggccgaggcgggcggatcatgaagtcaggagatcgagaccatcctggccaacacggtgaaaccccgtctctactaaaaatacaaaaaaaattagccgggcgtggtggtgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaaagaattatgcagacagtttcatt

SEQ ID NO: 68857 - DNA, 601 bp, Human
ttagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggcttatgcctgtaatcccagcactttgggaggccgaggcgggcggatcatgaagtcaggagatcgagaccatcctggccaacacggtgaaaccccgtctctactaaaaatacaaaaaaaattagccgggcgtggtggygggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaatt

SEQ ID NO: 68858 - DNA, 601 bp, Human
ggagaatagggtgaacccaggaggtggagcttgcagtgagccgagatcgcgccactgcactccagcctgggcaacagagcgagactccgtctcaaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacagraaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcagg

SEQ ID NO: 68859 - DNA, 601 bp, Human
acctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggyggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgta

SEQ ID NO: 68860 - DNA, 601 bp, Human
gtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttwtctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtctcttctgacgtgattgtaggtttcccgaggcctcccca

SEQ ID NO: 68861 - DNA, 601 bp, Human
acagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagayagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccat

SEQ ID NO: 68862 - DNA, 601 bp, Human
ctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggytcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcagg

SEQ ID NO: 68863 - DNA, 601 bp, Human
tgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaastaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgattta

SEQ ID NO: 68864 - DNA, 601 bp, Human
tttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgkataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagc

SEQ ID NO: 68865 - DNA, 601 bp, Human
atacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggmaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagt

SEQ ID NO: 68866 - DNA, 601 bp, Human
tccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacaytgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatcca

SEQ ID NO: 68867 - DNA, 601 bp, Human
ggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaacyccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgct

SEQ ID NO: 68868 - DNA, 601 bp, Human
atgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgrgctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaggatcactagtggtgagcct

SEQ ID NO: 68869 - DNA, 601 bp, Human
tgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgg

SEQ ID NO: 68870 - DNA, 601 bp, Human
ctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactc

SEQ ID NO: 68871 - DNA, 601 bp, Human
ccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagrgtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctccca

SEQ ID NO: 68872 - DNA, 601 bp, Human
gctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggrgcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggt

SEQ ID NO: 68873 - DNA, 601 bp, Human
cgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagycccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccatcagcttcttccccctccttctccatctgatctgagcatttaccatttccttcc

SEQ ID NO: 68874 - DNA, 601 bp, Human
ggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcaggrtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgt

SEQ ID NO: 68875 - DNA, 601 bp, Human
aggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttytatttctttacccaaatattctatgtctcttcggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttt

SEQ ID NO: 68876 - DNA, 601 bp, Human
tgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttygggaggctgaggcaggaggaggcttgaggcctggaattcaagaccagcctgggcaacatagcaagaccctgttttgttttgtttttttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgacggagtggagtgagaccttgtctttaaaaaaaaagaaaagaaaacagaaagaa

SEQ ID NO: 68877 - DNA, 601 bp, Human
agagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctctttgggaggctgaggcaggaggaggcttgaggcctggaattcaagaccagcctgggcaacatagcaagaccctgttttgttttgtttttttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgacggagtggagtgagaccttgtctttaaaaaaaaagaaaagaaaacagaaagaaatactcataaatggtatatatatatatcactttgtaatttgttcttgactactttgtcaacaatttttaagctgtatccatg

SEQ ID NO: 68878 - DNA, 601 bp, Human
attccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtytaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaaccgacttgattctaacaaatagaacacagcaggaggaatgggacatcacttctgacatcaggttataaaaagactgcagctgccagcttgggtgttctctgttgc

SEQ ID NO: 68879 - DNA, 601 bp, Human
atatgaatattgatcctccttgagtgctgtggaaggaagcctctaagatgccgccactggtccccacatcctggtcttcacacccttgtgtaatcccttccctcgggtgttggctggacttaaccgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctasgtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtg

SEQ ID NO: 68880 - DNA, 601 bp, Human
ggacttaaccgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcmaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctct

SEQ ID NO: 68881 - DNA, 601 bp, Human
ctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcrtatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaa

SEQ ID NO: 68882 - DNA, 601 bp, Human
gattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgstgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattcca

SEQ ID NO: 68883 - DNA, 601 bp, Human
cctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtyagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcag

SEQ ID NO: 68884 - DNA, 601 bp, Human
cacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagasacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgt

SEQ ID NO: 68885 - DNA, 601 bp, Human
ggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtyatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctg

SEQ ID NO: 68886 - DNA, 601 bp, Human
gtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgatratactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaactttttttttttttttgagacagggtcttgctgtcacccaggctggagtggtggcacaatcttggcctactgcaaccttgacttcccaggcccaagcgattctcccacctcagcctccca

SEQ ID NO: 68887 - DNA, 601 bp, Human
cttatcctgggtttcttcatttgtaaaatggaagcactacttcacagtgctgttgtgtgggtcaagatgagatgaatgtgacctactgtggtactatttattatttgtcctagaaaaactttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagayagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcac

SEQ ID NO: 68888 - DNA, 601 bp, Human
cccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgamgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagt

SEQ ID NO: 68889 - DNA, 601 bp, Human
atttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggaygaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaa

SEQ ID NO: 68890 - DNA, 601 bp, Human
atcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttkcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtct

SEQ ID NO: 68891 - DNA, 601 bp, Human
tctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacrtgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatg

SEQ ID NO: 68892 - DNA, 601 bp, Human
gctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattayaggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaa

SEQ ID NO: 68893 - DNA, 601 bp, Human
gtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccrctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatattt

SEQ ID NO: 68894 - DNA, 601 bp, Human
caccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtarccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttatt

SEQ ID NO: 68895 - DNA, 601 bp, Human
ctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcrtggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgtta

SEQ ID NO: 68896 - DNA, 601 bp, Human
ccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccrtgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgt

SEQ ID NO: 68897 - DNA, 601 bp, Human
gaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgmccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaa

SEQ ID NO: 68898 - DNA, 601 bp, Human
ctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcgrggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtagg

SEQ ID NO: 68899 - DNA, 601 bp, Human
taaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacawctgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttt

SEQ ID NO: 68900 - DNA, 601 bp, Human
gacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagaytctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttac

SEQ ID NO: 68901 - DNA, 601 bp, Human
ggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaakgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgc

SEQ ID NO: 68902 - DNA, 601 bp, Human
tgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccrgggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacaga

SEQ ID NO: 68903 - DNA, 601 bp, Human
ccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgmggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgc

SEQ ID NO: 68904 - DNA, 601 bp, Human
ctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggayatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcc

SEQ ID NO: 68905 - DNA, 601 bp, Human
gggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggyggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccg

SEQ ID NO: 68906 - DNA, 601 bp, Human
tgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggkgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgac

SEQ ID NO: 68907 - DNA, 601 bp, Human
aggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctcccctygaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggtta

SEQ ID NO: 68908 - DNA, 601 bp, Human
atcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatcygtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgagga

SEQ ID NO: 68909 - DNA, 601 bp, Human
cagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaacgttctgccacttggcagcctcaccrgggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggact

SEQ ID NO: 68910 - DNA, 601 bp, Human
ggatagaccccccggaatgcagggggccgggctgagcaagaggaggagaggacagggaaggaacatgtctgcttctttccttcaggaaaggaaaggtgagctgggcgatggggaaggcctccacggtgttctgttgtaacgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttcccyagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagc

SEQ ID NO: 68911 - DNA, 601 bp, Human
gaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccrtgatcataccactgcattccagcctggccaacagagcaagaccttgtctcaaaaagtaaataaaaaataaaacccattctcactctaacccatactgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggagtgctgggcagagg

SEQ ID NO: 68912 - DNA, 601 bp, Human
ttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaartaaataaaaaataaaacccattctcactctaacccatactgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggagtgctgggcagaggtttaccgtccagcacccccatttctgctgctctgataacttggatcgactgaagaa

SEQ ID NO: 68913 - DNA, 601 bp, Human
tcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctccttttttttkttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccg

SEQ ID NO: 68914 - DNA, 601 bp, Human
tttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcrtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggt

SEQ ID NO: 68915 - DNA, 601 bp, Human
tagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcrcgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtc

SEQ ID NO: 68916 - DNA, 601 bp, Human
tgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgytgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatct

SEQ ID NO: 68917 - DNA, 601 bp, Human
gggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaratgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcct

SEQ ID NO: 68918 - DNA, 601 bp, Human
cccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccastgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgt

SEQ ID NO: 68919 - DNA, 601 bp, Human
ggatctggagcctgtgggtgtgtaaggagccaactccctgaccccaaaactgtggccagttctggagaaggtggccaggctctgggtcccgggactgcggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcgggtgagagyggcagcctgagagctgcgacccggggccggggttttcctggagcagcaggagggatgagttgggtttctgtaactacaagggccaagaagagggagaggatgatctgggaaggagagtggctttgggccagcatttgggccagcaggactcggaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagg

SEQ ID NO: 68920 - DNA, 601 bp, Human
tgtgtaaggagccaactccctgaccccaaaactgtggccagttctggagaaggtggccaggctctgggtcccgggactgcggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcgggtgagagtggcagcctgagagctgcracccggggccggggttttcctggagcagcaggagggatgagttgggtttctgtaactacaagggccaagaagagggagaggatgatctgggaaggagagtggctttgggccagcatttgggccagcaggactcggaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccgga

SEQ ID NO: 68921 - DNA, 601 bp, Human
tgtaaggagccaactccctgaccccaaaactgtggccagttctggagaaggtggccaggctctgggtcccgggactgcggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcgggtgagagtggcagcctgagagctgcgasccggggccggggttttcctggagcagcaggagggatgagttgggtttctgtaactacaagggccaagaagagggagaggatgatctgggaaggagagtggctttgggccagcatttgggccagcaggactcggaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaag

SEQ ID NO: 68922 - DNA, 601 bp, Human
gaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaaygtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtc

SEQ ID NO: 68923 - DNA, 601 bp, Human
gtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgtggagcaacagctccctgtgcatcagagccgtgggggagggrggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagcccc

SEQ ID NO: 68924 - DNA, 601 bp, Human
tggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatygattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacgttggctccccatcgc

SEQ ID NO: 68925 - DNA, 601 bp, Human
tgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctggacagtgcttgcaaaggtaactggcattctgccggctgctcaactctgtggacaccagtrcagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccgagatacaaaaggttatg

SEQ ID NO: 68926 - DNA, 601 bp, Human
actctgtggacaccagtgcagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccragatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaat

SEQ ID NO: 68927 - DNA, 601 bp, Human
ccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcaagacaggctggacattggaggatgggatgacactggctcttctggggtaacttgtctgggtttaaggttcttgrtggggtttaggacatggcgggaccctaaggatggtgccagcatctgaattctctgccgtcttgcagagtcaggattctgcagctacttgcccaagaaaaagtagagaaaggtggtttcatgttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataaca

SEQ ID NO: 68928 - DNA, 601 bp, Human
ggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctyttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaat

SEQ ID NO: 68929 - DNA, 601 bp, Human
gggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtccygctttttctttccacttaagacaatatcattcatttcctgtatcattaaaaatatttgcagtcgggtgcggttgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctca

SEQ ID NO: 68930 - DNA, 601 bp, Human
aactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcagtcgggtgcggtygctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgt

SEQ ID NO: 68931 - DNA, 601 bp, Human
tttcctgtatcattaaaaatatttgcagtcgggtgcggttgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagygaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaacca

SEQ ID NO: 68932 - DNA, 601 bp, Human
caggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcrcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccat

SEQ ID NO: 68933 - DNA, 601 bp, Human
tctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgcyggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagcgtgttgtgcaattgttgggcggcttttcccttggccacagtagattcgcaattaagaaaaacaaatgcagctctcagtcagaa

SEQ ID NO: 68934 - DNA, 601 bp, Human
tctcagagctgcagactgagcgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgygctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagt

SEQ ID NO: 68935 - DNA, 601 bp, Human
gcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctaraaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcaca

SEQ ID NO: 68936 - DNA, 601 bp, Human
gggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctytctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgaga

SEQ ID NO: 68937 - DNA, 601 bp, Human
tccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcastcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgatgagaaagttcaagtgtgggaaccgctggggatcttgatggcctgggtcctctggatcagtgcttgtgcaggacagaggcagccccggag

SEQ ID NO: 68938 - DNA, 601 bp, Human
tcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcaytcttgttctctgctgcatcttaggatggtgactggcacatagtaggagtccaattaagaatgttttgaataagcgaaagagtgcctaaatgagacttctattccagcttgaagaccagcccaccaccctgatgagaaagttcaagtgtgggaaccgctggggatcttgatggcctgggtcctctggatcagtgcttgtgcaggacagaggcagccccggagttctcatgggggctggtgagcagagtggggccccaggatgcctgatggcccggtctgaggtgtgcaggtgcccctgagg

SEQ ID NO: 68939 - DNA, 601 bp, Human
cgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccrccagaacatcatgtcatttgggatccctgatggcacattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccct

SEQ ID NO: 68940 - DNA, 601 bp, Human
tctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagarcatcatgtcatttgggatccctgatggcacattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatc

SEQ ID NO: 68941 - DNA, 601 bp, Human
agtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttyatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggtta

SEQ ID NO: 68942 - DNA, 601 bp, Human
ctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctagtaggcatgtcccctcaactccccagttgtaataaccaaaaatgtctccagacattgccaaatgtacccgggaaaatcactcaggttgaagtcactaaattatatgtgtgtacatataattacacatgcatatacatcrcgtacacacacacacacccacacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttg

SEQ ID NO: 68943 - DNA, 601 bp, Human
tgtcccctcaactccccagttgtaataaccaaaaatgtctccagacattgccaaatgtacccgggaaaatcactcaggttgaagtcactaaattatatgtgtgtacatataattacacatgcatatacatcgcgtacacacacacacacccacacacacacacacaccttttgctggtggctctggattggtaagctggctccatggcaagaatcagcatcctaatacttgccccaccctttaaaataaacttcccaatcctaggcagacaaaagaacaaccccagacctcctccctcagrgtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgct

SEQ ID NO: 68944 - DNA, 601 bp, Human
caagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcmcccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggatcctgagctggggtctgaaggaagagcagttc

SEQ ID NO: 68945 - DNA, 601 bp, Human
cgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaycctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctct

SEQ ID NO: 68946 - DNA, 601 bp, Human
gagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagacyccgtctcaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagtgtccagggctgaacccctggaggtt

SEQ ID NO: 68947 - DNA, 601 bp, Human
tgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgyctggttccaggctgctgatttgtcggcctcgtgtcggggggtgtccggagcctctcctctctgggggcttttcttcctgctctgcctgtttgggaagcctctggccactgagcatgtgctggccttgggttttactgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgat

SEQ ID NO: 68948 - DNA, 601 bp, Human
ctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttactgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcctgcctgggc

SEQ ID NO: 68949 - DNA, 601 bp, Human
ctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttackgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcctgcctgggccaccatgttgatcctctgggtccattgctcaagagcccaccatggctccctgttggcaaatgcagcctgaattcagtattcaaagccctccgtgaatggg

SEQ ID NO: 68950 - DNA, 601 bp, Human
cctcgtgtcggggggtgtccggagcctctcctctctgggggcttttcttcctgctctgcctgtttgggaagcctctggccactgagcatgtgctggccttgggttttactgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcytgcctgggccaccatgttgatcctctgggtccattgctcaagagcccaccatggctccctgttggcaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaag

SEQ ID NO: 68951 - DNA, 601 bp, Human
gggaagcctctggccactgagcatgtgctggccttgggttttactgctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcctgcctgggccaccatgttgatcctctgggtccattgctcaagagcccaccatggctccctgttgscaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttg

SEQ ID NO: 68952 - DNA, 601 bp, Human
caggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccrcatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcacgtgtgaatccacctcc

SEQ ID NO: 68953 - DNA, 601 bp, Human
ttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccgcatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcacgtgtgaatccacctccttgtgcca

SEQ ID NO: 68954 - DNA, 601 bp, Human
gtccagcacccatgaggagcaggtggaacaggatgtggcagtcaagggctcctgaggggacccgtaagtgccacattcagccttctgtgttaaggaccatgagtccaaagagtagtcacgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagmgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaa

SEQ ID NO: 68955 - DNA, 601 bp, Human
cttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacmcctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgcttttt

SEQ ID NO: 68956 - DNA, 601 bp, Human
gagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggaccyattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttacc

SEQ ID NO: 68957 - DNA, 601 bp, Human
tggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcrgctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggc

SEQ ID NO: 68958 - DNA, 601 bp, Human
cccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttktcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcagg

SEQ ID NO: 68959 - DNA, 601 bp, Human
tgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaakcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgac

SEQ ID NO: 68960 - DNA, 601 bp, Human
ttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggrggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctt

SEQ ID NO: 68961 - DNA, 601 bp, Human
gcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgcyctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaa

SEQ ID NO: 68962 - DNA, 601 bp, Human
acgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggytttgattccagacagtccagccatgcagcccctggccttgccacctccctctgccattctccagagactcggagaggggcctaaggcctgacatgaacaaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagta

SEQ ID NO: 68963 - DNA, 601 bp, Human
cagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggttttgattccagacagtccagccatgcagcccctggccttgccacctccctctgccattctccagagactcggagaggggcctaaggcctgacatgaacraagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacaga

SEQ ID NO: 68964 - DNA, 601 bp, Human
ctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaatkccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagagggaagatgcctctgtggagctggtcactgagagtgctggccaggcagggctgcccccaggaa

SEQ ID NO: 68965 - DNA, 601 bp, Human
gccaggaggaaatttgcaattcgagttaatggagtgttcccaagcagcctgagcgccaatgccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggraagatgcctctgtggagctggtcactgagagtgctggccaggcagggctgcccccaggaagctggagacagtggggcctttgcaaccagatagcgagggacctcaatgtggagattgggtgtgcttgctgagcgtgccagcaggcttgtgctcacctgctccagctgggggcatgcagaggcccctcctaccccaggaggatgcttactcactgcattccatggccttttaaaaatcccctttaggcccgggcgtggtggctcacacctgtaatcccagtactgagggaggccaaggcag

SEQ ID NO: 68966 - DNA, 601 bp, Human
agctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagagggaagatgcctctgtggagctggtcactgagagtgctggccaggcagggctgcccccaggaagctggagacagtggggcctttgcaaccagatagcgagggacctcaatgtggagatwgggtgtgcttgctgagcgtgccagcaggcttgtgctcacctgctccagctgggggcatgcagaggcccctcctaccccaggaggatgcttactcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagtt

SEQ ID NO: 68967 - DNA, 601 bp, Human
ctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagagggaagatgcctctgtggagctggtcactgagagtgctggccaggcagggctgcccccaggaagctggagacagtggggcctttgcaaccagatagcgagggacctcaatgtggagattgggtgtgcttgctgagygtgccagcaggcttgtgctcacctgctccagctgggggcatgcagaggcccctcctaccccaggaggatgcttactcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggc

SEQ ID NO: 68968 - DNA, 601 bp, Human
gcacaggccaacctggaaccagcacttcctctccaccctcccaccacccagcattttccccttcagctggcctggctgtggtgggacagagggaagatgcctctgtggagctggtcactgagagtgctggccaggcagggctgcccccaggaagctggagacagtggggcctttgcaaccagatagcgagggacctcaatgtggagattgggtgtgcttgctgagcgtgccagcaggcttgtgctcacctgctccagctgggggcatgcagaggcccctcctaccccaggaggatgcttaytcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtga

SEQ ID NO: 68969 - DNA, 601 bp, Human
cgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaamaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagc

SEQ ID NO: 68970 - DNA, 601 bp, Human
atcggtacacgtttgtcaaagcccgcggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctyggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacacactgc

SEQ ID NO: 68971 - DNA, 601 bp, Human
gactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacacactgctatcttaaaagcatagggaccttgcagtgagaatttctggtgggaagatgtatgactttgtcaggtyttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggcggaaggaggggagaggtgcagcacccccattgtgcaggagcgagggga

SEQ ID NO: 68972 - DNA, 601 bp, Human
agagtgctgggattacaggcgtgaacaatggtgtccagcctaaaatctatctttaaaacacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcggggrcattcatttgtcaaacattatttgttgagcacctgctgtgtccaggctctggacgcatagacgtgaaacggacgatttcctgaccttgtggcgctcacagtcaggggggtgggttggtgggtgggcggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagt

SEQ ID NO: 68973 - DNA, 601 bp, Human
accttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggyggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcc

SEQ ID NO: 68974 - DNA, 601 bp, Human
ttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtygtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgt

SEQ ID NO: 68975 - DNA, 601 bp, Human
gtatgccagtcaagaaaccgtggaggctggagagaccctgaagggagcagggcacagttgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggyttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctca

SEQ ID NO: 68976 - DNA, 601 bp, Human
ctggagagaccctgaagggagcagggcacagttgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttcycgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtca

SEQ ID NO: 68977 - DNA, 601 bp, Human
ccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaratcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctg

SEQ ID NO: 68978 - DNA, 601 bp, Human
gtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcratttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggc

SEQ ID NO: 68979 - DNA, 601 bp, Human
ctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcccggccatgtcccggggctgccctcgggtctggagagcctgcyagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactca

SEQ ID NO: 68980 - DNA, 601 bp, Human
ccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcaygcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaagga

SEQ ID NO: 68981 - DNA, 601 bp, Human
acctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaagrccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgt

SEQ ID NO: 68982 - DNA, 601 bp, Human
cctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggycagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaag

SEQ ID NO: 68983 - DNA, 601 bp, Human
tctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcgrctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcc

SEQ ID NO: 68984 - DNA, 601 bp, Human
tccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgacygctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctagg

SEQ ID NO: 68985 - DNA, 601 bp, Human
atcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgygggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaa

SEQ ID NO: 68986 - DNA, 601 bp, Human
tgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacmccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattc

SEQ ID NO: 68987 - DNA, 601 bp, Human
ctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcrgctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgc

SEQ ID NO: 68988 - DNA, 601 bp, Human
ctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagayggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgcc

SEQ ID NO: 68989 - DNA, 601 bp, Human
tgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatcygcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaag

SEQ ID NO: 68990 - DNA, 601 bp, Human
gggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttctttggtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacagg

SEQ ID NO: 68991 - DNA, 601 bp, Human
ggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggt

SEQ ID NO: 68992 - DNA, 601 bp, Human
gatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcckctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctcccc

SEQ ID NO: 68993 - DNA, 601 bp, Human
agctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagayggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagca

SEQ ID NO: 68994 - DNA, 601 bp, Human
acttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattytcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagt

SEQ ID NO: 68995 - DNA, 601 bp, Human
accattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaacwgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagag

SEQ ID NO: 68996 - DNA, 601 bp, Human
gggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgtkagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggt

SEQ ID NO: 68997 - DNA, 601 bp, Human
agtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcaggg

SEQ ID NO: 68998 - DNA, 601 bp, Human
accgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccytccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagct

SEQ ID NO: 68999 - DNA, 601 bp, Human
gcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagytgcatgtttacatttctttccttgttcctctttttcttcttcttcttttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcc

SEQ ID NO: 69000 - DNA, 601 bp, Human
ccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttcctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcct

SEQ ID NO: 69001 - DNA, 601 bp, Human
aggagcctcactgagcagctgctagaactgtgccactaaacaggctttaatttacaggcaataccgactctgggttaactatttctcacagggctccccagctgcatgtttacatttctttccttgttcctctttttcttcttcttcttttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcaracagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgct

SEQ ID NO: 69002 - DNA, 601 bp, Human
aagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctcctycctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttg

SEQ ID NO: 69003 - DNA, 601 bp, Human
ctcttttcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagctygagactggcctgggcaaaatagtgaggccctgtttctacaaaaaaaaaaaaaattaactgggtgtggtggtgtgtgcccatagtctcagctactcaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctg

SEQ ID NO: 69004 - DNA, 601 bp, Human
tcacataaaaatacaccttgaagattatttcttatgagtacgtaagatgggcacctgagtagtttgctgttacagaccacgtaggcaatggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagacyggcctgggcaaaatagtgaggccctgtttctacaaaaaaaaaaaaaattaactgggtgtggtggtgtgtgcccatagtctcagctactcaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtg

SEQ ID NO: 69005 - DNA, 601 bp, Human
ggccgcctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactmaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacat

SEQ ID NO: 69006 - DNA, 601 bp, Human
ctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagrctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtg

SEQ ID NO: 69007 - DNA, 601 bp, Human
gactggcctgggcaaaatagtgaggccctgtttctacaaaaaaaaaaaaaattaactgggtgtggtggtgtgtgcccatagtctcagctactcaggaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggmgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactcca

SEQ ID NO: 69008 - DNA, 601 bp, Human
gaggctgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagwgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttaccttt

SEQ ID NO: 69009 - DNA, 601 bp, Human; identical to SEQ ID NO: 24142

SEQ ID NO: 69010 - DNA, 601 bp, Human; identical to SEQ ID NO: 24143

SEQ ID NO: 69011 - DNA, 601 bp, Human; identical to SEQ ID NO: 24144

SEQ ID NO: 69012 - DNA, 601 bp, Human; identical to SEQ ID NO: 24145

SEQ ID NO: 69013 - DNA, 601 bp, Human; identical to SEQ ID NO: 24146

SEQ ID NO: 69014 - DNA, 601 bp, Human; identical to SEQ ID NO: 24147

SEQ ID NO: 69015 - DNA, 601 bp, Human; identical to SEQ ID NO: 24148

SEQ ID NO: 69016 - DNA, 601 bp, Human; identical to SEQ ID NO: 24149

SEQ ID NO: 69017 - DNA, 601 bp, Human; identical to SEQ ID NO: 24150

SEQ ID NO: 69018 - DNA, 601 bp, Human; identical to SEQ ID NO: 24151

SEQ ID NO: 69019 - DNA, 601 bp, Human; identical to SEQ ID NO: 24152

SEQ ID NO: 69020 - DNA, 601 bp, Human; identical to SEQ ID NO: 24153

SEQ ID NO: 69021 - DNA, 601 bp, Human; identical to SEQ ID NO: 24154

SEQ ID NO: 69022 - DNA, 601 bp, Human; identical to SEQ ID NO: 24155

SEQ ID NO: 69023 - DNA, 601 bp, Human
agtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaastgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatg

SEQ ID NO: 69024 - DNA, 601 bp, Human
agtatttgaagtttaaatagctccatgggacctgtggctgccctgctgcgcagcagtggtctgagtgttgctggatagacaatcgcttcagtaggtgagggcaccatttctcaggtgttctgtgagtttgtgttctgttgctctgatcgtggtagcctccacgtgtagaataaagtgcagtctggtgttcagacattataagaggaactctactactccattctactgagtggctgcttgctttgaggataaagccaaacttggcccatgaggtactcacctctgcccattcagaaacagyctccccaacattctatgtctggttccatatttccacccttccctcttggccctctgcccatctctacttactgaaaccctctgagggccttcctaggattagttattagattgtttctttatcttccttctttgatcctagtggtttattgtaggtcttactatagtctccctttgttttttagttagttgtatatctcacctggatatattcctggtgcttgataaaagggcctgacactagtcagtaaatgagggttggttgtttgcatggcagatggacgtggggctgtgtcaggga

SEQ ID NO: 69025 - DNA, 601 bp, Human
atgctacattttttatttttaattttttgagacggagtctcctgtgtcgcccaggctggagtgcagtggtgcaatctcggctcactgcaagctctgcctcccgggttcacaccattctcctgccttagcctcccaagtagctgggactacaggtgcccgccaccacacccggctagttttttgtatttttagtagagatggggtttcaccgtgttagccaggatggtctcggtcttctgactttgtgatccgcccgcctcggcctcccaaagtgcttggattacaggcgtgagccactgcrcctggctggatgctacatttttaattaatttatttttgttttttggtaaagattgggttttactttgttgcccaggctagtctggaactcctgtgctcaactgattgtctccagcctcccaaagtgctgcgattataggtttgagccgctgtacttgtacttcgcctgatttatttttaaatatattttgaaagattagcttgaaatctttgggtgctaacatagctgcatcttaagtgtgggaggaataaatgccttttggaggatttcttgacccaaatcatccaattccagagtaat

SEQ ID NO: 69026 - DNA, 601 bp, Human
tcacaccattctcctgccttagcctcccaagtagctgggactacaggtgcccgccaccacacccggctagttttttgtatttttagtagagatggggtttcaccgtgttagccaggatggtctcggtcttctgactttgtgatccgcccgcctcggcctcccaaagtgcttggattacaggcgtgagccactgcacctggctggatgctacatttttaattaatttatttttgttttttggtaaagattgggttttactttgttgcccaggctagtctggaactcctgtgctcaactgatygtctccagcctcccaaagtgctgcgattataggtttgagccgctgtacttgtacttcgcctgatttatttttaaatatattttgaaagattagcttgaaatctttgggtgctaacatagctgcatcttaagtgtgggaggaataaatgccttttggaggatttcttgacccaaatcatccaattccagagtaataagataccactttcttctgagtttgatgaacacgattttaaaatgacatgaattaaccccttgaataaggtgcttagcgtttcctttctctttaatatgtattttc

SEQ ID NO: 69027 - DNA, 601 bp, Human; identical to SEQ ID NO: 20616

SEQ ID NO: 69028 - DNA, 601 bp, Human; identical to SEQ ID NO: 20615

SEQ ID NO: 69029 - DNA, 601 bp, Human; identical to SEQ ID NO: 20614

SEQ ID NO: 69030 - DNA, 601 bp, Human; identical to SEQ ID NO: 20613

SEQ ID NO: 69031 - DNA, 601 bp, Human
ttccttactggattgggagataagctgtgaagcttgatgtttaatgcagtaacttgcaaacttgatttacttgaaattgcatacaaatttcctgagcatctaaaaactagccttattactgagctttgcctttcctgctgggagtagtggcaaaattagcactcatggctgtagaaagatcactgagtgaagctctgactcctcctttgccaacacacagcagagcaagaaatacaccttgcctgtcttcatctaggtggcaactttgagggtcttgaatgggactgagcttgccttggtrgtgacatcagcagagaagtcagtagttgaagtcatcttccctttgagagttcaagtgctctcagtatggctgagcatgttggataaggagaatgcagaaaaggacaaagtaatttcatattccatgttaatgacagaagtcttctggctttagtgatcttgaacttttttttctagggtttacactgtgattttgcttgcctgatgttcaaacacctggtacacaaaccatcggaggagagagtaagagaaataattatcaatgctgttcggatagaacaggtaaagtgggtgatgaaat

SEQ ID NO: 69032 - DNA, 601 bp, Human
attaagatttcattccatattcattatataatgtatctacaaatggctagtttggtgccagggactgggcagggtgctgtcccaggggatcctagtccctgcctaaaaagtttaaaggggaaggcagacagatgacaagacagtagctagctggagcgcatgcccagaagttaggtagcaggaacgttagaaagccagcaagctagatggtggttagtcggcaagctagatggttaactggcaagctggaaaactaactaactgaagttttcgattgtgaaatggtaatagaggaaataamcaggatgctgtccaagagaattatggagaggatagggacctaccttaattaagaaaggccactctggagaagtggcttgttcatggaaacctacagaatgaaaggcttcagcctggggagagctggtattggcccatggtccttgcccaagaaatacggccctctctcccagagctcccattgctgtgggaatgagccagtgtatagacagtgaggccagggcatgagatcctcatctcctggtggcaattttgttgctctatcatatgctcaaatcttaatgaaccatcctgatagttt

SEQ ID NO: 69033 - DNA, 601 bp, Human
aaccccccaacttttaagtaagctcaaatttttaaaacaatttctgctttttaaaaatgtaggccaaactaaacccatccctgggccaggtaggaaccgcgggtggtcaacctctactgtagtgttgattgctagagttgcaacttcctgagaagcctttcagaaggcttgaaggcctaggtgtactccctccctttcaccaggcttttttctagcgtttctttagtgcaaagccctcagctggatgtctgctacatggaaatccagcatgtggtcccatcctgaggagccacagcgtgarcccagaagccaactgatgcaatgaaatgttcttgggggtactatgcagtacagcataccctacaaaaacatttcagagtgggcatcatctacaaattcatcatttggtgctgggattttccatttttgtttccttaaattagggaaactcttttttcaggttgaatcttgctcagaaactcagtatgtgaacactcattgctgaaggtttactgactgcatcttctggctcagccctgagtcaggtgctaaggggacattccacttcaggggtcggcataccacagcccgcaggccactt

SEQ ID NO: 69034 - DNA, 601 bp, Human
ataagcaggcagcctgtgcactcacacaggccctgtgctcagaagggcctatgcttgctttcatactgtctcatactctactgtcaccttctcaaaactctttaataactttcgaatgggccccatgatttcattttgcatttggtcctataagttacatagccataacttacatagtctgttttcacacggacgatcttttttcatcctcaggactccccgagaggtgagtgttaccatttgtctccctttgatacaggagtgaacagacactcagagatgggcatttacccaaagccayacagctggaaaggcctaagtcaaaatttgtactcaggtctgcctgagtctggggtgcagaattgcccatcttgtggcacgctgcagctgttgtaccgaaaggcctacagcatgttctggtctctggaggcctaggcatggggaagtttagcctcatggattgtcggtgtctgagggcatataatgatatgggtgtatactcagggccacattttgtgtgttgtagtagtcctagcagcttgctgttttattagggccacaaattgagtcagggagcaggacgggtatttcttctgaagga

SEQ ID NO: 69035 - DNA, 601 bp, Human
catcctcaggactccccgagaggtgagtgttaccatttgtctccctttgatacaggagtgaacagacactcagagatgggcatttacccaaagccacacagctggaaaggcctaagtcaaaatttgtactcaggtctgcctgagtctggggtgcagaattgcccatcttgtggcacgctgcagctgttgtaccgaaaggcctacagcatgttctggtctctggaggcctaggcatggggaagtttagcctcatggattgtcggtgtctgagggcatataatgatatgggtgtatactcagkgccacattttgtgtgttgtagtagtcctagcagcttgctgttttattagggccacaaattgagtcagggagcaggacgggtatttcttctgaaggacacagcaagaagtacgggggccgtgcacagtggctcacacctataatcccagcactttgagtgggggctgaggcaggaggatcccttgagcccagaagttcgagaccagcctgggcaacatatcaagaaagtgtctctaccaaaaaaaagagggaaaaagcagtatgatacagtctagtctcagggcaaactgagattctagct

SEQ ID NO: 69036 - DNA, 601 bp, Human
aatatgctgggcgcggtggctcacgcctgtaatcccagcactttgggaggccgaggcgggaggatcacttgaggtcaggagtttgagggcagcctgagcaacatggtgaaacctcgtctctactaaaaatatgaaaattggccaggcgtggtggcacacacctgtaattccaggtacttggagggctaaggtgggaggatcgcttgagcgtgggaggcggaggttgcagtgagccgagatcatgcactccagcctgggtgacagagtgagaccctgtttcaaaaaagaaaaaaaaaaaaaatgatagaaataccacagaggtggtattgccagtgattgtttagggatataagtgtgagggactattttggccaagagttcctttctgtggttcgggatgaataggacatggagtttgcattctttgtagcagcacaggcaagaatcctgttctgtaaggagtgaggagaggaataagacactgagagtccctcctgtacccaagggcttcacagagtggatactgattttaactgaacatgtggcctatagcgtcaaccctcccaacattgttttccattaacaggacatccaggtcttt

SEQ ID NO: 69037 - DNA, 601 bp, Human
tatttcatcaaaagcttcatttaaagtaaccagagctttaaacttcatccaacagagtctggacttgagcttttaccaaattcctactcccagtagcacaaaaaatgagtgtgaaaaagaaaattcttatagagcaaggaaagtaaaattaaattagtgttaggatgaatgagttggctaagcatacagcctagaggggacaaggaccttttttctgtccaacttttaaaaaattattattaatgcgaaagaagaaagcattggggagctcacatagaaaattggtaaatacagaggagamatgcgtttccctttggcaatgcagttttttagctagaacaacagtgcttttcttctgccttttgaggcacagtaagactggatgattggcaaacagacttgacataagtagagcattgaggcagatcaaaaccttctggatcatttcttcaggaggcaggcctggcaccggggggttcaaacctgctcactgtggcagcattttctaccacaaccaaggaatggccctttgcagttattctgatttttgagtgtgttttctccaagttgttgatactacaacttaataggttcatgaaat

SEQ ID NO: 69038 - DNA, 601 bp, Human
agtgcttttcttctgccttttgaggcacagtaagactggatgattggcaaacagacttgacataagtagagcattgaggcagatcaaaaccttctggatcatttcttcaggaggcaggcctggcaccggggggttcaaacctgctcactgtggcagcattttctaccacaaccaaggaatggccctttgcagttattctgatttttgagtgtgttttctccaagttgttgatactacaacttaataggttcatgaaatagtggaaaactacactcaaggtctctgaattctgtctcttccmagtctcccgctgtacagtggtgttagtgctaatgttcagtgagtccttttgagtgccaggcactgtgccaagcacttgggtggcaccaactcatgtgattctcacaacagatctgtacggtaggtactatcactgtcctttctatttgacccacattctttgaccaaggaagagaacgagaactcacatttgttgaaagcctgctatgggccaaatagttggcaatatcatcaccagaacccttttgttgttcagaacccttttctattgcagttgacaaaaatccatttcaaaatgcct

SEQ ID NO: 69039 - DNA, 601 bp, Human
taagatcatgtgacatccccaagtcgcagcgttaatttttggtggattgtggatttgaacccagacaatttgacttcatagcccactgggttagccaatacgttatcttgtccagaggaggagtagcatgcctggtggcatatacttccctccatagcctacttttatagtgcatgtttatgtgtcaaaaagacactccaggaaaaggggatgtctctgctgctggacatggtgggagtaaactggtttggaaggccagatataaatcatcctttgttttggatttgccaaaatcatgtgraagaaaacttaagaaaccaattatattttcaggtgttctggaagctaactagtggtactcactcagttacatctccattatttgagaagatttttatgttgaataatataacctatttggtcttagtcccagctgatcagtgctagttttcttgatattaaatgtttaatatcttattgaccataattctagcctagaaaaagacttgcaaaagtatagagcagctttacttctcaaattcagataggactgagctaactgcagattctggaacagaaaactggaaactccctaagtggg

SEQ ID NO: 69040 - DNA, 601 bp, Human
cccagcatcaccttatgaatatcacaaagataaatgcacatccaatttcaggtcctccccagaagtgatgatgtagcctgccagactatttcttttatgtacttcgacccccacgtcagtgggcccattatagatatattttagatcctaacagagatgccccagtctctctggtatcttctctgctgctcagtgaaggaagcacaatcagtttcatctaggtctaggagttgggaaccatcttgtgaaactacaggtatttatagaatccctctgattgtgaatcatatcatttactttgttaaatagtgtagcagcttaaaagacagactttggctcagggagatatgtgttctaactgcagctctgccacttcctggccctgcgactaggaagggcccatagggccttagtttccttatctagaaaatgagtctaatgatagcaacttttcatgaggttgttgtgaagattaaatgggggtagtatatgtaaaatgcttagtgtgtgaaatatattaacccattgagaagatgaggaaattcaggctctgagaagttgtcacttggctaagccaccctgcctaagtggttgccttggg

SEQ ID NO: 69041 - DNA, 601 bp, Human
tggttcataattggacacagtacataccagaatccctagagggagtcttcacaatacacagagctatatataccccaccctgcacctgctctgttagaatcatcatgaatggggcttaccctgcctgggtattctaaaagctccctaagccaaagagctatgcactgcttgttaataaccaccatttgactgatactttactgataagagagagagagagactgagagacagactgactgactgttcagggccctccaaaattaaggcatacctaaatcagagtacttaaagtgtcagaargatatatgctgcaaattgtacaatagggggaagtagaagataactaatttgggtcattactaggcctgtcagagtcagtgaaaataatgttacctggcctcagtttcttaaagggcacagacagcacccaggcgttggggaagggatgagaagtaaaagggcagaggtggaaacatgaaatatatggtggggaatcattggattatactttgtagttaaatttgtaaacatactttttcattacaaacatctatttcattgatttccctttttagggtacttacatatacaaatgttcac

SEQ ID NO: 69042 - DNA, 601 bp, Human
gtagttaaatttgtaaacatactttttcattacaaacatctatttcattgatttccctttttagggtacttacatatacaaatgttcactgaagagaaatgataattttggaaaatggctctttgtgatcctagaaatctgattcattcagggagggtctgtaagggtaagttagttgaaagagaattagacctagatagaaaattgaaattgcacgctcagtgacacacgtaagcacttcgagaaattcttttttttctttctttctttcttttttctttctttttttttttttttttttgagaccaagtcttgctctgttgcccaggctagagtgcagtggtgtgatctcggctcactgcaacctctgcctcccaggttcccaggttccaacgtttcttctgcctcagcctcccgagtagctggaactacaggcacgtgccaccacacctgcctaatttttgtatttttagtatagacggggtttcaccatcttggccaggctggtctcaaacttgtgatccacccacctcggcctcccaaagtgctgggattacaggcgtgagtcactgtgtctgggcagcgctttgagaaattctat

SEQ ID NO: 69043 - DNA, 601 bp, Human
aagcacttcgagaaattcttttttttctttctttctttcttttttctttctttttttttttttttttttgagaccaagtcttgctctgttgcccaggctagagtgcagtggtgtgatctcggctcactgcaacctctgcctcccaggttcccaggttccaacgtttcttctgcctcagcctcccgagtagctggaactacaggcacgtgccaccacacctgcctaatttttgtatttttagtatagacggggtttcaccatcttggccaggctggtctcaaacttgtgatccacccacctsggcctcccaaagtgctgggattacaggcgtgagtcactgtgtctgggcagcgctttgagaaattctatctccattcccctgcgctcaaaattagagacaatactgcctccttaagtagatcacagttcagaggtttagaggcattaaaacttgtgtttttcttttccttttctccaaaatccctgcttttgctttttttattcctggatacctctgaaggtcaagaagcataatttctcgtggaaattccctgaaatgagcaagttaaaatacaatgtcatgtgatatgcagctgctttt

SEQ ID NO: 69044 - DNA, 601 bp, Human
tggatgattctgctgtggctaaaattcataaataaatagcttgtatctttaaatcccaaagcatacgtggaatcagtaagttatactgacttttggaaactattataaaataggtaaatgattaaggaaagctttgctaaccctttgatactcctccctttgagatagcagtttataggagtttttgaagaattttgaatgaccagttttactaattctaacaggaatttaggatattcagtgtgttcttctgatttagtatagcaaagacagtgttttaagaacgaagacttttttttttcccctggtctcacctaacacttatgcaaaatatggaaatgctagacagagactgtgaatatatatggtggttgaggttaattagccatgttagaaaaaactcaaaatgcaagagtatttatccagcttgaaagaagtgcttttgaggttggcttccaatcactataaaggtagtatcaattattttatcagatagattttgaatggttagtgcctgttccatgcatgacatatgggaaaagtaggagcaggagagatacgttaaactgtgacttctgcaggagagtgaaaggggttttga

SEQ ID NO: 69045 - DNA, 601 bp, Human
acgtggaatcagtaagttatactgacttttggaaactattataaaataggtaaatgattaaggaaagctttgctaaccctttgatactcctccctttgagatagcagtttataggagtttttgaagaattttgaatgaccagttttactaattctaacaggaatttaggatattcagtgtgttcttctgatttagtatagcaaagacagtgttttaagaacgaagacttttttttttcccctggtctcacctaacacttatgcaaaatatggaaatgctagacagagactgtgaatatatrtggtggttgaggttaattagccatgttagaaaaaactcaaaatgcaagagtatttatccagcttgaaagaagtgcttttgaggttggcttccaatcactataaaggtagtatcaattattttatcagatagattttgaatggttagtgcctgttccatgcatgacatatgggaaaagtaggagcaggagagatacgttaaactgtgacttctgcaggagagtgaaaggggttttgactcaatatatttcactaagggtttttcaaaagaaaatgttccctggttactggtttcccattgt

SEQ ID NO: 69046 - DNA, 601 bp, Human
aattttcttgaactgtgcattctgctaaatattctggagaaacattttggctccgcttactctgttaatgctggttacatcatgagagctatagatttcttgggcatgcaaaatgattgcatattcatgaacatcttcaattctgaaatatttgtaaataacttggcaatttttttcataaggttgcctattaacatgattaggactttaattgttcacacaggaagaatttgtacttacagagcaccacctatttgataagtaacatttctatgctaagcaacttggattatgaacacayaagtcaccttcctaaaacaaagtataagagatgctattttccacttaagcatgattcaagtttgaaaatgtcaatagatgcaaaaagccaccctagagctttgctctctcgaaagaaagaaggaatgacatagtcaatgttaactgtcaccagatgaagagaaatcagattgtcaggcctggatctataaaattcttgccaaagtaggacctcatttacacatacagatcttcataccctttgctaagaaaagcatctgtggcagtttagatgtttgtgcgtttgccaaagatctttcac

SEQ ID NO: 69047 - DNA, 601 bp, Human
agttagttgggtgtggctattttatagcagtactcaagtatcatgataaataagcttaaaacatactttgggcttatgaactgaaagtctccttttgaagtgacaacacgaaataaatgggaatgtggagtcttcccgaatctatacctagtctgtcaacaccaaaaaaatccagttaattcagtcaaactgattatttggcatcatgtagacacagctgtcttgagctaaaattttgaacacttaaagatagatggcattgtacccagagccagctggtacaatggcatctatctataaytgtgtataaaggattgcttaaaacttataagattggaaatagaacttaattgcttaaagttcaagctggactccattgaacagcaattaaaaaaaaacaacaacaacaacaacaaagaaaacccctggtgtgataaaatttcttggcaaatgggtacccttgataaattcacacttttagttaagagtatgctatggtaatttaactatgtaaattgcgttgaatataaaaataaggggaattctctatgtacctttttttaaaaaccatatttaacctggcttgtaggcattaaagtca

SEQ ID NO: 69048 - DNA, 601 bp, Human
gtggaatggggagggcaggcaggaaggtgaaagggctgttgtgatttcactgtcttttcaggtttgaaaggtttaaaatcagagctgttcacaataggaagaatatgctttcttctaaaaagaacagcaaagcagcaacgtaaaggggagaataagaaaatagaaaagctcaccaatactactgtcaccttataattaggtgaaaatttgaagtacttttaaaagagtagtattccttttgggtaactgctaaaagggaaaactggtaataggctacataagaagctattacggctatttyataaacagagatagtaacaggctttataagaaaggacagaaaaagattttgtgtaattaaaaacaaaattgtattatggtaagagagttaaggtaatcttagtctcagatttccagacccatttacctggaataatgatggccagcatttactagttagcactgtgcatggatcattctatttcctgaggtaggtgtatcttattgtccccattttactgatgacgaaactacccatgagaaaactgaggctgtgggtggctacattttgaaatggcaggagtagggtttaagaccaggg

SEQ ID NO: 69049 - DNA, 601 bp, Human
aaatcacagttttttgagattttggtgaagagggagataaaagggagatagccagatttcatgaaaaataattcttatgctagagaccagctgcaggataataatgctgtgttatactctccaaagataggttagttttctagggggcaaatgcagtcattttgataaagatacatggatttggatacaggaagagaacaggcattcttaccaaggtaaatggcaataaagcaataagcaggaaatcaaatggtcttttcaaagggtatggagttaatattgtctgggattgggaagggtsgggaagataagatgggaccttgaaagcctggctaagggaatgtggaatctctccacacgtttctgaggaagggaataacaaagtcagcacaacgtttgaggaaaatcagtctggcagcaatttataccctgagcaggagagagtaggggctggaagatgcagtgtaaccagcacctgtcaaaggccagttctgtgtccgacactgtacatgcactgggtcactaccatgacctaaacccatcagtcatctgtagaacagtctctttaccacaattgtaggctgcctgaactcaggcacta

SEQ ID NO: 69050 - DNA, 601 bp, Human
ctcgttacatcaatttttagggtttgttcagtcttcgattttttgctttattttacacctgttttatgttggccttctcctatgcttatgtgcctgttaagattcaaactgttctttttgagaattctagctttgttacatagggagtaaaatataaacaagcttaaactatttatcaagttctgaataggtaaatttacaatgcatactccattggccagtgtctctttaaagggtttttaacacactaaaatcctgttaactttgaaatggcagttctgatagagaaaagccactcccrgatcagatgatattatcagcatctaaatgagccaggcagtactgcaaggaattacagatgacattattatctacatgacaaaatcagaaggcctcaggcaaaccccatgggttctaataaaatcagatttgacaatatttattacgattttttgtttctgtcattcatctaattggaaaagtgaaacagaggcaacagatcagacaaggggttttagataacaaagagtttggccatattgaatgacagctttaaacaatactgacagctgctcccaagcagtcttggtcaattgcatta

SEQ ID NO: 69051 - DNA, 601 bp, Human
tcaaaagagcatggctcagagcttataaggcagtttcaaaaggcaggtcccaacgtgctaagtttggctagcattgctcatgttcttacgtagactgatttgtgatcacactttattatctcattttagagaagagccaaagggcagccttaaagctccttaaaccagtgttttccaaaccataggttataaactatgttagaacagaatatattggagtttagtaagagtaaggaaagggtaagaactgtcattaaacacactttcccagaaaggtggattgaattaatgcctgtggggtttttttttttttttttaaatggacagctgggaaggactataattatggaaacttcaatttacagtgtccaacaattggagagtcattgaatactgtttctttgaacacacagaaattctttgcttttataccttaaattctttgagtacagtaacttcctccttctagagaagaagtgtacttctccctgggaagtactttgtgaatataaaagacaaccagttcattgttttcattatgtttaatgtaaatactatggaaaacatgcataattactaggcaactcctttgtggaaaaaa

SEQ ID NO: 69052 - DNA, 601 bp, Human
ttttgcacctcagcaagaaacctgttagcaggcactcccaattcctccttctctccagcacttagaaaccctgtatctaccttctgtctctgtggttttgcatattctggacatttcatataaacagattcatactatatgtgaccttttgtgtctggcttctttaatttagcgcaatgatttcaacactcatccatgttgtaccatatatcaatacttcattcctttttatggctgaataatactctaatgtgtggatatacagcattttgtctattcattcatcatttgatggacattstttcttttccgcttctcagctagtatgaataccgctatgagcattcatgtacaagtctttatgtagacagatattttcacttctctttggtgtatacgtaggagtagaatttgctagattatatggtaattctatgtttaaaattttgaggaactatcaaactcttttccaaagtggctattcattttacgttcccaccaacaatatataaagggtccagtgtttccacatcctcaccaactcttactatttaaaaaaaaaaaaaaacagccttcctaaccggtatgaagtggtatccta

SEQ ID NO: 69053 - DNA, 601 bp, Human
cgttcccaccaacaatatataaagggtccagtgtttccacatcctcaccaactcttactatttaaaaaaaaaaaaaaacagccttcctaaccggtatgaagtggtatcctattgtagtttcgatttgcatgtccccaattattagtgatgttgagcatcttttcgtgcttattggccatttgtataacttgtttggagaaatgtctaatcagatcctttaccattttttaactggcttacttttgtcttttgttgagttgtaagagttctttatatattctggatacagatcatttattgmatatacagtttgcaaatattttctcattctgtgcattgtcttttcactttcttaatgtgagttctctaaatttgttcctttttcaagattgttttggctattctttcaacaattgtttctgaattgtactactgtactgcttttgttaaatttattcctaagtattttattccatttgatcctaatgtaaatgaaattgtttacttagttttatttttggattgctcattgctagtttatataaatacatttgtaggttgtatcctacaaccttgctgaatccgtcttttctagtagttt

SEQ ID NO: 69054 - DNA, 601 bp, Human
atggtggcacatgcctgtggtcccagctacatgggaggctgagacagaaggatcccttgaacccagtaggtcaaggctgcagtgggctgtgttcacataactgcactccagcctgggtgatgatagagcaagatcatgactcaaaaaaaaaaagaaaaaattacaaaatccccattgtttataggaaaattgtagcctgatcctaataaataaaaatatgacgttaaacacaagaactttccacactagaatagagattgtgtttttgtaaatggcttttctgaaaggttcttctaaatamcaatatttatagtatatatgaaaatatttcatttttaaatttttagtttaaatgttccatataaaataccttttcaaaagcactgggaaatccttgtataaagcttgttttttgtcagccacagtaaatgactttagttggttgtttaaaaatgcttttattctgtttcatttgaaaatgcattcttgcctcttttttgtttgttttaaactttggtactcaaatacatgtcgcttgttctgtgatttatgttgcaatgctaagtgaataacgtacgtcatctaaggttatctaagtggg

SEQ ID NO: 69055 - DNA, 601 bp, Human
aacagtatgataaaacaaaagtgccagttgagtgtcttcatttcttacagtgctggtgtgggcagaacaggcacctatattgtaatagacagcatgctgcaacagataaaagacaaaagcacagttaacgtcctgggattcctgaagcatatcaggacacagcgtaactacctcgtccagactgaggtaaggagtagctgccagcgtcctcacgacattctggcaaatgctgtaactgaaatttgttaaatgataatgaagagacagattcattcttttagggcttgcagtaatttacagrtttgtattagaagatattctgacaatgatcctattctacggatcacagttttccatttctgtatggatcttaacatttggattcctaaataactacacaagtacttacgaaagagatacagttgtttcaagagctgtgttagatggtagggggagttaaacatgttgtctggcctgagaaatacataggagaggatggttctaaaacccttcattgaacacgattttttgtttgcttattgagttgaagcaataagcacagtatagaataccgtgatccaggcacagtatagaatacaga

SEQ ID NO: 69056 - DNA, 601 bp, Human
ataatttctcaatgtgtaatatgaaaagtatagagatttctgtatcttgaaacttttaacaaaagatacctaatcagtgctggtacaaaaatgcttaaattaagcagaatgcttcttaaggaattaattttattgttaatttcacacatctagtctttgaataaatgttgaaatttcccttaagtgaaaacagcagggttaactagaagtgaactgcacatggagagaaaattgtctgcacagtgctagcagaagtacatctaaaaattagccaaatgtaccgaatgcctttctcaattaytttagtgtagtcaaaacagtgctatcttatttcatgaatatattttactaccacaaagttagaataaaacactcatattcactgattttttttgtcttcccaactgaagggctattataggagcaatgaatttattataactcagcatcctctgccacatactacgaaagatttctggcgaatgatttgggatcataacgcacagatcattgtcatgctgccagacaaccagagcttggtaagtaaagcacatctgctatatattaatgagcccatgaggctacaagcataaattacttt

SEQ ID NO: 69057 - DNA, 601 bp, Human
atagtttttagggatagaattcaaggaccaagcctgcatatctatttttaatcttaaaatggatgaacatttaaagcttgcctgattcaaggctgaaagactttctatgttatcccctcttgaaatataacattgacagatttcttttaaaactgccttgtacatacagccaacctacttactcacacacaatcttccaaaaaagttctatcccttaccatttattagcagagtgattttagataatttatgggccccctccccaaggccttgtgtcctcatctgtaaagacaggtgatamaaaatctcctcagggttaatatacaaaatttgtacagaactcatacaactcagtagtagaatcatgaaatacctgatttaaatatgggcaaaagacctgaatagacatttctccaaggaagacataaagatggccaagaggtatatgaaaagatgctcaatctcattaattttcagggaaatgtaagtcaagataccccacacccattaggatagctattaaaaacaatcaaaagataccaaatgttggtgaggataacaaagaaaactctcacacactgttggtgggaatgtagattgc

SEQ ID NO: 69058 - DNA, 601 bp, Human
ataaatggataaagaaatttgtggggtagggaggaaatgggaagatgtaaaataaatcaagaggatacaaaacaacagatgaggaagaacaagtttagagatctcatatccaacatgaggactacaggtaataaaattgcactgtatttgggaatcatgccaatattgagtacattttagctgttcctgccacaaaaatgaaagtgagatgatgggtatgttaatttgctcctaattatagtaacctttttactatctgtatgtatccaacatcatactgaaaatatacaagaaaacttayagtgtttatgaaagtcctttgcaaaatgcagttcaactacagaattattaacataatccacaggaaataattagcatgtcttgattgcttaagcaattgtgaaataacaaaattaactgacctagatcctgctttcttttttactatgtcaatattacagaatacttctcaactgtaataagtcccctatagtgggagtgtttcaggttgctacactaacaggtgagagatgctagaaaatgattatcaaaatatattttacaatagaatacaataaccattcaacttggtgtagttcga

SEQ ID NO: 69059 - DNA, 601 bp, Human
catgccaatattgagtacattttagctgttcctgccacaaaaatgaaagtgagatgatgggtatgttaatttgctcctaattatagtaacctttttactatctgtatgtatccaacatcatactgaaaatatacaagaaaacttatagtgtttatgaaagtcctttgcaaaatgcagttcaactacagaattattaacataatccacaggaaataattagcatgtcttgattgcttaagcaattgtgaaataacaaaattaactgacctagatcctgctttcttttttactatgtcaataktacagaatacttctcaactgtaataagtcccctatagtgggagtgtttcaggttgctacactaacaggtgagagatgctagaaaatgattatcaaaatatattttacaatagaatacaataaccattcaacttggtgtagttcgatgggaacatataactcttatgaattcagtttaaacgatggcttgagagggatgggaaatgacaaaatccgtatgcaagaaatagaaaacaaatccttgacagaactgcagaggcttttttttttttttttttttttttttttggattccaaaggc

SEQ ID NO: 69060 - DNA, 601 bp, Human
gtgagatactctgaacaccagttccttttcagtttccatcttacctactttctgtacctctaaacatcacttcctgatgggctacaaacacgtcacattcagcatagctaaaaccaaactcatcttcactgcctgcccctaatcaacttaactgtacagaccagaaacatatcagagttatttttgagtctccctcacctccaagtctgattggccaccaagtcttcttggtgccatcgattctttcagtagacttttgaaaatcttttacaatctagtgtaaagtttacatttccagttrtcatcccaatctgccactgaagtacttcctgcatgccaccttgcccctgcaaatcctctttcctctgagcaccctttcattcaatacacagttcaaaagtcactctctgagactctaattcatcccagaggtgctaagcaaaatcattaacatgacaaccataccagataaatgtcattcctgcttatcatgtcacaccataattatttgtatacatgactgtcactctcacattgctgaggccagcaatggtaatttattcatcccagtctccaccgggggaaacccaatgcctgggac

SEQ ID NO: 69061 - DNA, 601 bp, Human
aaaaaatagggtttttttcttaacatcactagttaaataagcattacttttaatggagcccttagaggaagtggcaaacaaaatatcaaagccagtgaatttatatactactgtcattttacctaggttacagattacttataccacttttgcaccaagtccctgtagttttaaatgcaaatccatgaaactcgatgagcattctttaatcccacttagttcctaaacttttgaaagagaatggccctttttgtctttgctctgtcattatgtttggtatgcagaagatatttaaaagtayctgtgcatttgattgatttgacttgcgagtttcttgtcatgtttaagccatattgtataaatacttttaattttactgcttatttaaccgtggctaaatacaggaaaggcaacccatggaaaggtgagaataatctcacatggagtgcatgcatactccgtaaaaacatacatgttacctgacttttctatatggctggccacagatagctttgaaagagctaagaaaaaaggggagattcttaagtttaaccatttcactagaacagattaaacaaatgttaaattcttcccctcctaa

SEQ ID NO: 69062 - DNA, 601 bp, Human
catgaaactaaaaacttaaaagataggatactagtggagtgtagaactgaaatgaaactagaatgtggaagtcacatacagaagttctaacatatgtctaaaaagttatccatggggcaataaaatacaggttaaagaggaagaaataacagctgaggttttctaaaaacagaataaagtattcagttcttaaactgagcgaccaggatacatttgatcagtagcattcagagagatttgaataccacagttaacaagcgtgatctaatagtgatatagagaagttcgcacccaagagagwctgcacagagagacctagagtctcttcaaacacaaatggtttatttatatacataggccataaatggaatttcaatacattcccccaaaacagataccatacaaggctacattcattgattacaacccacttacattagaaaccaccagtgaaataacatcccaaatccttataactagaaacaactagaaactgaaatccttacatctaggattgcttataaataattcatgcatcaaagatgtaaccaaaataagtatttcacagtgtctaaaactaaatgatgatgaaggcactgca

SEQ ID NO: 69063 - DNA, 601 bp, Human
cagaagatttaatgcaatgttgatttaaacaaacaaggcttagcaccagaatggaaatgtataggccaagtcttgcttatttgaacactgatgcaaaaatgacaataaaaagctgtctaataaaacccagtatattaaaagaattacacatcatgaaaaacttatcctagtaatgtagagctggtgttaagcttttgatatattatcaaaagtttatcagtgaattcaggacattttaagagacatttcaaaaaaaaatcgatattgaaaagcgtacaataaaacaacacccattcatgaccccccccccccaaaaaaaacacttagagtaaaaatagaaagcatcctctttacctttataattgttatttaccagatgtatattagcaaacatttaaatttaatattaaaaacttagaagcttgaacatttaagatacatgatacttgctttcagttctagcacgtaagcctatctaggtgctagccaacacagtaaaagcagaagatagaagaagcgtaaaagataaaaagagggaaagttcgcattattggcagataaagatgtggtcaactacctagagaagccacaaactattaaa

SEQ ID NO: 69064 - DNA, 601 bp, Human
agacatttcaaaaaaaaatcgatattgaaaagcgtacaataaaacaacacccattcatgatcccccccccccaaaaaaaacacttagagtaaaaatagaaagcatcctctttacctttataattgttatttaccagatgtatattagcaaacatttaaatttaatattaaaaacttagaagcttgaacatttaagatacatgatacttgctttcagttctagcacgtaagcctatctaggtgctagccaacacagtaaaagcagaagatagaagaagcgtaaaagataaaaagagggaaarttcgcattattggcagataaagatgtggtcaactacctagagaagccacaaactattaaaacttaagcagggttcttctgtttgaccggatacaatttcaccatgtgaaaatcagtaaccttcccatgcatgaagtgaaaccaaacagaaaatgttatcacaaaaggaggccattaataggggtaataaactctaaagtacctaaaaatttaccaaaaatggaattggcaaagactataaagaaaacaataaaacctagttaaaagctataaaaggcctgaataaatggagaaaagacat

SEQ ID NO: 69065 - DNA, 601 bp, Human
tcaggtactcacttaattacttttggaaactcagttaaaggaagatatccattgccacctggaataaaatagctttactgactggagagtgcagtgattcaaagtagactaggcctgggcttttttatctggccgcagcaagtgcagaccagtgggagaaatgaagcgtgcagttatggatgctaacaagaaaggctgctgctccagtgattatttttcttttttaaggaaaaaatgatcccagtaattctcttttgttcctcttttgacacagcttggtggatgtgggggaaagggcagatgaaatgaccagtgaaatcaaaagatgaagtcttcttaaaggactggctctccagcccaatcatctagaggaagagacaagttcagattcttgtagggtatctaaatgcatctgtgcctgaaaattatggccgtttgagaaaaacaagaattcatggtgagacaaagcaacacagactgttggtacaagatacaaagccactaagtcagcgttcagcaaagactgatggatgaattgtcacccagcctaaaggactggcccagctaccaactgcccctgcccagcccaagagggcaagaa

SEQ ID NO: 69066 - DNA, 601 bp, Human
gaaaaaagaaaatttgggatacagaatgaggtacagggcttcgcaagggtctgtgcaagtgagagacccaaagcttaactttgcgagtttcatggtaaatgcatcactgtgcccaagttagctaacagctcatatccccagttttacaagcaatgaaattgaggaccaagtaagttaagtaatttgacgtaagtcataaagcttatactggcaaggataggatttgaacatatggaatctgactccaaatctcacgtattttctttgtgtggcttctaataaaaataaagttgctatcacytattaagcactaactatatcccagaaagatcacaccttaaggttataagaattatttgacaaagcagatgtgatcgttagtccttattatccctatttacagatggggaaaacatgaatcaagtaagattaaacagcccacggtcaccgagctgggacatagtggaagctaggtttcatgcccaggagtgtaacatcctcaatctttcccactgtcccatgctacctaccaccctacaggtaatccaggaaaaagcagaatagcgatgtgtgacttacctctaatgacaacagtatttcc

SEQ ID NO: 69067 - DNA, 601 bp, Human
tacaataatacacatgcagagacaaatccaggttttgtgggtcctgaagcttatacaatttgaagggtccttcttaagaaaaaagaaaatttgggatacagaatgaggtacagggcttcgcaagggtctgtgcaagtgagagacccaaagcttaactttgcgagtttcatggtaaatgcatcactgtgcccaagttagctaacagctcatatccccagttttacaagcaatgaaattgaggaccaagtaagttaagtaatttgacgtaagtcataaagcttatactggcaaggataggatktgaacatatggaatctgactccaaatctcacgtattttctttgtgtggcttctaataaaaataaagttgctatcacctattaagcactaactatatcccagaaagatcacaccttaaggttataagaattatttgacaaagcagatgtgatcgttagtccttattatccctatttacagatggggaaaacatgaatcaagtaagattaaacagcccacggtcaccgagctgggacatagtggaagctaggtttcatgcccaggagtgtaacatcctcaatctttcccactgtcccatgct

SEQ ID NO: 69068 - DNA, 601 bp, Human
tccaagaaatccttagggacagaaaaaaaatgtttgattcagttctgctgattctcaggacactcttctttctattaaaatgatcacaggcgagtgaagaggcatttaatatgtatctcaggcactgtgctaggtgtcaaggcagttcactgggataccagatgaaatgtaacgtaaactcctgcctttccaggcctaagggaggaaaaggaactgctgggtctctgcaaagctctctcttcatgaaggcccaaacgcttgtaaggaaatgccttattaatgctcacaatatcccctaggtagagggtgtgggaaaaagagaagtactattatgcctctcttgcaaatgagaaaattgaagcagaaacaattacaggccttgcccaatacgaggcagtcaccactgaggccaaaaatgaaacaaaattgtcttggttccttccacgatattcactggccaaaattaaaagtctctcttcagttacctctggtcactgcagggttcaaggacaattatcatttgagacaactttttggataggaattctcttactaagcttcccacacctactcatttgaatttcatcccttttccctcttc

SEQ ID NO: 69069 - DNA, 601 bp, Human
ttacatacacatcaataaagatgttttgctgatttgactttaaaaaacaagatcccatagtcaccaatcaaagcaatctggttatcagtgattacattttacttctttttttatttttatttttattttttttgagacagagtcttgctctgtcgcccaggctggagttcaagggagccatcttggctcactgcaacctccgcctcccggattcaagcgattctcctgcctcagcctcccgagtagctgggactacaggcacctgccaccatgcctagctaatttctgtatttttagtagmgacagggtttcaccatattggccaggctggtctcgaactcccgaccttgtgatccacccgattcagcctcccaaagtgttaggataacaggcgtgagccaccacgcctggcctatattttacttcttgaggaatcggtagaacagctccagagtttctatggctcccaaaagaaaccagctggtactgacttgcccagagcctcaggtccagatgaaggggaagtgtatttgtcctgttcattgcatctctgagacctaatgctacagtcctgccttgacctgtgaagaggaagtcaaag

SEQ ID NO: 69070 - DNA, 601 bp, Human
acaatgtagcatgagaggtgagggatggccatagaatttattgtccaaagcagaaatcttttggaggaaagggggtgttagtgattacaccagcacaacaggtacacagaaaccatgtaggactattccaggcaaatgggatgtatggtcatccttgagatgggaaaagtgggttcaggatcagaaggctagctggcacgctctctccttccctctccatttgactttagataagtcacttctattccaagagcctcaatttccttgaccgtaagataacagatttaagatatctttacargtttttttctgatcaagaaaaatctcagactaagataagtcttctttgaatagaggcaactcaggagatgaggtagatatgcaagaaggagccttttaaaatgatatatagctgaatgcctttacatacacatcaataaagatgttttgctgatttgactttaaaaaacaagatcccatagtcaccaatcaaagcaatctggttatcagtgattacattttacttctttttttatttttatttttattttttttgagacagagtcttgctctgtcgcccaggctggagttcaagggagcc

SEQ ID NO: 69071 - DNA, 601 bp, Human
attaacgacactgcctccgtttacagtgctatagtttcttcctgtgctgagccaatcacattgctccgttataaacttggaaaagagaaactaggagatgaagcatgtctatgagaggtcaacagctggaaagtcacactgaggcggggctgagcaagcccggatgagtacagagccaggctgagtaaacagaggaagcctgttggtggagaaagcagaggaaaaagtgggaggcagagtgtgcctgcttcctgctgactttccactttcggttgtcctctcaggaggccttactgtgccrtggttcttgccctttgatttctatgagcttccccttccagatttacagaaacaaaaaaaagaatcctatcttgccagagctagtttgagtaggcctcaactccttaagagagccaagaagcgggatacattgtggtctgtaaggacaatgtagcatgagaggtgagggatggccatagaatttattgtccaaagcagaaatcttttggaggaaagggggtgttagtgattacaccagcacaacaggtacacagaaaccatgtaggactattccaggcaaatgggatgtatggtcatcctt

SEQ ID NO: 69072 - DNA, 601 bp, Human
gtgaactgtactttgtttataaattacatacaggacaatatggtggaatgacaatcccaaaaaacctcctgctacaaaatacccactaacttatttttgaaagtttctaggtgattacaaatgtacagccaagtttgagaactgatgacctaaagggaaaaaaagcagctaccgatagaaacttaaacatagaaccaggtgaaaattgggagcgggaggggaatatatatatacatatatggggagtggggaggcgggtgagaaagaggagtttcagatgtgaataaataagaaataaggmcacggaaacaaggcccacattctgtgtgtaacttgcacagccagtctcattattttgcaacctgtttggttgtgattatatctctcaaaattgaaataagtaatattttcattacctacctatttctatgtctcctcttccactactgttgattatcagaagtacagtgttaaaagaaaatatccttaaaatgggaattgtgggcgctgggaggactggtgagatgttagtcaaaggacacaaaatttcagtttgatataaacaaattcaagagatctaatgtacatcatggtgatcaca

SEQ ID NO: 69073 - DNA, 601 bp, Human
acaagatggcccagagagggctctgttttgacttaaacttttaatttctgccccttctatttctgatcctcagggcattcaagtgtgcactcccaggagcttgctcggcaaaggaaggcctgagaaactaacaaataataacctcagcctcaagaccgcggactgtctggcacaggaagttattcattccgccagatacaacgagctagtgtccccctcaaaggcgccctttgccagtctgaacagaaagccatggcttgggaacaactgatcttcctcaccgagggttctgctgtggtgrtgacagccaccagacaaaccttgtaatcagctgagtcttcttagttacactaaatgaaaaagcaacataaggccttaaatcagttttacagtgtgactctggatattaagagtggcactgtggagtcacaatataactgttgcttattagttttaaccaagacgaacataatgaatttttccacgcacaatactgtggcactaccactaaaacaaaatactggaaaattatcaagttctatggtgaattcacagtgtcaacagctaaattaataattggactaaaaaacatacttttcag

SEQ ID NO: 69074 - DNA, 601 bp, Human
agaccatgttacagctggggcttctcctctgtctccctccacccccacagcccttctctgcctggccacttcttagttgagtcaccagcactcagacaaatcctcatagccccttttactcccttcaaatcttgccctcaagagtggtggcttttcctgctgctttcatatgtctcttttcctccaccttacaagttggatgtttgtcaggaaaccctctgtcaatcccagagtagatcacgtgctggagagtgagtgagtgtgtgtgtgtgtgtgtgtgtgtgtgtgtgtgctcatgcgratgcactaagtaggaagagagatggggaatgagagaacagagggaagttgtaaatacagctgctaacatttctaaaacagtgtgtctttatttttattttctcactttcagctcagagaatggcagttactattcagttaccattactgccacgccagctgcaatctactgtgagtctgctaaagtcaggtgctatgctaggggctttataatgtaccttatctctgagttttacactgacactacaaaataaaaatccccattttgcagacaaagaaatggtggcactggctgtcccaa

SEQ ID NO: 69075 - DNA, 601 bp, Human
aaggccttaagatgcatggcaagtttctatctgccaccttgaagttgccacccttggaaaagagaagagcaggccacaggtagctgctgatccttcagcctaggttctaaaacggagatgtgtagactagtcctaaagcggaccagaagcctggagtccagcctcgttccactgagccagctgagctggctgcacacccacatattattgttataagcaacgagactggggagttacttgttactcaccgtggcagtagaggcctgataaatacagcgcctgaggttaacagaaacctaasacctggtattcccaacagtcctctatctgttaatggagaaaagccttgtatttttactgtaaaaacggctgaaatacaaaaataatataaaagcacagactgcaaataaacaaaccaaaatgtgaactttgagtgtcgagaatttgtatcagttataattcaggtccggattaggaggagtcttccactcactgttgcttttgtttggatttttacaccagaaataaattacttctgtaagcagaaaaaaaaatgttcccttatctttttttttaagtgaaaatctaagaaactcagatt

SEQ ID NO: 69076 - DNA, 601 bp, Human
accaacaggatgtgggtggaatggcaatgtatcaatttggagctaaggccttaagatgcatggcaagtttctatctgccaccttgaagttgccacccttggaaaagagaagagcaggccacaggtagctgctgatccttcagcctaggttctaaaacggagatgtgtagactagtcctaaagcggaccagaagcctggagtccagcctcgttccactgagccagctgagctggctgcacacccacatattattgttataagcaacgagactggggagttacttgttactcaccgtggcagyagaggcctgataaatacagcgcctgaggttaacagaaacctaacacctggtattcccaacagtcctctatctgttaatggagaaaagccttgtatttttactgtaaaaacggctgaaatacaaaaataatataaaagcacagactgcaaataaacaaaccaaaatgtgaactttgagtgtcgagaatttgtatcagttataattcaggtccggattaggaggagtcttccactcactgttgcttttgtttggatttttacaccagaaataaattacttctgtaagcagaaaaaaaaatgt

SEQ ID NO: 69077 - DNA, 601 bp, Human
tagatttgaccaacaggatgtgggtggaatggcaatgtatcaatttggagctaaggccttaagatgcatggcaagtttctatctgccaccttgaagttgccacccttggaaaagagaagagcaggccacaggtagctgctgatccttcagcctaggttctaaaacggagatgtgtagactagtcctaaagcggaccagaagcctggagtccagcctcgttccactgagccagctgagctggctgcacacccacatattattgttataagcaacgagactggggagttacttgttactcacygtggcagtagaggcctgataaatacagcgcctgaggttaacagaaacctaacacctggtattcccaacagtcctctatctgttaatggagaaaagccttgtatttttactgtaaaaacggctgaaatacaaaaataatataaaagcacagactgcaaataaacaaaccaaaatgtgaactttgagtgtcgagaatttgtatcagttataattcaggtccggattaggaggagtcttccactcactgttgcttttgtttggatttttacaccagaaataaattacttctgtaagcagaaaa

SEQ ID NO: 69078 - DNA, 601 bp, Human
actcccctaagggtgaagtattctccctgcctcactgacttcaggctaggccaagtgactagatttgaccaacaggatgtgggtggaatggcaatgtatcaatttggagctaaggccttaagatgcatggcaagtttctatctgccaccttgaagttgccacccttggaaaagagaagagcaggccacaggtagctgctgatccttcagcctaggttctaaaacggagatgtgtagactagtcctaaagcggaccagaagcctggagtccagcctcgttccactgagccagctgagctggctgcacacccacatattattgttataagcaacgagactggggagttacttgttactcaccgtggcagtagaggcctgataaatacagcgcctgaggttaacagaaacctaacacctggtattcccaacagtcctctatctgttaatggagaaaagccttgtatttttactgtaaaaacggctgaaatacaaaaataatataaaagcacagactgcaaataaacaaaccaaaatgtgaactttgagtgtcgagaatttgtatcagttataattcaggtccggattaggaggagtcttccact

SEQ ID NO: 69079 - DNA, 601 bp, Human
gccaaggcgggcagatcacttgaggtcaagagttcgtgcttggtcaacatggtgaaaccccgtctctactaaaaatacaaaaatcagccaggtgtggtggtgcgtgcctgtaatcctggctagtcgggaggctgaggcagtagacttgcttgaacctgggaggtggaggttgcagtgagccaagatcgtgccactgcactccagcctgggttacagagcaagactctgtctcaaaataaattaactagttaattaattaataattgtaaaggaagggtactaaagacagcacttgggcagmagcatgaagcatagtgtttccaaaacctagggcacagattgagtgcctaaagggcctgctggctttgttatttttgaagattccatggatggtgtatcttctgtagaagttaagcaattctgaaaagcaccatacactcccagtttgcccagatgagagaataacaaggggaagggcccaagaaggccagttttggtcctttttcaagtcaaaccacatccatccctaccgcctccaccaccaggggctttaaatgtattttcttattggatccccaaaaaccctaaaatggaactgcct

SEQ ID NO: 69080 - DNA, 601 bp, Human
ggtgacattgaagaaatagaactgagtatacacaggcagagggggcttctcccaggagtcaaatgcctcagtaccattccttaacacaattttctaggaaaaaaccaaaaggagatttacaaaaatgtaaggcaatagttggctttaaacccaagaagcagaggaagggacgccccctattctgacctcctagatcactattttaatcatttcacaggcattcaactgcagtctcctgagaacagggccatatcttacaccaatagagcccacagttctaataagtcagagaaggccttcrataaatatttgtaaaggggccgggcccagtggcccaacactctgggaggccaaggcgggcagatcacttgaggtcaagagttcgtgcttggtcaacatggtgaaaccccgtctctactaaaaatacaaaaatcagccaggtgtggtggtgcgtgcctgtaatcctggctagtcgggaggctgaggcagtagacttgcttgaacctgggaggtggaggttgcagtgagccaagatcgtgccactgcactccagcctgggttacagagcaagactctgtctcaaaataaattaactagttaa

SEQ ID NO: 69081 - DNA, 601 bp, Human
aggactcaggccatattggggtcactctgtatttctttcaagacaggaggtggtcaagacttacctgtaggtgtatggccccacttcttccacccgaggggtctcccctctgaggatctcctctggattggtgacattgaagaaatagaactgagtatacacaggcagagggggcttctcccaggagtcaaatgcctcagtaccattccttaacacaattttctaggaaaaaaccaaaaggagatttacaaaaatgtaaggcaatagttggctttaaacccaagaagcagaggaagggacrccccctattctgacctcctagatcactattttaatcatttcacaggcattcaactgcagtctcctgagaacagggccatatcttacaccaatagagcccacagttctaataagtcagagaaggccttcgataaatatttgtaaaggggccgggcccagtggcccaacactctgggaggccaaggcgggcagatcacttgaggtcaagagttcgtgcttggtcaacatggtgaaaccccgtctctactaaaaatacaaaaatcagccaggtgtggtggtgcgtgcctgtaatcctggctag

SEQ ID NO: 69082 - DNA, 601 bp, Human
actgaagcaacagcatgaatactggcaaggcagtgtgtctggggagcttataaatcatgggagtggccaagcatggtggctcacgcctgtagtcccagcactttgggaggccaaggcgggtggatcacttgagaccaggagttcgagaccagcctggtcaacatggtgaaaccttgtctctactaaaaatacaaaaaattagccaggcgtggtggccgtgcctgtaatcccagctacgggggaggctgaggcagaagaatcacttgaacctgggagacaaaggttgcagtgagccaagatygcgccactgcactccagcctgggagacagaatgagactctgtctcaaaaacaaacaaacaaacaaacaaacaaacaaaaaatcatgggagtatggttggaattatgctgtctaatagggtagccactagacacatgtggctattgcacattcaaaatgtggctagtctgaaatgaaatgttctataagtgtaaaatgcacacaggatttcaaagacagtataaaaaaagattgtaaagtatctcattaataattctaaatattgctaacatgttggaatgacactattttggatagtttg

SEQ ID NO: 69083 - DNA, 601 bp, Human
ttcaagtgattctcctgccttagccggtgtgtgccaccacacccagctaatttttttttctttttgtatttttagtagagacagggtttcattatgttggccacattggtcttaaactcctgacctcaagtgatctgcctaccttgacttcccaaagcactgggaatataggcatcagccaccacacccaaccaaaagggttttttaaaaagtcccttataaaaccatcagatctcgtgagaactaactcagtatcaagagaacagcatgagggtagctgcccccgtgattaaattacccycctgggtccctcccatgacatgtggggattatggaaactacaattcaagctgagatttggctggtggggacacaaccaaaccacatcaacataccactttacaagtgctataaagtggtatacttgacacttttttttttttttttgagatgggggtcttaccctgttacccaggctggagtgcagtggtgcaatctcagctcactgcaacctccacctcccaggttcaagcgatgctcccacctcagcctcccacgtagctggggccacaggcacatgccaccacgcctggctaatttt

SEQ ID NO: 69084 - DNA, 601 bp, Human
ttcattttcagggcctgattcccctttcttgaacctatatttgggtttcctgaactaagtcctatggttccggctattaggtgggtgcaaagtaactgcgttttttgtcattacttttaaatactttttaataattgtgtcctatagtgttagtttttccatgtgtcctatgaatttaaaccacagttgaagatgtttaatttacatattccacaaatattcattaaatagtagacagtcagagacgaaaggacttggtcactgcaccccatggagcttccagtacattgggaagaaagasagatacctaagccaattattaaaatgcaattagtcactgtcataatggatgcacatatttattagtctgttctcatgctgctaataaggacatacctgagactgagtcatttataaaggaaagaggtttaattgactcacagctcagcatggctggggaggcctcaggaaacttacagtcatggcagaaggggacacaaacacgtcctttttcacgtggcagcagcaaggagaagtgcccagcaaaagggtttttgtttgtctgttgttgttgttgttgttgttgttgttgttgtttgag

SEQ ID NO: 69085 - DNA, 601 bp, Human
aatatgtccctgagcaaaaggatcatgaggccaatgagccttgtattcacagacccattccagggctgctcaatctgcagctttacaaaaatgtaaataatacacttcattccttaaaccagactggctgttatcaacatttggaatgcccatcatctttttccaaaaacattactatgctgaactccccagtatgtgaaaggtttgggaaatgtgccactgtaaatcctgtgtcagatgagtccacagtcttgcttggcccttccccatctcagaggtttcccaccaccataccaatccrtactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatcaaatccagtgaatgaccgcaaaaggcacatgtagagactaacaggccccatagaaggtttggacagctccctaaaaagccatgtttttctacaaatcccagatctcacgacccactcagccct

SEQ ID NO: 69086 - DNA, 601 bp, Human
aaatatgtccctgagcaaaaggatcatgaggccaatgagccttgtattcacagacccattccagggctgctcaatctgcagctttacaaaaatgtaaataatacacttcattccttaaaccagactggctgttatcaacatttggaatgcccatcatctttttccaaaaacattactatgctgaactccccagtatgtgaaaggtttgggaaatgtgccactgtaaatcctgtgtcagatgagtccacagtcttgcttggcccttccccatctcagaggtttcccaccaccataccaatcyatactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatcaaatccagtgaatgaccgcaaaaggcacatgtagagactaacaggccccatagaaggtttggacagctccctaaaaagccatgtttttctacaaatcccagatctcacgacccactcagccc

SEQ ID NO: 69087 - DNA, 601 bp, Human
ttttatacaaatatgtccctgagcaaaaggatcatgaggccaatgagccttgtattcacagacccattccagggctgctcaatctgcagctttacaaaaatgtaaataatacacttcattccttaaaccagactggctgttatcaacatttggaatgcccatcatctttttccaaaaacattactatgctgaactccccagtatgtgaaaggtttgggaaatgtgccactgtaaatcctgtgtcagatgagtccacagtcttgcttggcccttccccatctcagaggtttcccaccaccayaccaatccatactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatcaaatccagtgaatgaccgcaaaaggcacatgtagagactaacaggccccatagaaggtttggacagctccctaaaaagccatgtttttctacaaatcccagatctcacgaccca

SEQ ID NO: 69088 - DNA, 601 bp, Human
ttaatgcttgaaatgttaaatggtaggcaaaatagaaaaaggtatctgacaagataaaaaataaacctcaaaaaggctgcagaagccatgggataccacaactttgatacaaattttatacaaatatgtccctgagcaaaaggatcatgaggccaatgagccttgtattcacagacccattccagggctgctcaatctgcagctttacaaaaatgtaaataatacacttcattccttaaaccagactggctgttatcaacatttggaatgcccatcatctttttccaaaaacattactatkctgaactccccagtatgtgaaaggtttgggaaatgtgccactgtaaatcctgtgtcagatgagtccacagtcttgcttggcccttccccatctcagaggtttcccaccaccataccaatccatactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatca

SEQ ID NO: 69089 - DNA, 601 bp, Human
aagaccaaaatataacattgaaaaatcctatgctataacattaggtgaataaaaaatatgtatattttgtatatgtacatgcatatgtacaaagtatgataaccatctaaaactcatccatggaaaaatggccaagaagatatccactaaaatgttagttagcattggttatttttgagacagtgaagccatggattagtagtttttgttcaaaactttactgcattttcaagttgatctttagtgattatatatatggaacacatatatatgtgtaatttttataatataaaatatagtytacactcttaaagataatgctgtatatattatatatgttgattatatttgaaaatccagtattacttgttatcaatgaataataaaataacttaagatctagcccttacatctttttaaataatacaagcctaaaatagaaatgaataatccaaacagcaaaactaagaaaccccaaaataagatatttcacgggatactgtaaatttagtaaatacttcttagaaatacgcaaattaattggaagtgcccttagacaaattgttttcttttttaatgcttgaaatgttaaatggtaggc

SEQ ID NO: 69090 - DNA, 601 bp, Human
tattttggcaaaacaaatacagttttagctaccaatctaaaaacactatcagagaaaagcgaggcaagtttagaaaaaaggagaaagcattctcctataataatggaaacaatgatcacggtgttcctaaattttttgttgtctctttatgttaaaaaaatttcttatacagcttggctcagacacggttaaagaactaaagggttaataggacagaattagacagtataaacaaaattcctgcctttgctaaattgcaaggaagacacttagatcctgaagaaattaaatgtggaaaaayagaactataagaaaatcgacttgaacatcaaaccattgaagggagtaagacttttaaagctcagacctgatagaaatgttgaaaaagaatagacttgactacaacacattttaaaaattgacaaggtaaacaatggaaaagcagttgccccaaatgaaacataaaaggttcacagagtgccatgaacactccagaacccagataagcaaatggacaaaggacaagaactaaaagtgtggaaacacaactggctggcaaacatgaggagaacattcaacccacgaggtaaccagaggagaa

SEQ ID NO: 69091 - DNA, 601 bp, Human
aaaagtgcccggcatggtccctggtatttagtagatgctaatgaatctcagactatagtataacatttgtgcattactatgacggtccttgtcattaagacaaggttcagttatgctccatgaactatttaatcaggcaggaaaattcatggttggttttagaaataattttagaaacaatagactgagataaggagtggaaatcaaaaggaataattttaattaggtggaaaattaacatcggtatatctaattcctcagaggtgtttgataaattggatgcgtataatactatcatagwatcgttatctttcagtcatattggttccttcattcacctaatcctctgttgagaattactattaagaagtgattgggcatacactggatacaaactagactgagatctggctggtagggttaacattcaaccctggtttcatcttactcactgcttctgtgcctcagtttcctcatctgtaaaatggaggtaataacgtactcaccttgtagggttgttgtgagaatgaaatccacataaatccagttacaacactacctggcacacctgctgcttaggagggattagctactgatacca

SEQ ID NO: 69092 - DNA, 601 bp, Human
tgctttcctctcttgtattgtacagctgtgtaagaccatcagtcaagggtgctatgggacctgagctcaaccaattcctttcctctggcctctgaatcctgagcacagtgcctcaagatagaaaacacagtaaaagaaccaggcgtggtgacatgtacctgtagtgtcagctacttgggaggctaaggtgggaggatggcttgagcccaggagtttgacgttacagtgagctatgatcatgccactgcattccagcatgagcaacagagcaagactttgtctctaccaaaaaaaaaaaaawttttaatttaaaaacaagaaaactcagtaaaagacaggattcctcccagtggcagacacatgatgtgatgatcaatacactctcgtgacctggatctttaaagctgccctgcatcctgcttttgtcttccaagctgctttccttgattctgttaacctactttatagccttcaaatagattcccgttttacttaaattagccagaggtagtttattttgcttataaccaaagacccttcacttagaaatcattaactccacctttttatagataaggatatgtggattcaggaccaatcg

SEQ ID NO: 69093 - DNA, 601 bp, Human
ggaagcatacttcctatcacatatacacatatcacacatcatatcacactaaacaccaagctatgcccactaatcctataaatagctgacccttgcatagctcttcaaagagtttaacccacattattttattttatttaatccttacaagtatgtagtacaaatacagcatgtagtattgccccacttcacagttggggacacagagcacaggcagaagagtgagaacttgatcccaagtctttctcattagcacaaggtgctcctctctctgtatgagacaacctctcctaacaggtayctaagaaacgcctgtaggatgaaaccagctaatgcctctaacaaatgcctctaaccaaagccaaatctaatgataaattacatgcccttccagtttacaaagaatatatttaaaaatttgatagacacttccgtgttaaaccacttacacagcttgaagttcagtgtttgcagtggacttttcatttgttagacaaccattccgctttctgctggtaatagccctgatttgctttcctctcttgtattgtacagctgtgtaagaccatcagtcaagggtgctatgggacctgagctcaac

SEQ ID NO: 69094 - DNA, 601 bp, Human
cgattccaaggatcttaggagctgtatgccaggaaatggaggaagactaaatatatatttcatcatatcacatgtctatatcctatactctgtcaagtgtatagaaggaagcatacttcctatcacatatacacatatcacacatcatatcacactaaacaccaagctatgcccactaatcctataaatagctgacccttgcatagctcttcaaagagtttaacccacattattttattttatttaatccttacaagtatgtagtacaaatacagcatgtagtattgccccacttcacagytggggacacagagcacaggcagaagagtgagaacttgatcccaagtctttctcattagcacaaggtgctcctctctctgtatgagacaacctctcctaacaggtatctaagaaacgcctgtaggatgaaaccagctaatgcctctaacaaatgcctctaaccaaagccaaatctaatgataaattacatgcccttccagtttacaaagaatatatttaaaaatttgatagacacttccgtgttaaaccacttacacagcttgaagttcagtgtttgcagtggacttttcatttgttagac

SEQ ID NO: 69095 - DNA, 601 bp, Human
tgggaggttggggggtggggctgaaagtcccaaccctctaatcctgtcctcttctttcaggaccagctcccatccaggagccatagaggctgccagtcatcagtcaattcactagcatacaaaaagacacttatcacttaagcgattccaaggatcttaggagctgtatgccaggaaatggaggaagactaaatatatatttcatcatatcacatgtctatatcctatactctgtcaagtgtatagaaggaagcatacttcctatcacatatacacatatcacacatcatatcacactaarcaccaagctatgcccactaatcctataaatagctgacccttgcatagctcttcaaagagtttaacccacattattttattttatttaatccttacaagtatgtagtacaaatacagcatgtagtattgccccacttcacagttggggacacagagcacaggcagaagagtgagaacttgatcccaagtctttctcattagcacaaggtgctcctctctctgtatgagacaacctctcctaacaggtatctaagaaacgcctgtaggatgaaaccagctaatgcctctaacaaatgcctct

SEQ ID NO: 69096 - DNA, 601 bp, Human
cattcatatagatgcatacaaatagatgagtctttgtatcttctccagtagaaaaaacaaaccatttttttctgtgctctcatactgtaacaacttacacagaagacttctaagacttctgagacttctggtcaccaagaagtgtgtggcgttttctctgcaccaataattctgcagtgtcctccaattcaattcaattctgatactttctacttggacatagcatcagattctacaggttgagactgccttccacctcctatgccaatcaaaagccccaggctgttttacctgtgcttcygaactaatggctataaattggggttcccatccccctgtgcttgggctcaattaatttgctagaacagcccagagtactcagggaaacacttacattttattataaaggatattacaaagtatacagatgaagagatgcactgggcaaggtgtaggggaaggagctcagaacttccatgccctctgcaggctcgctactctccaggaacctccccatgtttggttctctggaaactctccaaattcagtccttttggttttttatggaagctacattacataggcatgattgattaaatca

SEQ ID NO: 69097 - DNA, 601 bp, Human
actagaaaatcttaaaatcttaaattacacatgtggttcatgtaatatttctattgaacagagctaatttaagagcacaggttaggaaggcattggccagctgggctacccacacctcctctgaggcctttcccaaccatagcagcacagggatttttctcacccacctgtggatgtccgtacatgtctttagcattcaattagaaacttctgagtgacatcatttagattgtgaaattatcatgtagcctcaggtagactgcaagcaagctgaaggctgaaactggtacgtaaaaatgckcctcggtgatgatggagttatgtcccagtaaacccatcataagttgaaaacatcgtaagttgaaagtttgtttttgattcaacaacttagtatctttccaatttacaatgggtttatctggatgtaactctatcgtcattggaggggcatgccaaatacatatcactttcacacaatcgcgaagtcaaaacatcattcaagttgaaccatcataagtcaaggaccgtctgtatattgtatctctttatacctcttaaatcccttctagactttaaaataaaaacagatgagaaaataaat

SEQ ID NO: 69098 - DNA, 601 bp, Human
attttaaataaaaacagaatctgatcttttgttcatcaaatgcctcacactagccctagccctagccctgcctggtacatagtaggtgttcaataaattccagtgacttttgtttctttccctttgcttatctttccttcttcctaaaccagctagggttattatgtctgacatggtagccactagtcacatgtgactactgagtacttaaactgtggctaactggaattgagatttgctgtaagtgtaaaatatatacagaatttcaaaaacagtgccaacctttttttatattgattayatattgaaatgatgctatttcagttataatgggtaaaattaaaatatattatcaaaattaattttacctgcttccttctactttttaaaaaatgtggctactagaaaatcttaaaatcttaaattacacatgtggttcatgtaatatttctattgaacagagctaatttaagagcacaggttaggaaggcattggccagctgggctacccacacctcctctgaggcctttcccaaccatagcagcacagggatttttctcacccacctgtggatgtccgtacatgtctttagcattcaat

SEQ ID NO: 69099 - DNA, 601 bp, Human
agtacagaagcatgccaccacacccagctaattgttttatttttttgtagagatgaggtcttactatgctacccaggctggtcttgaactcctggactcaagtgatcctcctgcctcgaccttccaaaatgctggcattacaggcatgagctaccacacccggtctctgtttctgatatacagcacagtttggttcaagttagagcccccaaatgaagcattagaaagttcttagaaagcgcctggtgccagggctgggcctagagtcagtgtgagtgatgtaagaggtgcctaaacaagyagtaatcaagataaatagtttaatgcactatttattaaaaccaaaatttatgccaaaaatttatgatgaacaaaattttaaataaaaacagaatctgatcttttgttcatcaaatgcctcacactagccctagccctagccctgcctggtacatagtaggtgttcaataaattccagtgacttttgtttctttccctttgcttatctttccttcttcctaaaccagctagggttattatgtctgacatggtagccactagtcacatgtgactactgagtacttaaactgtggctaactgg

SEQ ID NO: 69100 - DNA, 601 bp, Human
ccaacataaaaatctgaagtaagaaatggtatacaaatttcactgctagaatttctgaatgaaaacaaggggcaaataaacatttttaaaattattagctaccaaaaaatcctaggggcatatttatttgcacaattgctaatcctgaacacccaggaagaaattatgaaaacaaatcctaaaatctgaattttgtcatcatttgaaaagaccttatttgatacatcttagaaaaaagtccaagatgtactttaaagaaaagaaaaaaagtatttttctttttatatatgtatatttcaasataacttaatggctcctaaatgtaaaatcataaagagcattaacttagctttttcctttcttccaaaatccaacttaatggtattaaaatgcctacttaccaatacaggaatatttaatgttctaattaagtcaattttagggtctccaacagattggtctcgttcaaaaacataggccttgttgctaacagcagatattgttgttccattatctccaaattgaatatttgctttgtttctgagttccctaaaagaaagaaaagggttttatttgaaaatagacaccactttaataagca

SEQ ID NO: 69101 - DNA, 601 bp, Human
tggtgtcaatttatgaattttgagagtataaaatccaacataaaaatctgaagtaagaaatggtatacaaatttcactgctagaatttctgaatgaaaacaaggggcaaataaacatttttaaaattattagctaccaaaaaatcctaggggcatatttatttgcacaattgctaatcctgaacacccaggaagaaattatgaaaacaaatcctaaaatctgaattttgtcatcatttgaaaagaccttatttgatacatcttagaaaaaagtccaagatgtactttaaagaaaagaaaaraagtatttttctttttatatatgtatatttcaagataacttaatggctcctaaatgtaaaatcataaagagcattaacttagctttttcctttcttccaaaatccaacttaatggtattaaaatgcctacttaccaatacaggaatatttaatgttctaattaagtcaattttagggtctccaacagattggtctcgttcaaaaacataggccttgttgctaacagcagatattgttgttccattatctccaaattgaatatttgctttgtttctgagttccctaaaagaaagaaaaggg

SEQ ID NO: 69102 - DNA, 601 bp, Human
acaaagagaccatttgcaggctctgagttatccagacaccacaaaaggggaaaagctcttgtaaacatgtgggcatctttggccacaaggtggcgctaccttccgcctaagcagggccagaggctcattataaacccgacctacacccctgggactaggcggcagggacctcatactgtctaggtcctgggtccatcatcagtgtccagctgcatatggagcggtcacctaggggttagggtgggagagtcggcaggggttggtgtaggtgaattagaatgtttactgggccagcccaggmacagtggttcacgcctggagtccctggccgacacaggaggatccctggagcccaggaggtagaagcttcagtgagctgtgatggagccactgactgcactccagcctgggcgacagagcaagaccctgtctcaaaaaaaattaataataaataaattaatttaatttaaaaaaaaagaaagtctcatgggtctcagtatagaatagatgtagaataggtgtcgttattaggtagaattaccattataaacagagcccactgaaatcacagtaggctgccagtctattgatttctggtgtc

SEQ ID NO: 69103 - DNA, 601 bp, Human
aaagggggttggaaatataaatgtaaaggttgagattaaatagctgaaaaatcaggcagtgagctcctttctggctgcatatggaagacaaagcctcttctctgtcctttcccagtactgcattttgtaagtgtaatatttacaaagagaccatttgcaggctctgagttatccagacaccacaaaaggggaaaagctcttgtaaacatgtgggcatctttggccacaaggtggcgctaccttccgcctaagcagggccagaggctcattataaacccgacctacacccctgggactaggyggcagggacctcatactgtctaggtcctgggtccatcatcagtgtccagctgcatatggagcggtcacctaggggttagggtgggagagtcggcaggggttggtgtaggtgaattagaatgtttactgggccagcccaggcacagtggttcacgcctggagtccctggccgacacaggaggatccctggagcccaggaggtagaagcttcagtgagctgtgatggagccactgactgcactccagcctgggcgacagagcaagaccctgtctcaaaaaaaattaataataaataaattaa

SEQ ID NO: 69104 - DNA, 601 bp, Human
tgtgagtcacaaagagcttctgctgataggctttcaacatggcctcgatgatctccctgaggaagtgcacctgggaccactctatgacagtctgcggagcagaggtatattaagacagcagcatcccctccaaagcacctccatccactctctcctactaccccatagcaaagggggttggaaatataaatgtaaaggttgagattaaatagctgaaaaatcaggcagtgagctcctttctggctgcatatggaagacaaagcctcttctctgtcctttcccagtactgcattttgtaagygtaatatttacaaagagaccatttgcaggctctgagttatccagacaccacaaaaggggaaaagctcttgtaaacatgtgggcatctttggccacaaggtggcgctaccttccgcctaagcagggccagaggctcattataaacccgacctacacccctgggactaggcggcagggacctcatactgtctaggtcctgggtccatcatcagtgtccagctgcatatggagcggtcacctaggggttagggtgggagagtcggcaggggttggtgtaggtgaattagaatgtttactgggc

SEQ ID NO: 69105 - DNA, 601 bp, Human
atctggcttggggtgccccaacccactgtcagctaaaaaaagaggttctgaaaagaaaaatctacttacctcatagaataggccaaaatagggagagatatcgggcctgaaaacatggataagggacaagatttcatctttgtagccccagagcaattcgtcaactgtgtgagtcacaaagagcttctgctgataggctttcaacatggcctcgatgatctccctgaggaagtgcacctgggaccactctatgacagtctgcggagcagaggtatattaagacagcagcatcccctccaargcacctccatccactctctcctactaccccatagcaaagggggttggaaatataaatgtaaaggttgagattaaatagctgaaaaatcaggcagtgagctcctttctggctgcatatggaagacaaagcctcttctctgtcctttcccagtactgcattttgtaagtgtaatatttacaaagagaccatttgcaggctctgagttatccagacaccacaaaaggggaaaagctcttgtaaacatgtgggcatctttggccacaaggtggcgctaccttccgcctaagcagggccagaggc

SEQ ID NO: 69106 - DNA, 601 bp, Human
gttattttatcttttaccaacttcccaactatccactgcactccagggtttttgtttttgtttttgttttttttggcttttttagacagagtcttgctctgtcaccctggctggagtacagtggtgtaacttcagctcactgcaacctctgcctcctgggttcatgcaacttacctgcctcagtctcctgagtaggtgagattacaggtgtacatcaccacagctggctaatttttgtatttttagtagagatagagttttgccatgttggccaggctggtctcaaagtcttaacctcaartgatccacccacctcggtctcccaaagtcctggaattacaggcattagccaccgcacccggcctcaagttttttttctttccaaaaaacactccatttttcacacactctataagataacttaactctaggcaatttctagaagaaactcaaagttaatctggcttggggtgccccaacccactgtcagctaaaaaaagaggttctgaaaagaaaaatctacttacctcatagaataggccaaaatagggagagatatcgggcctgaaaacatggataagggacaagatttcatctttgt

SEQ ID NO: 69107 - DNA, 601 bp, Human
aggcccagggacacaattattgctgtttgccataaaaactggaatgctacaggattacatgaagagggtaagactcttgaacaggcagagccagaaaacagctacaaatttaaagctgaggagacccatcacaatcccagagcacacccctaatctaatcctcttcctggggttattttatcttttaccaacttcccaactatccactgcactccagggtttttgtttttgtttttgttttttttggcttttttagacagagtcttgctctgtcaccctggctggagtacagtggtgtaayttcagctcactgcaacctctgcctcctgggttcatgcaacttacctgcctcagtctcctgagtaggtgagattacaggtgtacatcaccacagctggctaatttttgtatttttagtagagatagagttttgccatgttggccaggctggtctcaaagtcttaacctcaaatgatccacccacctcggtctcccaaagtcctggaattacaggcattagccaccgcacccggcctcaagttttttttctttccaaaaaacactccatttttcacacactctataagataacttaactcta

SEQ ID NO: 69108 - DNA, 601 bp, Human
ataattttttaaaacttgctcacaattctattttaacaatttctacgttttatataaccttgaaggcccagggacacaattattgctgtttgccataaaaactggaatgctacaggattacatgaagagggtaagactcttgaacaggcagagccagaaaacagctacaaatttaaagctgaggagacccatcacaatcccagagcacacccctaatctaatcctcttcctggggttattttatcttttaccaacttcccaactatccactgcactccagggtttttgtttttgtttttgttttttttggcttttttagacagagtcttgctctgtcaccctggctggagtacagtggtgtaacttcagctcactgcaacctctgcctcctgggttcatgcaacttacctgcctcagtctcctgagtaggtgagattacaggtgtacatcaccacagctggctaatttttgtatttttagtagagatagagttttgccatgttggccaggctggtctcaaagtcttaacctcaaatgatccacccacctcggtctcccaaagtcctggaattacaggcattagccaccgcacccggcctca

SEQ ID NO: 69109 - DNA, 601 bp, Human
ctgagaaacagtgagatattagcaacaagatctacttggctgatggattgaagccactgggaccaaaagggccttgagggaacctttgcataatatctctcagtaggaggctctcctgaaattatttctagaagggaggttcagtaagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacrtataattttttaaaacttgctcacaattctattttaacaatttctacgttttatataaccttgaaggcccagggacacaattattgctgtttgccataaaaactggaatgctacaggattacatgaagagggtaagactcttgaacaggcagagccagaaaacagctacaaatttaaagctgaggagacccatcacaatcccagagcacacccctaatctaatcctcttcctggggttattttatcttttaccaacttcccaactatccactgcactccagggtttttgtttttgttttt

SEQ ID NO: 69110 - DNA, 601 bp, Human
aacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggaccaaaagggccttgagggaacctttgcataatatctctcagtaggaggctctcctgaaattatttctagaagggaggttcagtmagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacatataattttttaaaacttgctcacaattctattttaacaatttctacgttttatataaccttgaaggcccagggacacaattattgctgtttgccataaaaactggaatgctacaggattacatgaagagggtaagactcttgaa

SEQ ID NO: 69111 - DNA, 601 bp, Human
tttatttgggcatgtagctatgatttctcagaaatagcacaggtagtagctcctctataataataggagtgaacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggaccaaaagggcctygagggaacctttgcataatatctctcagtaggaggctctcctgaaattatttctagaagggaggttcagtaagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacatataattttttaaaacttgctcacaattctattttaacaatttctacgttttatataaccttgaaggcccaggg

SEQ ID NO: 69112 - DNA, 601 bp, Human
ttcctaaaattctttatttgggcatgtagctatgatttctcagaaatagcacaggtagtagctcctctataataataggagtgaacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggamcaaaagggccttgagggaacctttgcataatatctctcagtaggaggctctcctgaaattatttctagaagggaggttcagtaagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacatataattttttaaaacttgctcacaattctattttaacaatttctacgttttatataacctt

SEQ ID NO: 69113 - DNA, 601 bp, Human
tgaaaatgttctggaattagcagtaatggttgcacaaccttgtgactatactaaggactactgaattgtacattttaaaatggtaaattttatagtaagtgaattatttctcaataataacaaatttaaaagcctaagtccaggactaggaccaattataccagaatagctacactggaagaagacggtattaatatagccctattttcaattaaggtttcttcaattgtatattctctccaagttatacttcttaagggcacatacagacactacattcctaaaattctttatttgggcrtgtagctatgatttctcagaaatagcacaggtagtagctcctctataataataggagtgaacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggaccaaaagggccttgagggaacctt

SEQ ID NO: 69114 - DNA, 601 bp, Human
agggcatacattatatgactccatttatatgagatgtccagaatatgcaaattcacagagccagaaagtagattagtggttgccagggcctgggagagtaagacaggaataggagtgactgctaagagagtatgcagtttcttttttgggataatgaaaatgttctggaattagcagtaatggttgcacaaccttgtgactatactaaggactactgaattgtacattttaaaatggtaaattttatagtaagtgaattatttctcaataataacaaatttaaaagcctaagtccaggacyaggaccaattataccagaatagctacactggaagaagacggtattaatatagccctattttcaattaaggtttcttcaattgtatattctctccaagttatacttcttaagggcacatacagacactacattcctaaaattctttatttgggcatgtagctatgatttctcagaaatagcacaggtagtagctcctctataataataggagtgaacaattgttgagtataatattcctggctctgttctaaaatttttgcatgaatcatctcatgaaatcctcacaaccacataagatag

SEQ ID NO: 69115 - DNA, 601 bp, Human
tgctacaacatggatgaaccctgacaacattacactaaatttaaaaagcagacacagaagggcatacattatatgactccatttatatgagatgtccagaatatgcaaattcacagagccagaaagtagattagtggttgccagggcctgggagagtaagacaggaataggagtgactgctaagagagtatgcagtttcttttttgggataatgaaaatgttctggaattagcagtaatggttgcacaaccttgtgactatactaaggactactgaattgtacattttaaaatggtaaatkttatagtaagtgaattatttctcaataataacaaatttaaaagcctaagtccaggactaggaccaattataccagaatagctacactggaagaagacggtattaatatagccctattttcaattaaggtttcttcaattgtatattctctccaagttatacttcttaagggcacatacagacactacattcctaaaattctttatttgggcatgtagctatgatttctcagaaatagcacaggtagtagctcctctataataataggagtgaacaattgttgagtataatattcctggct

SEQ ID NO: 69116 - DNA, 601 bp, Human
aggactccaaaattccacacctatgtatatactcaagagaattccacttcaaggtatatacccaatgttcatataaaagcttgtatgaacaaatattcatagcagcacttctaataatagccaagaaggaacacaacccaaatgtccatcaactgataaatggataagcaaaatgtggtatatctacacaacggaatattcctcagttataaaaaggaatggaacactgatacatgctacaacatggatgaaccctgacaacattacactaaatttaaaaagcagacacagaagggcatayattatatgactccatttatatgagatgtccagaatatgcaaattcacagagccagaaagtagattagtggttgccagggcctgggagagtaagacaggaataggagtgactgctaagagagtatgcagtttcttttttgggataatgaaaatgttctggaattagcagtaatggttgcacaaccttgtgactatactaaggactactgaattgtacattttaaaatggtaaattttatagtaagtgaattatttctcaataataacaaatttaaaagcctaagtccaggactaggaccaa

SEQ ID NO: 69117 - DNA, 601 bp, Human
gtcttgcagtgaaagaccttatttttgaaaaagaacttatctttaaagcttttacctgcaaaagtcagatgggaagacataaaggacctcatctttggttattagtgggtgaaaagaatctccatctgttccattaatcatattgcacttgtctgttatccaccagtcaagtgacctataattgataagcacaagaaagagtaaagatgatcacatttgagtttagattctcttaaatggtcaggactttgcaagatttaactggagctgtctatccacagtatcttattcatacacagayacaacagttttaattagatcaagggggagaaaaagtaggtccctggcccaaatcagctttcatagaggcaatggccaaatagcccaaaacatgtggtggtttgaaaagtatttgtgctgtagctactacacatcactcaatgactattaagcaagagtgggacttttcactggcctgtaattcatgcctggccatgataaatctacaaatcactaatatttaatctgtaagatgttttaccaccatcttgatttgtagaataataattacaagactatttacatgtttttatatttttca

SEQ ID NO: 69118 - DNA, 601 bp, Human
aaatatccatgcataataagtgtgtctgcatatattcctcatgcttttggtggtcttgcagtgaaagaccttatttttgaaaaagaacttatctttaaagcttttacctgcaaaagtcagatgggaagacataaaggacctcatctttggttattagtgggtgaaaagaatctccatctgttccattaatcatattgcacttgtctgttatccaccagtcaagtgacctataattgataagcacaagaaagagtaaagatgatcacatttgagtttagattctcttaaatggtcaggactytgcaagatttaactggagctgtctatccacagtatcttattcatacacagacacaacagttttaattagatcaagggggagaaaaagtaggtccctggcccaaatcagctttcatagaggcaatggccaaatagcccaaaacatgtggtggtttgaaaagtatttgtgctgtagctactacacatcactcaatgactattaagcaagagtgggacttttcactggcctgtaattcatgcctggccatgataaatctacaaatcactaatatttaatctgtaagatgttttaccaccatct

SEQ ID NO: 69119 - DNA, 601 bp, Human
atagtaactaagagccaacacttaatattggttactgtgtgatgggccctgggctaagtattttactaatactaactcatttgtcctcataacaacctctaacatagttaacaatttctatctttgttttacaaataaggaaagtgaggtacagagtggttaagtaatttgcccaaggtcacacagctataagtggtagagccaagattcaaaccaacagtcagaagtctgtgctgtgaaccagtacactatactgtctcgatgtgccatcagcatttatcactgattatgcataaatatycatgcataataagtgtgtctgcatatattcctcatgcttttggtggtcttgcagtgaaagaccttatttttgaaaaagaacttatctttaaagcttttacctgcaaaagtcagatgggaagacataaaggacctcatctttggttattagtgggtgaaaagaatctccatctgttccattaatcatattgcacttgtctgttatccaccagtcaagtgacctataattgataagcacaagaaagagtaaagatgatcacatttgagtttagattctcttaaatggtcaggactttgcaag

SEQ ID NO: 69120 - DNA, 601 bp, Human
agagataaaatactctaacaaatacctttgtatctgccacttagacaaataaaaattatattatggatataactgaacctgtctacgtaatgctcttgattccattccttctctgcctcccctgaggaaaccactctgctgaaatatggacaacagtatcttttatttggcttccatgtagagactacctattgactggaagtagaccaggtcagttgatgcttgacagagcatatcatagtaactaagagccaacacttaatattggttactgtgtgatgggccctgggctaagtatttkactaatactaactcatttgtcctcataacaacctctaacatagttaacaatttctatctttgttttacaaataaggaaagtgaggtacagagtggttaagtaatttgcccaaggtcacacagctataagtggtagagccaagattcaaaccaacagtcagaagtctgtgctgtgaaccagtacactatactgtctcgatgtgccatcagcatttatcactgattatgcataaatatccatgcataataagtgtgtctgcatatattcctcatgcttttggtggtcttgcagtgaaagacc

SEQ ID NO: 69121 - DNA, 601 bp, Human
ataacatttagaatggagactcacataaaaaagaaataagaggcctctctagacctgcatggacatatgccagtgtggacgggccaccggcaaagccagggaagccagggcacggcagagccaaagctaaggtagaacaggcagcgatggccgtggcctcgtagggtcttaggcacttgaaaagtgtcacattggacagatactttattggaatacacactttgatactcaatccccccctccaagaaaaatcagattccatattttgccccagtcatttatttaaatggagttcaacgtwattctgcctttcattcttactgatttcaaacatagtcccatgtaatatgaccactgcttacactgcatagtgcctaaccactttgatgtacacagtcaccactgagccttcagcccttcctttgaaggctggccggaagagccttctgggcctcactttttcatctctgaaccagagctgttgatacatctctcgcaaggttgtgaataacataggtggtttcactgcacaaaccaaaccacccctacagcattttttaatgaaaaattttaggcaccagaaagagataaaatactctaa

SEQ ID NO: 69122 - DNA, 601 bp, Human
atgtaaatatgtaaagcacttaggacagtgactggcatacatcaggtgcttagtaaacatgagctattattactgttaagacttctaaaccactgtccagaaaaaaaaacacaacatggcattctagaaataaaaagcatcacagaaaagccatgatttttttttaccattcaatagccatgttatgaaacattgttcttgaaagaaactgatctttctattgggctgacaatatattcttttttgtttgttttgttttttagagacagtggtctcgccatgttgcccaggatggacttgrgaactcctgggctcaagtgatcatcccacctcagcatccttagtagctgggactgtaggtgtgcgccactacgcccagctacatattctttgttgaactccaatccttctgcattcttgacacccctatcatgtcccctctctgagttcttaccattcttgcagatgctgacattcagaactcctgagcccaggcagtttccctcaggtatacagaagccggcattgtctgacgtattggctaatatttctgcaggaactttataccgaaaggcaggcagtccctgtacactctcatagt

SEQ ID NO: 69123 - DNA, 601 bp, Human
gggtcactgccctgtcagacaaggatcaggaggtatactgctgacttcagacttattccaaaatgatatcttattcttttttttttttcttttttaaaagatggagtctcgctatgttgcccaggctagaatcaaactgggctcaaacgacccttccaccatagcctcctgagtagctgggtctacaggcacacgccaccatgccaggcctgaaaggagattttaaaatgagatagataagggagcaaaagtgagcacattactattcaggagaaagggactacacagagagctctccagrgaaattttaaagaggaattacagcccaagagggaatcacagggcaaatatgagaagaccctgagttccgccagggatctgctcagagggaggagtcgcatcaaaatcacgttccctctctgagccctagtttccccaattataaaaacaggccgctgaatgtctactatctagtaagttcattgtgaataattctgcaacatgtggctgttaaaactactcttcaagatgaagaaaatagttttgtcagttgtgccactgataattctgcctcattcatggaaaggagcagagtagctct

SEQ ID NO: 69124 - DNA, 601 bp, Human
tgggtatctggaactataggtgtatgctactatgcccagctaatttttaaattttttgttcagatggggtctccctgttgcccatgcaggtctaaattcttggcctcaagtgagcctcctgcttcagcctcctaaagtgttaggattacaggcatgatccaccatgcctcaccaatatatttttaataactctccagataattctgatgtaaagccaggtgtgggggtcactgccctgtcagacaaggatcaggaggtatactgctgacttcagacttattccaaaatgatatcttattcttttttttttttcttttttaaaagatggagtctcgctatgttgcccaggctagaatcaaactgggctcaaacgacccttccaccatagcctcctgagtagctgggtctacaggcacacgccaccatgccaggcctgaaaggagattttaaaatgagatagataagggagcaaaagtgagcacattactattcaggagaaagggactacacagagagctctccagggaaattttaaagaggaattacagcccaagagggaatcacagggcaaatatgagaagaccctgagttccgccaggga

SEQ ID NO: 69125 - DNA, 601 bp, Human
taacagtttggctgatccaagggaactgatcagctgatggctaagagaaaagggagaaaaccacacacgattttattcaccagagcataagatcactggtttctcagatacaaatgcaatgtatgcagctaagagtgtgaagtacccataaaatactgtgctaaaagaatgttcttgttttttttttttattggtccataatgttcaaattccaaaaatgaagacatggttagcatggtttttgtttttctcgtctatgaatacaggagtaaatgtgtattatacacacacacacacacayacacacgtgtgtatgtctcctctatgtatatctgatacctttacaattaataatataataaactctcaaataacctgtagaaagaagtttgccaaaagtgactgaggttaatatacatattcatatttcaaccaaaatattcctggcagtgaggaagcaaagggacatctttaaccttatcgatctgtgtcccaaggggagaaataaatatatgttgaggtccaaggctagcatcagaagattgaccaggttatatgggtacatcagtagtttccaataactgagttttcactgttgctt

SEQ ID NO: 69126 - DNA, 601 bp, Human
tcattgaggtacatcactgggaaaaccatggttctaatgtctcccgtttcactacaaagacaaaggatgagattgtttcagaaacatcctcatcacaatggcacactttcccggacagacacatttatatgaagattctagtacacttatttcttaaattacccagaatttgctgatttcttagttatctttgcaaacatgtaccccaaaagttagattccagtctgtctagcaattccatgtgctgtacgtttatcaaaacacaagatactgaaggcagattccttaaaatgatgactaktctccttagagtcatcagggaaggctccagtcgacagaacaaaactgtcactcctcagagtgttttgtaactaggccactgaagtactgtctttgcaacaagagccaactgagcatgtaccacgtgccagctctgtgctgggtgtttttgggatattatctcattcaattcctagagtagtcacctacagtaggtattactgtcccaggtttacagatgagaaaattatgactcagagaggcctaggatcaccacaagtaagtgatggagccacaaatgtaattccactttgcttctaag

SEQ ID NO: 69127 - DNA, 601 bp, Human
aggggtggtggcgggcgcctgtagtcccagctacttgggaggccgaggcacgagaattgcttgaacccaggaggcagaggttgcagtgagctgagattgggccactgcactccagcctgggcaacagagcaagactccatctcaggaaaaaaaaaaaaaattagccgggcatggtggcacacacctgtagttccagctacttggaaggcagaggtgggaggatcacttgagcccgggaagtcgaggctgcagtgagccaaaatcgcaccactgtagagggtgagagtgagaccttgtctcaaaaaaaaaaaaaaaagaaaagaaagcattttttttcattggaccgagtcagtggattgggttctaagacattttttccaataactggatagagtttcctcctcggtaaaaaggtggtgtggcaacagtctccaatgtcacttccagacttccaggtctaatattttatttttctagagaagagaataatcacgctcttcctaggaggcagcaaaaatacaaggttccactccacacacctggacttaatctagtctttcacaaaaaagcaaattagaagttgggggtggagggacttcaa

SEQ ID NO: 69128 - DNA, 601 bp, Human
tctgctaaaaatacaaaaattagccaggggtggtggcgggcgcctgtagtcccagctacttgggaggccgaggcacgagaattgcttgaacccaggaggcagaggttgcagtgagctgagattgggccactgcactccagcctgggcaacagagcaagactccatctcaggaaaaaaaaaaaaaattagccgggcatggtggcacacacctgtagttccagctacttggaaggcagaggtgggaggatcacttgagcccgggaagtcgaggctgcagtgagccaaaatcgcaccactgtasagggtgagagtgagaccttgtctcaaaaaaaaaaaaaaaagaaaagaaagcattttttttcattggaccgagtcagtggattgggttctaagacattttttccaataactggatagagtttcctcctcggtaaaaaggtggtgtggcaacagtctccaatgtcacttccagacttccaggtctaatattttatttttctagagaagagaataatcacgctcttcctaggaggcagcaaaaatacaaggttccactccacacacctggacttaatctagtctttcacaaaaaagcaaatta

SEQ ID NO: 69129 - DNA, 601 bp, Human
ggcaggcggattgcttgagctcaaaagtttgagaccagcctgagcaatgtggtgaaaccacctctctacaaaaaatacaaaaattagctggggctgggcatggtggctcatgactgtaatcccagcactttgggaggccgagatgggcagatcacttgaggtcatgagtttcaacatggtgaaacctcatctctgctaaaaatacaaaaattagccaggggtggtggcgggcgcctgtagtcccagctacttgggaggccgaggcacgagaattgcttgaacccaggaggcagaggttgcmgtgagctgagattgggccactgcactccagcctgggcaacagagcaagactccatctcaggaaaaaaaaaaaaaattagccgggcatggtggcacacacctgtagttccagctacttggaaggcagaggtgggaggatcacttgagcccgggaagtcgaggctgcagtgagccaaaatcgcaccactgtagagggtgagagtgagaccttgtctcaaaaaaaaaaaaaaaagaaaagaaagcattttttttcattggaccgagtcagtggattgggttctaagacattttttccaataac

SEQ ID NO: 69130 - DNA, 601 bp, Human
agccagctgacagcccttcagtgaagtacagttgaattcctcaggtaaagttatccagtaaggaagaagttccttcagccagttctcacctcatccatggatccctgtcctttgcatgcaagccaggtaaaaaccaaaccaaagaacacacccagcgccatgatgatgtagggtatgttggtgatgatcaaagtagtgttaatcatagacttcagtcgactcgccgtctctttatcaatgtgaacactctggagaggcaagaaaatagtattcttgatgactaaacatccagtgtgtaacygttttttgctatatctttcctttgtttaatacaatttgggaatgtcctcctgttagcaaaccaaacatactgaaaatccatttataagtcagagtaatcagaagggacatttattcattaatatcttgtcttctcctgaagacattttttttactcttaaaatagattggaaaaaggaggtaaaatgtattcagaaatattgagacagtatcaccttttgttttatgtcagataattccaattcatccttaaaaatccagctcagcatcacttccttccaaaagttttctctggctacct

SEQ ID NO: 69131 - DNA, 601 bp, Human
gctgctgcttgttcttgaagattccaggcctaacctttccaggaggccttctctgaccactcccaccctcaataccagagcagtacccttctctgtgttgatctggattataaaacttagactctattcaacttgcctccttcctggtttgaaacctactaaggagtagtgtctcagaggtattagttctcaataattccttgcttgttgaatatatgaggaaggttaattgtaggagcagtaattaacatttccatgaggtttcatttgtgcttaagacaatttcaatgactgcataaartcacactggaagatccacacatagaaatggcaaaatagtttgcctcacagctaattcaggctaaagtgactggcaggggataagagaaataatggaagaatatggaagtcagggaaattcagctaattttactcagatggtttcacgtatttattttctacttcacatttgccttggacacttagttgaggaaactggaggaaaaaaggccactgttgtaaaaaaaaggaagctgcagaaaatttaagaagggcttctacagaaaaggctcattgcaggtattcaggttcctggctgggc

SEQ ID NO: 69132 - DNA, 601 bp, Human
atatgcttgaattctgaacactgtgacatatgatggctcccaattccctgtcttaggttatgctgaaaccaagaagtcctttgaaaagtggtgtctctgcttctggtcctaacagacctttctttaaagtactttgtgcaatattttaaacatccatcattctgtcagcaaaatgattgtcacaggaagtatagggcacacgtttctctattcagtgagtgacagtgagctacaaaacactggaaagaactgaaactgaggaaggaacttgtaaaaagaacttcaaaattaccaagaagamggctgtcccagaagaaatatctctttagtctaatcagactttctgaaacttatgtgtaacttaggctgtagatagatggatttcccatattcataattttacaaataatcactcaatattagattaattaatacagtaacatatttggcaagggcgactcaggaagaaaaatcagttactcattacattctctcagaagcatcttttcgtagcatgatcattttgactaaaaaaaaaacagttaactatccacaagcatcataactagcaattaattctacatgaaatatctgtacttta

SEQ ID NO: 69133 - DNA, 601 bp, Human
aatatgcttgaattctgaacactgtgacatatgatggctcccaattccctgtcttaggttatgctgaaaccaagaagtcctttgaaaagtggtgtctctgcttctggtcctaacagacctttctttaaagtactttgtgcaatattttaaacatccatcattctgtcagcaaaatgattgtcacaggaagtatagggcacacgtttctctattcagtgagtgacagtgagctacaaaacactggaaagaactgaaactgaggaaggaacttgtaaaaagaacttcaaaattaccaagaagraggctgtcccagaagaaatatctctttagtctaatcagactttctgaaacttatgtgtaacttaggctgtagatagatggatttcccatattcataattttacaaataatcactcaatattagattaattaatacagtaacatatttggcaagggcgactcaggaagaaaaatcagttactcattacattctctcagaagcatcttttcgtagcatgatcattttgactaaaaaaaaaacagttaactatccacaagcatcataactagcaattaattctacatgaaatatctgtacttt

SEQ ID NO: 69134 - DNA, 601 bp, Human
tgtcgcagccccagtttacaggtgaggagatggaggttcagagaagtaagtgagcttgcctggagatgcacagtggaagactgtgggatttgaatctaggcctgatgtgatcccagaactgctactttttaaccattcttccggattgcccgttctccattctccgcttgatagcaagacctgtgaaggggacacaagaggagacccaacctagtcagggttatggagagacagggagtcagtccaaaaacaaaaaataaaaaaaagtgccctaaggaatgagtagaagttggccagatakggtgaagagagtgcccccagtcttggatacagcaggtgcagctggtgagatgcttggtgcattcaaggaactgaaagaagggctgagtcacagaaaacatttttatccaaaagagagtcctgaccgggcacagtggctcacgcctgtaatcccagcattttgagaggccaaagcgagtggattacttgaggtcaggagtttgagaccagcctgcccaacatggtgaaaccccatctctactaaaaatacaaaaattagccgggtgtgctggcacatgcctgtaaacccagctactcagga

SEQ ID NO: 69135 - DNA, 601 bp, Human
gaggagatggaggttcagagaagtaagtgagcttgcctggagatgcacagtggaagactgtgggatttgaatctaggcctgatgtgatcccagaactgctactttttaaccattcttccggattgcccgttctccattctccgcttgatagcaagacctgtgaaggggacacaagaggagacccaacctagtcagggttatggagagacagggagtcagtccaaaaacaaaaaataaaaaaaagtgccctaaggaatgagtagaagttggccagatatggtgaagagagtgcccccagtcktggatacagcaggtgcagctggtgagatgcttggtgcattcaaggaactgaaagaagggctgagtcacagaaaacatttttatccaaaagagagtcctgaccgggcacagtggctcacgcctgtaatcccagcattttgagaggccaaagcgagtggattacttgaggtcaggagtttgagaccagcctgcccaacatggtgaaaccccatctctactaaaaatacaaaaattagccgggtgtgctggcacatgcctgtaaacccagctactcaggaggctgaggcaggaaaatcacttg

SEQ ID NO: 69136 - DNA, 601 bp, Human
ttctccattctccgcttgatagcaagacctgtgaaggggacacaagaggagacccaacctagtcagggttatggagagacagggagtcagtccaaaaacaaaaaataaaaaaaagtgccctaaggaatgagtagaagttggccagatatggtgaagagagtgcccccagtcttggatacagcaggtgcagctggtgagatgcttggtgcattcaaggaactgaaagaagggctgagtcacagaaaacatttttatccaaaagagagtcctgaccgggcacagtggctcacgcctgtaatcycagcattttgagaggccaaagcgagtggattacttgaggtcaggagtttgagaccagcctgcccaacatggtgaaaccccatctctactaaaaatacaaaaattagccgggtgtgctggcacatgcctgtaaacccagctactcaggaggctgaggcaggaaaatcacttgaacgcaggaggtggaggttgcagtgagccgagatctcgccactgcactccagcctgggtgacagagcaagaccttgtctcaattaaaaaaaagaaaagaaagaaagcaaaagaaagtcctgactgggca

SEQ ID NO: 69137 - DNA, 601 bp, Human
agacccaacctagtcagggttatggagagacagggagtcagtccaaaaacaaaaaataaaaaaaagtgccctaaggaatgagtagaagttggccagatatggtgaagagagtgcccccagtcttggatacagcaggtgcagctggtgagatgcttggtgcattcaaggaactgaaagaagggctgagtcacagaaaacatttttatccaaaagagagtcctgaccgggcacagtggctcacgcctgtaatcccagcattttgagaggccaaagcgagtggattacttgaggtcaggagttygagaccagcctgcccaacatggtgaaaccccatctctactaaaaatacaaaaattagccgggtgtgctggcacatgcctgtaaacccagctactcaggaggctgaggcaggaaaatcacttgaacgcaggaggtggaggttgcagtgagccgagatctcgccactgcactccagcctgggtgacagagcaagaccttgtctcaattaaaaaaaagaaaagaaagaaagcaaaagaaagtcctgactgggcacgggcacagtggctcaggcttgaaatcagagcatgttgggaggccgagg

SEQ ID NO: 69138 - DNA, 601 bp, Human
caatggcttaacaagcagctcagcatcagaaaagatctgtaatgcccacgggtgcaaaatggccatgagactagtaagtggtccctgggcacatatcaagcaatgggccccacccagtgaggctgatgggtgtttcttttctgtagtaatttgagtctcgctgggggaaagacaagatggaagccagagcctgttttgcttgtttgcagagattttttaaaaatagaaatttttggcatgttagtcaagactcctttggtataagtgatccagctcacactagcttaagcaaaacaggcgmttcattggctcacatgactaagaaatccagaggtatactgcattcaggcaaggctggatccaggtattctaatgaggtcatcaggaatctttctccgtcttggttcaacttttctctcaggcgacttcactctcaggcaagatctctccatgtggagggatcccctcagtgcccttgcttagcagtggtcccagaaaaagagctctttccctatagtcccagcaaaggtcctaagaagactcattagatcacatgctcacccctaaaccaatcactgtgggctacagcaggggctctcat

SEQ ID NO: 69139 - DNA, 601 bp, Human
caatgacatgaggctgtggaggtcagagagagggcatcttctgtgcatgcctctgcacacatgaccgtgtgtgtgtttttgcccatgcataatggtacaagtaggggtgaggctggtggctgtaaactgagccactgagtcaccctcccttgaacgaggggaccagcctctgtgcatgcccatgagttggtcactggctgtgggtcacttccaagaggttgctgaggggtctcctaacctcccaggcctcaccctcagcagctgggggtgggtgcaccagcctgatgaggggatcttgtgrtcagcacacagctgtgtatgaggcagtagcccttgagcatgtgtgagcatgagtgtgaacgtttcccaccaccaagttgcagccagaaaggtggctggcaaagcacagctcttgccctgctagggccctcgagcagtggctggggtcctgctagcagctcccacgccacccacaaaaacccctcttggcctccacagtgtagcctcaacaggacccagtgtaccttccggaacttcaccagtgctacccaggcattgacagagtggtacatcctgcaggccaccaacatctttgcacagg

SEQ ID NO: 69140 - DNA, 601 bp, Human
gcagggatgtattgaagagctcgcgaagcattgagagaactgtgttaggaaaagtctgcagggaaagtgggataaggaaggaggatttggaacatgtaggaaaaggagaaaatagaaaaagaaaaaggaaaggctgggcgtggtgggtgggtggcttacccctgtagtcccagcactttgtgaggtggagacgggaggatcgcttgagaccaggagttcaagaccagcctgggtaatatagtgagactccagctctagaaaatagtaaaataaattaaattttaaaaggaaggaggaaaargttaaacaaggatgtggtcttaggtaaagtctaggctcagcttgatctgtgggaggatctggagcataaactgaaccagagtggtcctcccttgaaggaggggaccagcctttctgcgtgccccgtgagctggtcactggctgtgggtcattcccaacaggttgatgaggtgtctcctaacctcccagacctcacttctagcagctgggggtgggtgcaccagcccgatgaggggatcagggtgggcacccaggcatctgttgcctcggttttctcatctctgaagcaggaacaataatc

SEQ ID NO: 69141 - DNA, 601 bp, Human
ccttgtgggccaccccatggctagctggtcacagtctgtgtttcagcctcactgtcttggccagggtcctttgctcagggcacacccgccaaccacacctgccataaggctagggataccaaacagactactgtaatgtccacaagcacattcatctcacccgctcagctgaaagagagctgtaacactgcaacttcaagtgcatggcccatctgctcagtgagaacacgcccaggagcgagagtggggcaggaaagtgaacctgctgtcaactccctacccatccaacgggatcccagtgttcaagggcctgtgttccactcacagcccagccccgaaagctgtgccggccacctcatgggtagctgggctgggctgggtatagctggcctgttgtcaacatagcaccctccaaaaggagccccatttgagtcatatgggctgagggtgagggacgggtggtcccccaagggaagctaaagaactgttagcagaaacagggaaaatagctggctgatgggccactaaaacccccaaatattggccacataacttctgccatgtgcgaggggtagggggtaagtgtaatgaaagggtcaag

SEQ ID NO: 69142 - DNA, 601 bp, Human
ctgaagtcacacagttggtgagtggcagagctagcagtctgggccaggcccaccccgcatcactctattgcctcatcagaaagggtgatcgtcatcttccctccctacccacctctcccaagcctatttccccagccctcggcaggtcccagtgaaaggtaccatccaggcaccttagcatagagatctcagccaactgctctctgagctcttcctcactcccacagttgactggtcatctgccttcctgagtcagccttggacacagctgtgggaatgtgcctctctgctctcccggtgmtgggccacagacactgtggcccctgcttcctccctctctctctgactccatcctgtccccctcctaacatgacaaacactctagaagcagcagctgcagaattaggaaaatgtgagccgcatgtggaccccaacaccaaactgcctggacttgaatgtcagctcagtatgtgactgggcatgctacttagcctttctgtgcctcagtttcctcatctggaaagtggggacagtgaaataaccacatagcattattgggggattaaatgagaacatatgcaaagtacctggtgcaatgcct

SEQ ID NO: 69143 - DNA, 601 bp, Human
aacatagtgaaaccccatctctactaaaaatacaaaaattagctgggtgcagtggctcacgcctataatcccagctactcgggaggctgaggtaggaggctgaacccaggaggcagaggttgcagtgagctgagatcatgccactgcactccagcctgggagagagagcgagactccatctcaaaaaaataaaaaaataaataaataaataaacaaataaataaataaataaaaaggcttttggccaggtgcagtggctcacttaatcccagcactttgggaggccaaggagggagaatcrcttgaggccaggagtttaagaccaacctgagcaacatagtgagaccccccatctctacaaaaaacaattttaaaataacaaaattagcccggcgtggtggtacacacctgtagactcagctactctggaggctgagggggaaggatcacttgagcctcggagtttgaggctgcagtgaaccaagatcacaccactgcattccagcattccagcctgggtgacagagtgagagtaaaatatagagagagagactttgttgttggtggtggtggtggttttttttttttttttttttttgag

SEQ ID NO: 69144 - DNA, 601 bp, Human
agggaggcctcagagcagataaaagctgaaggatggggagaagccagtatctgaagagctggttagagaatattccaggcacaaaggacaacagaggcaaaagccttgagcttggaaacatctagagtgtcgctggagtgtagggaatgagacatagaaggccagcatagggactttgcactttattctgtgagtgacaagaagcctttggagggttctcagaaagggagtaccgtgctctgactcacaaatttaaacaatcaccctgactgctgtgcagaaggaagactttaaggatgarcagaggcagaggctccagcaagaatccagacatgagatgctggtgacttgggccagggtgggagcgtctgaggtggagacaggtggacagactaaagtcacatcttggagcctggcgtggtggctcacacatgtaatctcagcactttgggaggctgaggtgggagatcacctgaggtcaggagttcaagaccagcctggccaacatagtgaaacaccatctctactaaaaatacaaaaattaggccaggcatggtggctcacgcctgtaatcctagcactttgggaggctgaggtgggt

SEQ ID NO: 69145 - DNA, 601 bp, Human
attgcatgttcttacctgtaagtgggagctaaatgatgtgcacacgtggatatagagtgtggaaggagagacatcagagacttagagggtgggagggtaggaggcaggtgagggacaagaaattaatgagtacagtatatatgattccagtgaaggttacactaaaagcctagacttcaccactgtataataattccatgtaacaaaactgcgcttgaaccccttacatttatacaaattagaaaaagaaaagaaatacataacagtctcttagtctctctgcctctctggtgtacagttygtttgtttgttttcttgagacagggtctcactctgtcacccaaactggagtgcagtggcacggtcatggctcactgcagcctcaacctcctgggctcaggtgatcctcccacctcagcctcctgaggagctaggattgcaggtggctaattttttgtagagataaggtttcatcctgttgcccaggttggtcttgacctcctgggctcaagcaatctgccctccttggcctctcaaagtactgggattacagatgtgatccactgcgcccagctgtacagttcttaaagaaagacagaga

SEQ ID NO: 69146 - DNA, 601 bp, Human
ggcccctgtccgggtttatggggccaaggcctcagtactccgggagagctggccccagcaagtctggctctgctgggcctttgtaggttgccacggggcaccccgggcctgtgggaccagtcactttcctgggctctctcaccagggcctagggttggccacttctcatccccacattggcaggtgtacccctggggaagcccaggggattatggggatcttactctggggtttcccaagatgaaaacaaaaaatagcagctaacaccatcaagcttccattgtgtgtgaaatgctgtgcraagggctggaacacattccatcgtcatttaatctttcaactgcctcctgccatgaatctacaatatagtaatgacagcagcatttattgataaactaataatagcagggttaccatgtgttaggcagtcactgttgtaagtaatttacatgtatattacatcatttaactttcacaacaaccctaagatgtagatactattatcattcccattctgggaatgaggaaattgggattgacagaccccagttcaaatgcatcatcaatttacctgagaagtccctttttttttttttttgag

SEQ ID NO: 69147 - DNA, 601 bp, Human
tgagccactgcgcccactggaagtccctctttgcatctgccttcaatcccccttgctgtagctggaggcttccttctcatcctgatctccagagttaacccagacctgccactagtcctggcccccttggagagggcagactgaatccttgcaaaggtgacaaaaatgaccactcgctgatacttcctctccagcccagtctgccttgccatatcagtgcactgagtcataacaagagggcagcccagtgcctgcctcagtgtctgggtgcccgagcatggcatggtttgccctttccccrtaggaaatgaccctcctggtgcccacctgcccacccattgcctggctggtttggccacctcgcgtctggagggacttctgcccattatggagaactctagccgtcatctgagcctctggagggacagacagacagacaggacagtacagggaggtgggaaacacggagaagaaggtaccagccccagaaacctcattccaggaaaactgcatctctcgtttcttccggtgtggtagccacccaggccagaaaacagccaagagccaggccctgatcgggagctctgcccatccccatgga

SEQ ID NO: 69148 - DNA, 601 bp, Human
tccgtaactgcaactgtggccactacctgtacccactgccccgtggggagaaatactgcaacaaccgggacttcccagactggggtgagcgggggcacgggggatcggcactccagccatctggggccacagaggctctgaccatagaggaggaggcagagctcagtgccctcagcagagtccagagatgtgcccagggtggctcctccacagtctgaggtccctcctatgatcccctcccaggcctcctttctgcaggagcccagccttctctctgctcctcaatttcatgaagcatggrcttgaaacacataggcatagaatgcacgtgtccttgtgggcctgtgtctgtgtgccacacaaatgctcacacatgtgcaaccctgggcatgtggctgctggcgagtgtgtgcctgcactcatgtttccaagtgcacaagtgcaaaggcatttccatgcttgcgtccaaatgcacaggagctgttcgtgactgcagtgggttgctgtatgtagtttatgcacaggcacaaatcacttccagggtctgcatttgtgcactctggcttttgtgcacgtgtgtgtgtgtgtgtgtgtgtgtgtg

SEQ ID NO: 69149 - DNA, 601 bp, Human
catagaggaggaggcagagctcagtgccctcagcagagtccagagatgtgcccagggtggctcctccacagtctgaggtccctcctatgatcccctcccaggcctcctttctgcaggagcccagccttctctctgctcctcaatttcatgaagcatgggcttgaaacacataggcatagaatgcacgtgtccttgtgggcctgtgtctgtgtgccacacaaatgctcacacatgtgcaaccctgggcatgtggctgctggcgagtgtgtgcctgcactcatgtttccaagtgcacaagtgyaaaggcatttccatgcttgcgtccaaatgcacaggagctgttcgtgactgcagtgggttgctgtatgtagtttatgcacaggcacaaatcacttccagggtctgcatttgtgcactctggcttttgtgcacgtgtgtgtgtgtgtgtgtgtgtgtgtgtgcacgtgcatgtatgtataaggccacgtgtccatcttcagcatgtgtgttcatgtctatgtgggctcattgggtctctctgcaaggcgctgggtggaaggggagtgtgaggaagccattagcatgatggtagcctccaagg

SEQ ID NO: 69150 - DNA, 601 bp, Human
agtacagcagggaaggagcctcagtctgcctgagagataagggaggtctgcgtagggaggtggctttgagtgaactctccaaggaggagtaagtgctgttcagataagaagaggtaccaatgtccaggcagaagacaaagctggaaagcctggaggcacgagacagcacagcctgaggacgatcaggtgggaggggatgcccacacagccacccttctctgtcccaggtgcagtgaaggcgctcaaggctcagtgaagagctctgtgcggagtcactccgtatagcccaggccaccctgakggcacaaagtggggagctcagagcagatctttggggctgtcccaggccagagtgtcctgtagggaactggtagtcaggggatggagaaagggggccataggatgggtgctgggcagagatgcccagaagggccgggaagggctgcacttgcagttctcgtttggacctccccactcacgggggcacgcatgagagaagctcaggacagaggagggctggggcggccatccctggctgccttcctgtgtgcatgtgtgcacgggtgtgtgggtacatgtgtgtgcatacatgtgggtgtgt

SEQ ID NO: 69151 - DNA, 601 bp, Human
aggcttacaggaccatctcggctggcgggcatcgccccctgcccctaattccttaggccttaccaccaagctttttccacacagccatccagactgaggaagacccggaaacttaggggccacgtgagccacggccacggccgcataggtaagtgccggcttcccctcggggtgggccttgggctctcttcgggtgcttagctagtctggagatcggtagcctataagtgggttagaataagacctttttgtggtcaagttgcacagctgttgatttttttctgacgatcctctagtattycagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaacactctgcttttgtgcgaggaagtattgagatgcatgagaaggctgtgtggtgcatgtagcttttttgtgtgtgtgtgagactgatcactgtcgc

SEQ ID NO: 69152 - DNA, 601 bp, Human
ctagtattccagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaacactctgcttttgtgcgaggaagtattgagatgcatgagaaggctgtgtggtgcatgtagcttttttgtgtgtgtgtgagactgatyactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaag

SEQ ID NO: 69153 - DNA, 601 bp, Human
ctctgcttttgtgcgaggaagtattgagatgcatgagaaggctgtgtggtgcatgtagcttttttgtgtgtgtgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtc

SEQ ID NO: 69154 - DNA, 601 bp, Human
tttgtgcgaggaagtattgagatgcatgagaaggctgtgtggtgcatgtagcttttttgtgtgtgtgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctacccccccycgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgagg

SEQ ID NO: 69155 - DNA, 601 bp, Human
ctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcargtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaag

SEQ ID NO: 69156 - DNA, 601 bp, Human
ttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcagtgcccccgttagtgcccagatcagaaacatacataccctgcctagggatttagaaagtgggttggcagtctttcctcacgcccatcacgcagttggtacctactacagtgtattgtaaacttttttctctgttcttctagggctactayaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaa

SEQ ID NO: 69157 - DNA, 601 bp, Human
ttggtgtatatttggtgttgggggtcactctatggccaaagtcaggggttgccatgagctcaggtgacggaggctccatcactgactgttgtgtgactttggccagctcccctgccctctctgggcctcagtctcttgctcaatataataagggtatagggaggctaaatgatacaatttctaaaatagagtatcgccaagttcaaaagccagaattatagacccccaggactacagacagtgtcacagcatcgtctgggtgaggctagggttagtgtgcggctgggctcagggctgcccmatttgctaggatcgtggggttcccatgtgtcaggatccagaggctagggtatgatcaggatctctagctggggtcagggtcagagctctctgtgtcccctagaattgccatcaaccttaaacccagagggaggcccagtccaacccctcagctttaagacctgctgggagcctcatctcagagaggctgagtcatggccaaggccagttgggggtgggagcagggggcttggtgtgggcctgcagcccctcatccactgccctcccctctagtgaaccacgagactgccaaggtgatcca

SEQ ID NO: 69158 - DNA, 601 bp, Human
cccttgatttggaaccagagcctgacaccttccctacccccaccctccatcccctggtgccctggggggatttattggagtgtatcaacctctccaacagcccctctaagagtcaggcttcaaagggtcctttcccactgccctgggaagatggaggtcttatttcggggtgaatggggggtagggtagaaaaatctcaaacaaaataagtatttttttaaaaaatgtataaatgttgttttcttatagtacagacaggtcttgctatgttggccaggttggtcttgaactcttggcttakccagtcccccaccccaagcctaaaattagtatcttgactttatttgggatgatggtaacagtcaagggtcggttgtgggccaggtgcttttacaaacaatatcctcacctttatcatatatttttttctttcttgtttttcattttttgagacagagtctccctctgtcacttaggctggagtgcagtggcacaatctcagctcgttgcaacctccgtctctgggttcaaggaattttcgtgcctcagcctccagagtagctggaattacaggcacacgtcaccacatccgcgtaatttt

SEQ ID NO: 69159 - DNA, 601 bp, Human
ataagtatttttttaaaaaatgtataaatgttgttttcttatagtacagacaggtcttgctatgttggccaggttggtcttgaactcttggcttagccagtcccccaccccaagcctaaaattagtatcttgactttatttgggatgatggtaacagtcaagggtcggttgtgggccaggtgcttttacaaacaatatcctcacctttatcatatatttttttctttcttgtttttcattttttgagacagagtctccctctgtcacttaggctggagtgcagtggcacaatctcagctcsttgcaacctccgtctctgggttcaaggaattttcgtgcctcagcctccagagtagctggaattacaggcacacgtcaccacatccgcgtaatttttgtatttttagtagagatggggtttcatcatgtgggccagactggtctccaactcctgacctcaagtgatccgcccacctcagtctcccgaagtgctggggttacaggcgtgagccaccacgcctggccctttatctatcttaatctttattttatttatttatttatttatttatttatttatttatttatttatttatttatt

SEQ ID NO: 69160 - DNA, 601 bp, Human
ctgtaaaagaggataatgccatcgcccggatgaccctgcttaacaaacacggaaacaggagccgatagaggtttagcagcctggcggagctcatgtgcaaactcagctcagtatcggaaactcagccaccttcatggcacctcaggctgccctggagcctgggtcccggtctgtgtgtcggtctgaggccccaagggtggggcagacattgttcagggaccttgtctttgtcttaaagccaatctcctcctcctccccggccctgctaaacacgctccccaggggtggtctctgctacccscgcacattgggccttgagtcttggtaaatgtttctgagccaccagggggcgccagcggtgctggatgccacttcgccttttgcaggaaaactcccgccgctagcgggtgctgtggggcgtcccaggtctcgcgcagccacgccctctgtgtgaccttgggcttcagtttaggcttctgtaaaagagaataatgggcaaggtccagtggctcatgcctgtgatcccagcactttgggaggccgaggtaggaggattacctcagccagggttcaagaccacctgtctctataaaaaatttaa

SEQ ID NO: 69161 - DNA, 601 bp, Human
gtgcagctccacctctgcccccggggcctagctgaggcctcctccaagctgagccacctactatcttccaaactcccaccctccatctggtgtcacctcctcccggaagccctctgtatcagtttcctgttttctgccataaaaaaaatcactccaagtttagtggcttaacatgacacaagtttaccattttacagtttaaaaggctagaagtccaccatggccctccctgagctaagatcaagctgtcagcagaaccagattccttctgggggctataggggagaattaattccctcgytttctgcagcttctagaggcttcccccattccttggcttccctccatctacttttatttagggcgagggaagcttcctgctctgactttctcatttatggtattctcccctgctttccagcagctgtgattgtcccaagtcctgtcctctggttctctaggccagaaaaactatgatctaccagagctcaagaacttgaaagggccttttcccactgtcccttctcacagtgagagccggagcccagcttcgtgctagaatctgtgaaaatggagaaatgcaccctgtgctgttctcttc

SEQ ID NO: 69162 - DNA, 601 bp, Human
gccggagcccagcttcgtgctagaatctgtgaaaatggagaaatgcaccctgtgctgttctcttcctccacccggcatctcccctgcagcccggctgggtttttttgtttgtttgtttgtgggtttttttgtttttttgtttgtttttgagacagagttttgcacttgtcgcccaggctggagtgcaatggcacgatctcgactcactgcaacttctgcctcctgggttcaagcgattctcctgcctcaacctcccgagcagctggaaccacaagcatatgccaccactcccggctaatcttttttttttttttaatgcatttttagtagagatggggtttcaccatgctggccaggctggtctcgaactcctgacctcagatgatccacctgcctcggccttccaaagtgctgggattataggcgtgagccacggcctgggcccagtctgactgttttcacttactctctaatgtctcaggtagtgtttattgtattctgtgcagaggtcaagaatttagtcatccaaggaggttagtgtattaggagcttacgcagctattaccagaagagactccactcaaaaatttggtacgtggct

SEQ ID NO: 69163 - DNA, 601 bp, Human
tattgagttgagatctttctcttttttaaagataggcatttctagatataaatctccctgtgagcacggttccctccatcttcagcacaccagggttgactctctccgggcgttcttccctggtcacctctccccttcctctcctcttctgcctcctcttccacttttcggtaccctgtgattgtattgggaccacccagataacctaggatcatctccccacctaccccaaggtccttaacttaaccatactttcatatgggtaacacgagttgagtgtggtacccagggtttgacatgytgggtaacatatttgcaggttctgtggattaggaggacattttgggggccatgattctatcttccaccctcgcctagacaaaattggaggctcactccttgggctccctggatgacccccaacatccttcctcacttccattccttcccagcatccagatcagccacttgtccatcgccagcagccaggtggagctggtggaagccaagtccattgatgtctccattcagaacgtgtctgtggtcttcaaggggaccctgaagtatggctacaccactgcctggtggtaagcattcctgt

SEQ ID NO: 69164 - DNA, 601 bp, Human
ggcagaagggaactggtgggtggggtctggagaggagccctctattcaggccattttctgactctggagcagacggatacatgtatgaatttggactctagacacgttctcgtgtgtgtgacaggtgtgagcgtcacaggagctgggccctcccgaggaattctgggatggtgccacagttaattcttgggtctgaggctccgtgttctcagctgcaaaatgggagtgataattcttacttcctgagctacaagagtcagggccaacagagccatgaacggtgcctggtacacactaggcrctccatggatgcacaggactggtcaggggctcattgtggtgcttgctgccttcaggcctgggtggatcaagcagctgttcacaaatttcatctccttcaccctgaagctggtcctgaagggacaggtgagtgaggctggctgactccctgtggtccagggccatgcccaggaggctggatccctttcctccctgcctttccctgagaaggtgccactcccaccttctccatgtggccagtcccctgtgccggtccccagcactgccaccaccacgcagctggaaggaggcactgcctctg

SEQ ID NO: 69165 - DNA, 601 bp, Human
tcctgaagggacaggtgagtgaggctggctgactccctgtggtccagggccatgcccaggaggctggatccctttcctccctgcctttccctgagaaggtgccactcccaccttctccatgtggccagtcccctgtgccggtccccagcactgccaccaccacgcagctggaaggaggcactgcctctggcctcctttcctgcctggaaagcacctgctctgtctgccccagatctgcaaagagatcaacgtcatctctaacatcatggccgattttgtccagacaagggctggtgagtgygtttctgtctgcatgcctcagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcctcacaagctgtgtggcgttgggcaagtctatagaactcaggacaaatgggtgattaagtccaagaggactccaagattctcctggaagtagattaggaaaaaagataattagattgctcaca

SEQ ID NO: 69166 - DNA, 601 bp, Human
cactgcctctggcctcctttcctgcctggaaagcacctgctctgtctgccccagatctgcaaagagatcaacgtcatctctaacatcatggccgattttgtccagacaagggctggtgagtgcgtttctgtctgcatgcctcagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcmtcacaagctgtgtggcgttgggcaagtctatagaactcaggacaaatgggtgattaagtccaagaggactccaagattctcctggaagtagattaggaaaaaagataattagattgctcacatggctgggcactcatccatgtactgtactctcctatgcagtacagagcagagctgggtttcagcccaagtcttggactctgctctgaaccaaccttctagaagggctctacctacccagacagacagacttgggaaaagagagaatgaaaaagtgccacacccctccccgcacaccca

SEQ ID NO: 69167 - DNA, 601 bp, Human
cgtcatctctaacatcatggccgattttgtccagacaagggctggtgagtgcgtttctgtctgcatgcctcagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcctcacaagctgtgtggcgttgggcaagtctatagaactcaggacaaatgggtgattaagtccaagaggactycaagattctcctggaagtagattaggaaaaaagataattagattgctcacatggctgggcactcatccatgtactgtactctcctatgcagtacagagcagagctgggtttcagcccaagtcttggactctgctctgaaccaaccttctagaagggctctacctacccagacagacagacttgggaaaagagagaatgaaaaagtgccacacccctccccgcacacccaggtcccactttacagaggggaacactgaggctggagggttgggtagctgtgtggatgcaggggagcggtga

SEQ ID NO: 69168 - DNA, 601 bp, Human
cagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcctcacaagctgtgtggcgttgggcaagtctatagaactcaggacaaatgggtgattaagtccaagaggactccaagattctcctggaagtagattaggaaaaaagataattagattgctcacatggctgggcactcatccaygtactgtactctcctatgcagtacagagcagagctgggtttcagcccaagtcttggactctgctctgaaccaaccttctagaagggctctacctacccagacagacagacttgggaaaagagagaatgaaaaagtgccacacccctccccgcacacccaggtcccactttacagaggggaacactgaggctggagggttgggtagctgtgtggatgcaggggagcggtgactcagggcaattcccccatcctgaggccctgcgttgatcttttcctcctgcagccagcatcctttcagat

SEQ ID NO: 69169 - DNA, 601 bp, Human
tggactgccctctgcaggggcagggctggtggtcagctggggcggggtgggagctggaggtccgtggtcaccagctgccctgactaatgtcgttacttgaatataaccctgtgaaggcaggaaccacgtctgtctggttcacttcccacggtggttgagacatagtgggcactccggaagtatttgttgaatgagtgaaagccccgctgggggaaactgggtacagctctttcctcagtttccccatctgcactctgggctgaatgctggggctcctcccaatctccctgaagctggaccygagcccagtagggacacacagggtccagccagcgtcctggcttcctccagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggtgagtgggtggggctgggctgctagggaatccagatggcatgtggtatgtgtgtgtgtgcacacgcatg

SEQ ID NO: 69170 - DNA, 601 bp, Human
atagtgggcactccggaagtatttgttgaatgagtgaaagccccgctgggggaaactgggtacagctctttcctcagtttccccatctgcactctgggctgaatgctggggctcctcccaatctccctgaagctggacctgagcccagtagggacacacagggtccagccagcgtcctggcttcctccagggtcatttcatctacaagaatgtctcagaggacctccccctccccaccttctcgcccacactgctgggggactcccgcatgctgtacttctggttctctgagcgagtcttycactcgctggccaaggtagctttccaggatggccgcctcatgctcagcctgatgggagacgagttcaaggtgagtgggtggggctgggctgctagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggaagctgagatgtagcaggacgaaccgcagacaaaactcctcagac

SEQ ID NO: 69171 - DNA, 601 bp, Human
ctgggctgaatgctggggctcctcccaatctccctgaagctggacctgagcccagtagggacacacagggtccagccagcgtcctggcttcctccagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggtgagtgggtggggctgggctgckagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggaagctgagatgtagcaggacgaaccgcagacaaaactcctcagacactgagttaaagaaggaaagagtttattcagccgggagcatgggtaagactcctgtctcaagagcggagctctccgagtgcgcaattcctgtc

SEQ ID NO: 69172 - DNA, 601 bp, Human
gggactcccgcatgctgtacttctggttctctgagcgagtcttccactcgctggccaaggtagctttccaggatggccgcctcatgctcagcctgatgggagacgagttcaaggtgagtgggtggggctgggctgctagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggargctgagatgtagcaggacgaaccgcagacaaaactcctcagacactgagttaaagaaggaaagagtttattcagccgggagcatgggtaagactcctgtctcaagagcggagctctccgagtgcgcaattcctgtcccttttaagggctcacaactctaagggggtctgcatgagagggtcgtgatctattgagcaagtagcaggtacgtgactgggggctgcatgcaccggtaatcagaacgaaacagaacaggacagggatttttacaatgctctttcatgcaatgtctggaatctat

SEQ ID NO: 69173 - DNA, 601 bp, Human
tccactcgctggccaaggtagctttccaggatggccgcctcatgctcagcctgatgggagacgagttcaaggtgagtgggtggggctgggctgctagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggaagctgagatgtagcaggacgaaccgcagacaaaactcctcagrcactgagttaaagaaggaaagagtttattcagccgggagcatgggtaagactcctgtctcaagagcggagctctccgagtgcgcaattcctgtcccttttaagggctcacaactctaagggggtctgcatgagagggtcgtgatctattgagcaagtagcaggtacgtgactgggggctgcatgcaccggtaatcagaacgaaacagaacaggacagggatttttacaatgctctttcatgcaatgtctggaatctatagataacataactggttaggtcaggggtccatctttaactac

SEQ ID NO: 69174 - DNA, 601 bp, Human
gggctgggctgctagggaatccagatggcatgtggtatgtgtgtgtgtgcacacgcatggggaggagggaggaaactcggaaacttggtggtgggcaaaagaactaagctggagcaatagcagtgaagtccagactgggcacagtggctcacacctgtaatcccaatcctttgggaagctgagatgtagcaggacgaaccgcagacaaaactcctcagacactgagttaaagaaggaaagagtttattcagccgggagcatgggtaagactcctgtctcaagagcggagctctccgagtgmgcaattcctgtcccttttaagggctcacaactctaagggggtctgcatgagagggtcgtgatctattgagcaagtagcaggtacgtgactgggggctgcatgcaccggtaatcagaacgaaacagaacaggacagggatttttacaatgctctttcatgcaatgtctggaatctatagataacataactggttaggtcaggggtccatctttaactaccaggcttaggtcaggtaggcccaggcctggtttcgggtctggttccttggtttcgggtctggtctctaggcgttgggctacc

SEQ ID NO: 69175 - DNA, 601 bp, Human
tgcccctgtgtggggtttatctcacgtaccccaatcctgctctggcttcaagagcccccacacagccaataacaccaccaatggcaacaattataacagcgaacacagctcctactcggttgttcggcatggagtgaagcacttagtgtgtgtgacttccttcagtgctcacaccgaccctatgagtggggcggtcaaactgtccccattttacacacagggaaacttagtgaatggcaaggctgggtttgagcccagctctattgcccccaaagataaggctccattccctgctccattwcccaggcatagggacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccctcagctttctggtcacctcactccccccacccactgcaatgacttct

SEQ ID NO: 69176 - DNA, 601 bp, Human
gggtttatctcacgtaccccaatcctgctctggcttcaagagcccccacacagccaataacaccaccaatggcaacaattataacagcgaacacagctcctactcggttgttcggcatggagtgaagcacttagtgtgtgtgacttccttcagtgctcacaccgaccctatgagtggggcggtcaaactgtccccattttacacacagggaaacttagtgaatggcaaggctgggtttgagcccagctctattgcccccaaagataaggctccattccctgctccatttcccaggcatagrgacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccctcagctttctggtcacctcactccccccacccactgcaatgacttcttcaggccttccc

SEQ ID NO: 69177 - DNA, 601 bp, Human
taaggctccattccctgctccatttcccaggcatagggacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccctcagctttctggtcacctcactccccccacccactgcaatgacttcttcaggccttccctgccatcctcaaatctccagctgccccctcctgtctaccttccacttccctctccacacacaacctgcttaccagagagctgagcagagccaccaacagaacttcccccccacgtcgctgctcccagtcgcaacccactcacccacacctgcgccttcctgcggccgttctcctgttctaacagaggacggtccctcttcccttctgaactcaggccgtccagccttccccggctctgtgatgcctctctccttgcacatacac

SEQ ID NO: 69178 - DNA, 601 bp, Human
agctttctggtcacctcactccccccacccactgcaatgacttcttcaggccttccctgccatcctcaaatctccagctgccccctcctgtctaccttccacttccctctccacacacaacctgcttaccagagagctgagcagagccaccaacagaacttcccccccacgtcgctgctcccagtcgcaacccactcacccacacctgcgccttcctgcggccgttctcctgttctaacagaggacggtccctcttcccttctgaactcaggccgtccagccttccccggctctgtgatgyctctctccttgcacatacacaactcacaatattgggcaggcccctgaccggctcttctcccttagccccttgtctgagtcctgttcctttgatgtcctatttctagtctttccatttctctctgtctctacctcctccccaggctaccattatctctagtggggacccatctgtagctcccggtgggtctccctgtgtcctgataccctccaataatctgttccccacagcagccagaacaatcttttcaagaaataaaactggtcattcacctgcctgcttaaagccggtgtaggatac

SEQ ID NO: 69179 - DNA, 601 bp, Human
gtcacctcactccccccacccactgcaatgacttcttcaggccttccctgccatcctcaaatctccagctgccccctcctgtctaccttccacttccctctccacacacaacctgcttaccagagagctgagcagagccaccaacagaacttcccccccacgtcgctgctcccagtcgcaacccactcacccacacctgcgccttcctgcggccgttctcctgttctaacagaggacggtccctcttcccttctgaactcaggccgtccagccttccccggctctgtgatgcctctctccytgcacatacacaactcacaatattgggcaggcccctgaccggctcttctcccttagccccttgtctgagtcctgttcctttgatgtcctatttctagtctttccatttctctctgtctctacctcctccccaggctaccattatctctagtggggacccatctgtagctcccggtgggtctccctgtgtcctgataccctccaataatctgttccccacagcagccagaacaatcttttcaagaaataaaactggtcattcacctgcctgcttaaagccggtgtaggatacaggctaaac

SEQ ID NO: 69180 - DNA, 601 bp, Human
ttatctctagtggggacccatctgtagctcccggtgggtctccctgtgtcctgataccctccaataatctgttccccacagcagccagaacaatcttttcaagaaataaaactggtcattcacctgcctgcttaaagccggtgtaggatacaggctaaacgctctcccatggcctccagggccctgcattttctcatcctgtctacttcttcatctagttgtttcccacccagcgtaattgtaactgtttagttgaaagttgacgaggtcttttgtcagctctagaaatttcttttctttkctttcttttttttttttttaagacagagtcttgctctgtggcccaggctggagtgcagtagcacaatctcaactcactgcaacctccaccttccgggttcaagcaattctcctgcctcagtgctgaaattacaggtgtgagccacagcacccagcccatcagctctggaaatttcttcatcactctctcttccatgattgccccatccctattttctccatgcctacctcctggaatttccatgagacacacgttgggccatctcattccattttccgtgtctcttagttgctctgtcgt

SEQ ID NO: 69181 - DNA, 601 bp, Human
agcacccagcccatcagctctggaaatttcttcatcactctctcttccatgattgccccatccctattttctccatgcctacctcctggaatttccatgagacacacgttgggccatctcattccattttccgtgtctcttagttgctctgtcgtgttttccatctcttttatctctatcctaaattctggatagtttcttcaagtatctttttagttcattaattctttttacagctgtgtcttatttgtttacttacccactgagattttcattttattttatttaattaattaatttrtttatttttgagacagagtctcgctcttgttccccaggctggagtgcagtggcgcaatctcagctcactgcaacctacgcctcctgtgttcaagcaattctcgtgcctcagcctcccgattggctggggttacaggggtgcaccactgtgcccagctcatttttttgtatttttagtagagacggggtttcaccatgttggccaggctggtcttgacctcctgacctcaaatgatcctcctgcctcagcctcccaaagtgccgggattacaggtgtgagctcccgcaccccgccggccct

SEQ ID NO: 69182 - DNA, 601 bp, Human
attccattttccgtgtctcttagttgctctgtcgtgttttccatctcttttatctctatcctaaattctggatagtttcttcaagtatctttttagttcattaattctttttacagctgtgtcttatttgtttacttacccactgagattttcattttattttatttaattaattaatttatttatttttgagacagagtctcgctcttgttccccaggctggagtgcagtggcgcaatctcagctcactgcaacctacgcctcctgtgttcaagcaattctcgtgcctcagcctcccgaktggctggggttacaggggtgcaccactgtgcccagctcatttttttgtatttttagtagagacggggtttcaccatgttggccaggctggtcttgacctcctgacctcaaatgatcctcctgcctcagcctcccaaagtgccgggattacaggtgtgagctcccgcaccccgccggccctttctttcttttgagctgagctatgtatttaatgaaaccttttcttgtgtatccagcagttcagtggtttcttggggcatgtgatctccttgagcccagtcccacaggctgtaatcgaagg

SEQ ID NO: 69183 - DNA, 601 bp, Human
cttttatctctatcctaaattctggatagtttcttcaagtatctttttagttcattaattctttttacagctgtgtcttatttgtttacttacccactgagattttcattttattttatttaattaattaatttatttatttttgagacagagtctcgctcttgttccccaggctggagtgcagtggcgcaatctcagctcactgcaacctacgcctcctgtgttcaagcaattctcgtgcctcagcctcccgattggctggggttacaggggtgcaccactgtgcccagctcattttttkgtatttttagtagagacggggtttcaccatgttggccaggctggtcttgacctcctgacctcaaatgatcctcctgcctcagcctcccaaagtgccgggattacaggtgtgagctcccgcaccccgccggccctttctttcttttgagctgagctatgtatttaatgaaaccttttcttgtgtatccagcagttcagtggtttcttggggcatgtgatctccttgagcccagtcccacaggctgtaatcgaaggtcctcaggccacactccccagccccgctggctgcctgcgcattcct

SEQ ID NO: 69184 - DNA, 601 bp, Human
atctcagctcactgcaacctacgcctcctgtgttcaagcaattctcgtgcctcagcctcccgattggctggggttacaggggtgcaccactgtgcccagctcatttttttgtatttttagtagagacggggtttcaccatgttggccaggctggtcttgacctcctgacctcaaatgatcctcctgcctcagcctcccaaagtgccgggattacaggtgtgagctcccgcaccccgccggccctttctttcttttgagctgagctatgtatttaatgaaaccttttcttgtgtatccagcrgttcagtggtttcttggggcatgtgatctccttgagcccagtcccacaggctgtaatcgaaggtcctcaggccacactccccagccccgctggctgcctgcgcattccttatcttggccatgttccttccacagggctcttgtccacactgtcccctctgccagaatggtttgccctcccccatgccatctgctcctcctcctgccacctcagggaaggcctctcccacctccctgactaggtcaggtcccctcgtgccacagcctggtgtgtctctcctttaaatactcctcagctgca

SEQ ID NO: 69185 - DNA, 601 bp, Human
gtatttaatgaaaccttttcttgtgtatccagcagttcagtggtttcttggggcatgtgatctccttgagcccagtcccacaggctgtaatcgaaggtcctcaggccacactccccagccccgctggctgcctgcgcattccttatcttggccatgttccttccacagggctcttgtccacactgtcccctctgccagaatggtttgccctcccccatgccatctgctcctcctcctgccacctcagggaaggcctctcccacctccctgactaggtcaggtcccctcgtgccacagcctrgtgtgtctctcctttaaatactcctcagctgcagttttacgttctgttctgggatgccctggaaaatgctgggctcctgcagatatggcccgcagctcctgcgctctctgctctatccccacccctagcccagctgctacagcagcttccctcggagggttaccatgcagtaggtcctgttctaagctctttccacagattatctcattccatcctcaggacaaccctatgaggtaggatctatgattatccccattttacagatgaggaaagtgaggcccagaaggctaagtgaaggca

SEQ ID NO: 69186 - DNA, 601 bp, Human; identical to SEQ ID NO: 33681

SEQ ID NO: 69187 - DNA, 601 bp, Human; identical to SEQ ID NO: 33682

SEQ ID NO: 69188 - DNA, 601 bp, Human; identical to SEQ ID NO: 33683

SEQ ID NO: 69189 - DNA, 601 bp, Human
ctgtcattaagcgttttagtccttcaacttcatcttctcctgggttaagttcaccaccaggtctgtataaaagttaagaatttcagctttcaacttaatacaatttggagataacaaataacacaataattgttatttctaccaagtcactaagaacatatttcagcataataaggcaatcaaaacaagtatcaaagtgaagggggagaatatgcttgaattcatgtcaattccccagactaacagtatacaaaccctaggtttttttcctcttcgtatatatttatttttattttattgkagattcaacgggtacatgtacaagtttgttacataggtatattgtgtaatgctaaggtttaggcttctagtgaacccatcactgaaacagtgaacataacatccaataggaagtatttcaaccctcgcctccccctcaccctccccacctttggagtatacagtgtttattttttccaactttatgtccatatgtacccatcacataaaccctagttttaaacaaacagaatatataacatagcacaaacataaacaaaattgctaaccaccagtccatcccaatctcctctctgggagc

SEQ ID NO: 69190 - DNA, 601 bp, Human
agactagaaatgatgggtccatatcctggtgcattgtcatacaattcaaacaatggtgcagctaccagcttgtaatttttagggactgcaaacaaggctaaaataaaacagaattcattattataagttattatataatcactgcttccatttcatttttaaattaccaattttacatttaataaaaagtgtaagaaaaaagataattctcattaatacattttggttgtgtctttcaaggtagatttcctagccacagatttgaaactaaaagcatggtatacatctttagttttacaayaaacccaaaagttcaaggaactttgagaaaacacaaatagaggtatccttgaaattattctacagaatttttagatggctacctttgaaaacaaaataacttacctttttcttgaagctgaaccagaaacaacttcttatgttccttaggctttgtaatatgtgcaggaatatatggatactgaaattacaaatgaatacaactttaatatgtattccatggcttcatttctttacatgtttactccccagtatagtataaactgttgggagaagcatactactttctgtcctctttacc

SEQ ID NO: 69191 - DNA, 601 bp, Human
gcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcaggtacgtgtccccagggctggttctccgcgcccctagtggctctcctggcttggaagggtatggacaggagtggggcgtgggggcggggtgcgcaactgtggctccctgggcttccctgcgtcaagggatgggctccccccttaggaagccgaggagrgaggttcgctcaaggccaggaattcaagaccacctaaagcaaaatagcgagacccccgtctcttctacacacacacacacacacacacaaaataaataaaataaaataaaataaatataaaattaaaaaacgaccgggcgcagtggctcacggagcctccacctgctgtcgagactagcctggccaacatggagaaacctcgtctctactaaaaatacaaaaaattagcctggcatggtgtgcatgcctgtaatcccagctacttgggaggctgaggcaggagaatctcttgaacccggg

SEQ ID NO: 69192 - DNA, 601 bp, Human
ggtccaccttaaggagaagatgtcctggcctggagcccctgagggctcaccagtctctgggtcaaagctgatgggagcacctccttcctcagccctgacctggcccagccaggccacccaacccttctcctctgcaagccagtgggctgtccctgaagccctgctgatcactgattggaacagaggtggagaaagaggtcttgagggacttgagctgcaggggtgctggagaaggtagaaatggggttcggggtgccatcctgaaggttagaaccttctaggggagggtgtcatggaggarggggtgccaggtagtagtgtttgtagatttgggccctccacaatgtcttggggtatgtgggaattagggctgggaacccccagctcccagaccagaaacactcttgtatcttacaaatccaatgctccaggtccctgacccctcttcctccttcctctcttgttctcctcctccctccccgcccccgccggccccctccccaccgcagaaagtgggcttttgctgccaccacaagttgtaggtgctttattcccaaatctccgttcatctcgaaccacagcatgtccacgtgtgtccgat

SEQ ID NO: 69193 - DNA, 601 bp, Human
cctggtctgggggtgaggcaaggcagggtgtccttccagaagctgggacccagagagagaagtgaggaaagagagtcccgccgggcgcagtggttcacacctgtaatcccagcactttgggaggccaaggctggcggatcacgaggtcaggagatcgagaccagtctggccaacatggtgaaacccccgtctctacaaataatgcaaaaactagtcgggcgtggtggcacatgcctgtagtcccagctgctccggaggctgcggcagaattgcttgaacctgggaggcggaggttgcagtsagccaagattgcgccactgcactccagcctggcgacagagcgagactccgtatcaaaaaacaaaacaaaaaaagagagtcccaggcagggggaacagcatgtgcaaagtccctgtggcaggacggtgtgtggtacaagggtgggaagaaagcctgtgtgccagagagggtgtgggtacagcatggcaggaggaggatgggcacgggggctggtcctccaggtgccttgtggaccatgctgaggaaggacatagggagccatggaagaggttaggcagatggcagagaggtggtcatgaga

SEQ ID NO: 69194 - DNA, 601 bp, Human
tgtatttttagtagagactgggtttcaccatgttggtctggctggtctcaaactcctgacctcaaatgatttgccgactttggcctcccaaaatgctgggattataggcattagccactgctcctggcctcttttctttaaaatgcagcccttgtctgggtgtagtggctcatatctgtaatcccgacactttgggaggcctatcatgaggatcacttgagcccagaagttcgagaccagcctggacaacatagtgagagctcatctttacaaaaaattttgtaaaagtaaaaaaaaaggycaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcggaggttgcagtgagctgagatgacgccaccgcactccagcctgggcgacagagcgagactccgtccccccatcaaaaaaataaaaaagag

SEQ ID NO: 69195 - DNA, 601 bp, Human
gatcacttgagcccagaagttcgagaccagcctggacaacatagtgagagctcatctttacaaaaaattttgtaaaagtaaaaaaaaaggccaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcrgaggttgcagtgagctgagatgacgccaccgcactccagcctgggcgacagagcgagactccgtccccccatcaaaaaaataaaaaagagaaaataaaataaaataaaataaaattcagcccttgctgggcatggtggcacatgcctgtagtcccagctactcgggaggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctg

SEQ ID NO: 69196 - DNA, 601 bp, Human
cctggacaacatagtgagagctcatctttacaaaaaattttgtaaaagtaaaaaaaaaggccaagtgcagtggctcacacctgtaatcccagcactttgggaggttgaggcagacagatcacgaggtcaggagttcgagaccagcctgaccaacatggtgaaaccccgtctctactaaaaatacaaaaattagccgggcatggtggtgtgcacctgtaatcccagctactcaggtggctgaggcaggagaatctcttgaacctgggaggcggaggttgcagtgagctgagatgacgccacygcactccagcctgggcgacagagcgagactccgtccccccatcaaaaaaataaaaaagagaaaataaaataaaataaaataaaattcagcccttgctgggcatggtggcacatgcctgtagtcccagctactcgggaggccaaggcaggagggtcacttcagcccaggagttaaaggctgccgtgagccgtgatcacacctgtgaatagccaccgcactccaacctgggcaacacaacaaaacctcgtttctaaaaaaaaacaaaggctgagcacggtggcttacacctgaaatgccagc

SEQ ID NO: 69197 - DNA, 601 bp, Human
aagtgacgtgatcttggctcactgcagcctccgcctcctgggttcaagtgattctcctgcctcagcctcctgagtagctgggattacaggttcccgccaccatgcacagataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctct

SEQ ID NO: 69198 - DNA, 601 bp, Human
agataattgttttgtatttttagtagagacggggtttcaccatgttggccagggtggtcttgaactcctgacctcaagtgatctgcccacctcggcctcccaaagtgttgggattacaggcgtgagccacaatacccggccacaaacatctttataatggtgctccacaggattctttttttttttttttttttgaaacagggtctcactctgttgcctaagctggagtgcagtggtgcgatctcggctcactgcaacctccacctcccgggttcaagcaattctcaaaaaaaaaaaaaaattaggcacggtggctcacacttgcaatcccagcactttgggaggctgaagcgagtggatcacttgagcccaggagaccaatctgagcaacagggcgaaatcctgtctcaattaaaaatacaaaaaactagctgggcatggtggtgcctgcctgtgttcccatctacttgggaggctgagttgggaggatctcttgagcctaggagataaggctgcagtgagctgagactgcgccactgcactcaagcctgggtgacagagtgagacccctgcctcaaaagaaaaagaaaaaatgcaggca

SEQ ID NO: 69199 - DNA, 601 bp, Human
ctgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggcaggaggctggtggtttggcacctgcagccattccaacctcaacggccagtacttccgctccatcccacagcagcggcagaagcttaagaagggaatcttctggaagacctggcggggccgctactacccrctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatgga

SEQ ID NO: 69200 - DNA, 601 bp, Human
taaccagcctctctttttacacgttgggaaactgaggcccagagtgacaaagacacagtttataagtgttggaacccgattgagcccaggccacctgtaggccttaccacttaggaagcgtgtcttagggggcttgtggccagcatctgggactttgggttgttggaccaacttcttccaacacgtgcgcactgatggccggggccccagccagcctgctggagggtcttccccgcccgagggactgagggggctctaggagcatcacataaggcctaggtagatcaggcagccattgccyatttagggacagctggaggaagccggagtcccttgtttctcagctgagccttctgtgcccagctacactttggcctagtggtctgccctggttgctgggctccctggctgacaatggcagcccttgagggctaacccctggatccaaggtgccttcaccctgcggcctgctctatgagggcctgcgtcgcacatcagctgttggtatcctcacctcgctgagccgttcctccgagtgtgctctgtggcttgcaccaggcctagctgggccttgtgtctggtctcatccagcgtcttctga

SEQ ID NO: 69201 - DNA, 601 bp, Human
aaccagcctctctttttacacgttgggaaactgaggcccagagtgacaaagacacagtttataagtgttggaacccgattgagcccaggccacctgtaggccttaccacttaggaagcgtgtcttagggggcttgtggccagcatctgggactttgggttgttggaccaacttcttccaacacgtgcgcactgatggccggggccccagccagcctgctggagggtcttccccgcccgagggactgagggggctctaggagcatcacataaggcctaggtagatcaggcagccattgcccrtttagggacagctggaggaagccggagtcccttgtttctcagctgagccttctgtgcccagctacactttggcctagtggtctgccctggttgctgggctccctggctgacaatggcagcccttgagggctaacccctggatccaaggtgccttcaccctgcggcctgctctatgagggcctgcgtcgcacatcagctgttggtatcctcacctcgctgagccgttcctccgagtgtgctctgtggcttgcaccaggcctagctgggccttgtgtctggtctcatccagcgtcttctgat

SEQ ID NO: 69202 - DNA, 601 bp, Human
gcaggtgcccggcccaaggtctcgcccctcgtggcaggaggaagctttggaagggttttggagactgggattctaaggggccgtctggagacagggggactaaactttgggtcctgctgatcgggtgccatctccactcagcccaccgtgaggcagctgctcccaggtcctggctgggcacccacccagacgtggcactgccagggcaggggtgttgctccccacatgccccatccaggtttctgtggttatcccctgcttgttatttttgcccttttgctgtgttaaatgacccagctcygagtgcttgctcaagtcatggttttgccctttagattatttccttgaagtgcgttcccagcagaacagttactgggtcaggagcaatggagaggctgtgtggttcccgggacttgtctgcagagactgcttcctggaaacactgatttagcttctgcggcatctggcatttggcgggcaggcggtgtggggtgggggggggcggtgcctgccctgctgccctccccacactggcctccttttactgagtctagcaggtgccctgctgaccttctcaagctagttggtagcaaaaatctaa

SEQ ID NO: 69203 - DNA, 601 bp, Human
gcaccattcccctgaagagtctctcagtctgcctgagcattagggtctgggcccccagggccaccacactgtcatggggcaggccagggcacctaggacttctcagaggtgccagttctttgtttttgccaaccgggcttgcctgctctgtcagccaagtggcgtgtctggggtaggggggtcgcttcccagccagtgaagccaccaacttctgtggaaatgctcggagctgtgtcctcaagggctctttatttccccaagacaacagattgcttgtgtcctagacaatgaagttttcatycccagcctgcatcctggaccagcccgccactgccccgctggccacctctctgcatcgggcacccagtgccagggactggttgggcagctcagcctctttgccattcacctgttttgtcacccagactggagtgcagtggcttagtgtcagctcactgcaacctccgcctcctgggttcaaatgattctcctgcctcagcctcctgagtagctgggattacaggtgcctaccaccatgcccacctattttttgtatttttagtagagacggggtttcgccatgttgacaggctggtctcga

SEQ ID NO: 69204 - DNA, 601 bp, Human
aggccagggcacctaggacttctcagaggtgccagttctttgtttttgccaaccgggcttgcctgctctgtcagccaagtggcgtgtctggggtaggggggtcgcttcccagccagtgaagccaccaacttctgtggaaatgctcggagctgtgtcctcaagggctctttatttccccaagacaacagattgcttgtgtcctagacaatgaagttttcatccccagcctgcatcctggaccagcccgccactgccccgctggccacctctctgcatcgggcacccagtgccagggactggytgggcagctcagcctctttgccattcacctgttttgtcacccagactggagtgcagtggcttagtgtcagctcactgcaacctccgcctcctgggttcaaatgattctcctgcctcagcctcctgagtagctgggattacaggtgcctaccaccatgcccacctattttttgtatttttagtagagacggggtttcgccatgttgacaggctggtctcgaactcctgagctcaagtgatccacccgccttggcctcccaaagtgctgggattacaggcgtgagccactgcacctggcctg

SEQ ID NO: 69205 - DNA, 601 bp, Human
agacggggtttcaccatgttagtcaggttggtctcaaactcctgacctcaaatgatccgcctgcctcggcctccccaagtgctgggattacaggattacaggcatgagccactgtacccggccatctttctgtctttctctgaagtccacttggtagccctgtgcggggcacccatggtgacgtgagagaatgccagccccgttgtcttaggtctttcacgccaggccaagcagtggtctttggggagaggagaggtctgagccgaggggtcttgaaggatgagtaggagtttgctggcckccccagggggacaggctgccctatgcggtgggagctggggtgcccagagcctcaatgcccaccccataaggcagaaccacgactcccgagccacgtgctggggtttggggtaggacagtgagtgtggcagtgagttgcgaaggaagaacttggactgtggatgcagaagacctgggttcaaatcctgcctggctcacttcccaggcggtggctccagacaagtcacttggggagcaccgttgggaggtgagggcgagcccacaaacatgcatagcttcagggtcctgctctgccccgcac

SEQ ID NO: 69206 - DNA, 601 bp, Human
gccagcctttttggcattttgtttgttcacttgacagacattttcttgggtgtttattgtgtgccaagcactgtgccaggacctgattcctgcccttggggcagactggcaaaagataaatgccacctgacaggtgagagagtggcaagagtgacggaggaagaactgggtccgggagcagggtaattcggagagtagagttttagtagcatagcagggagggccttcttggccaagtggcatttaaggggccacacgaaggggatgagggagggagccaggtgtgtgcctggagaagagtgtttctggcagcaggagcaacccgtgcaaaggccctgaggcaggatcgcacctggcgtgttgggggaacagcatggaggcctgtgtggctggagcagagtgagccggggggggggcgggagggaggaggggagggccctgtgggcagcggggaggactgtggcttttcccctgcggaaggtgggggccacggagggttgtctgcagaggagggagggaggtgccctggctcggcactcacgggcgctctctggtggctgctgcaggaggacagcgttttggttggtgatgagcgtgaaca

SEQ ID NO: 69207 - DNA, 601 bp, Human
tgagcgtgaacacagggaccgcacagacaataccttccagggtctgagagtctggaatggaatcgcccagggagacatggtggggtgcacccctcgtcctcccttctcttggatctgtttcggatgtgctgaaggattgattctgagatgcgagagaaaggaaggagtcgagaatgactccaggtttctggcatgagtgcctggtaggaccaagccaaagttaaccaagataaggagggtaggtgagcggtgggtgagcaggcttagggagtgatcgggagcttggctctgctcttctggktatgaggggcctggggcccctgaggagacatgaaggagacaatgggcacgccagtctgggcttctagggagagaggtaatataggagttaccagcccatggctggtatttacagccatgagcctggatggggtcacctggggactgggtgtggacagagatgcctgtcctgaggctccctgaggttcgaaggtagagtgggagactgagtgggagtgactgtgaggagaggagtcggggtgtggagcccctgcaggcagggaaggagggagagctggctgggtgcctgctgcacaggccc

SEQ ID NO: 69208 - DNA, 601 bp, Human
ccccgtccctgggtgctgttgcccacaaaccctcatctctgttctgtccacgctgcgctgactcctttctgggccagggtttgcatcttggcaagctgctctgctgtgcacccccctcctgggacaatgcatacctgtgttggagccttgtgaggagctgtgcacacacgtggactgccacacggactgccccttgaatgaggacttagccttggctggagctccctgcagctcagcaggggacctgaccctggggacaggggtggtgggaggtggctgcaggctctttcctccgggctgygtcctcagggcacattcctgtttcccactcagccatctgtgccgaagctggatgtgggtttgctgcaccaggagaggtgggggttgaggtgggagtagctcctcatgtcctgtcacttacatacctggagcagtgacccttcccatgccctgaccagaaaccacaacaaccgtgacagctgcctactcgtgtcccttcctgtgcgatgcctgctcttttcgtggggggagacagaatctctgttgcctaggctggagtgcagtgattcgatctcggctcactgcagcctccacctcctgg

SEQ ID NO: 69209 - DNA, 601 bp, Human
gttgaggtgggagtagctcctcatgtcctgtcacttacatacctggagcagtgacccttcccatgccctgaccagaaaccacaacaaccgtgacagctgcctactcgtgtcccttcctgtgcgatgcctgctcttttcgtggggggagacagaatctctgttgcctaggctggagtgcagtgattcgatctcggctcactgcagcctccacctcctgggctcaagcgattctcctgcctcagcctcctgagtagctggggctacagtagccaccacgcccggctaattattattattattatttttttttttgagatggagtctcgctctgtcacccaggctggagtacggtggcgtgatctcggctcactgcaagctccgcctcccggattcacgccattctcctgcctcagcctcccaagtagctggggctacaggcgcccgctaccacacccagctaattttattgtatttttagtggagatggggtttcaccacgttagccaggatggtctcgatctcctgacctcgtgatccacccgcctcggcctcccaaagtgctgggattacaggtgtgagccaccgcgcccgggtacttttt

SEQ ID NO: 69210 - DNA, 601 bp, Human
agtagctcctcatgtcctgtcacttacatacctggagcagtgacccttcccatgccctgaccagaaaccacaacaaccgtgacagctgcctactcgtgtcccttcctgtgcgatgcctgctcttttcgtggggggagacagaatctctgttgcctaggctggagtgcagtgattcgatctcggctcactgcagcctccacctcctgggctcaagcgattctcctgcctcagcctcctgagtagctggggctacagtagccaccacgcccggctaattattattattattatttttttttttgagatggagtctcgctctgtcacccaggctggagtacggtggcgtgatctcggctcactgcaagctccgcctcccggattcacgccattctcctgcctcagcctcccaagtagctggggctacaggcgcccgctaccacacccagctaattttattgtatttttagtggagatggggtttcaccacgttagccaggatggtctcgatctcctgacctcgtgatccacccgcctcggcctcccaaagtgctgggattacaggtgtgagccaccgcgcccgggtactttttgtattttttat

SEQ ID NO: 69211 - DNA, 601 bp, Human
agctccgcctcccggattcacgccattctcctgcctcagcctcccaagtagctggggctacaggcgcccgctaccacacccagctaattttattgtatttttagtggagatggggtttcaccacgttagccaggatggtctcgatctcctgacctcgtgatccacccgcctcggcctcccaaagtgctgggattacaggtgtgagccaccgcgcccgggtactttttgtattttttatagagacgggatttcaccatgttggccaggctggtctcgaactcccgacctcaagtgatccgcstggctcatcctctcaaagcattgagattacaggcgggagccaccgtgcctggccatgcctgctcttacttcctcctcctgtgactgccttcctgttcacacatttggaaaaagtagtccagaggtgaagtgacttgcccaaggtcaccccgctcaggagccttctcaagccgtgtctggctgcccagccaccaggctgcaggtggaggctcagggttgatggatctcgagctgctctgcctgcctggctgcctgggtccccttgccccagctgggacagccctgctctgaggaccagaca

SEQ ID NO: 69212 - DNA, 601 bp, Human
tgagattacaggcgggagccaccgtgcctggccatgcctgctcttacttcctcctcctgtgactgccttcctgttcacacatttggaaaaagtagtccagaggtgaagtgacttgcccaaggtcaccccgctcaggagccttctcaagccgtgtctggctgcccagccaccaggctgcaggtggaggctcagggttgatggatctcgagctgctctgcctgcctggctgcctgggtccccttgccccagctgggacagccctgctctgaggaccagacacaggcaggtgttgtgctatccrcagtggctgtttctggaaggcaggagcctgccttcacttctgcaccacttagcacagtgcctgcaggccctgggctccaggcatctctcgactcctccacaccgttggcagccgcgttggtgcagcacccagggaaccggcgggaaggttgtgggggcagtcgtgggtggagtgtggggattcacagaacctcgccttcccgcccagtggtgctcatcggggactcaggcgtgggcaagagcaacctgctgtcgcgcttcacccgcaacgagttcaacctggagagcaagagcaccatcg

SEQ ID NO: 69213 - DNA, 601 bp, Human
tggggtttctccacattggtcaggctggtctcaaactcccgccctcaggtgatccaccctctcggcttcccaaagtgctgagattacaggtggcgtgagccaccgtgcctggctgtcgcctcctcttttttggagacagacagggtcttgctctgtcgcccaggctggagtgcagtgccacaattgcagctcactgcccccttgacctcccaggctcaagcgattctcctgcctcagcctcctgagtagctggggctacaggcctgtgccaccatgcctggctaatttaattaattaattwatttattttttagttttagtttttgagacagagtctcactctgtcgcccaggctggagtgcagtggcgcagtctcagctcactgcaagctctgcctcccaggttcacgccattctcctgcctcagcctcccgagcagctgggactacaggcgcccaccaccacgcctggctaattttttgtatttttagtagagatggggtttcaccgcattagccaggatggtctcgatctcctgacctcatgatctgcccgcctcggcctcccaaagtgctgggattacaggcgtgagcgaccatgcc

SEQ ID NO: 69214 - DNA, 601 bp, Human
atttattttttagttttagtttttgagacagagtctcactctgtcgcccaggctggagtgcagtggcgcagtctcagctcactgcaagctctgcctcccaggttcacgccattctcctgcctcagcctcccgagcagctgggactacaggcgcccaccaccacgcctggctaattttttgtatttttagtagagatggggtttcaccgcattagccaggatggtctcgatctcctgacctcatgatctgcccgcctcggcctcccaaagtgctgggattacaggcgtgagcgaccatgccyggcctatttatttatttttttgagatagagtctcactctgtcatccagactgaagtgcagtgtcacaatctcggctcactgcaacctccgccccccgccccccagggttcaagcaattctcctgccttagcctcccgagtagctgggattacaggcgcctgccaccacgcctggctaatttttgtatttttagtagagatggggtttcaccatcttggccaggctgatcttgaattcctgacctcgtgatccacctgcctcggcttcccaaagtgctgggattacaggcatgagccacca

SEQ ID NO: 69215 - DNA, 601 bp, Human
gaattcctgacctcgtgatccacctgcctcggcttcccaaagtgctgggattacaggcatgagccaccacccccggccaatttttgtgtttttctagtagagatggggtatcgccatgttgcccaggctggtctgaaactcccagcctcaagtgatccacccgcctcagcctcccaaagtgctgggattacaggcatgagccaccatgcccagccccttcttccctttttttgatgacctcacggtatcttctatttccagctcccaaactccctcctcagacccccacatttcagagctsaatccagggagcagcgctggggcctccagacacacacccttcccttgaggccacaatgactgccccttggctcggccctggacgacccaccctgggcgtgatgtgtgctgttatcccgtgaggctgccgctgcccatggttgtcctccagagaggctcatgggcccctgaccctgcaggtactaccgtggtgcagtgggcgccctgctggtgtacgacatcgccaagcacctgacctatgagaacgtggagcgctggctgaaggagctgcgggaccacgcagacagcaacatcgtcatca

SEQ ID NO: 69216 - DNA, 601 bp, Human
aattcctgacctcgtgatccacctgcctcggcttcccaaagtgctgggattacaggcatgagccaccacccccggccaatttttgtgtttttctagtagagatggggtatcgccatgttgcccaggctggtctgaaactcccagcctcaagtgatccacccgcctcagcctcccaaagtgctgggattacaggcatgagccaccatgcccagccccttcttccctttttttgatgacctcacggtatcttctatttccagctcccaaactccctcctcagacccccacatttcagagctcratccagggagcagcgctggggcctccagacacacacccttcccttgaggccacaatgactgccccttggctcggccctggacgacccaccctgggcgtgatgtgtgctgttatcccgtgaggctgccgctgcccatggttgtcctccagagaggctcatgggcccctgaccctgcaggtactaccgtggtgcagtgggcgccctgctggtgtacgacatcgccaagcacctgacctatgagaacgtggagcgctggctgaaggagctgcgggaccacgcagacagcaacatcgtcatcat

SEQ ID NO: 69217 - DNA, 601 bp, Human
gacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgygctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagcccc

SEQ ID NO: 69218 - DNA, 601 bp, Human
tccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcgggagaattgtgtgaactcgggaggcggagcttgcagtgagctgagatggcaatagagcaagactccatctcaaaaaaaaaaaggccagcattagtgaagcattcacatttttgtcaatctattctcatctcatgctgttcctcctatattgtattatctctatcattaaataagtgtctttttaaaggaaacacttcaagttgaagaagatgatcgacctgagttaccatggtggaaatgcaagaagtgggccttacatattttagcaagactttttgaaaggtaatctcatccatatatggtgatttaaattaatttattaaggttttgctttaaagtgctagcataaagcattataaagaaacaatgggcattttgatgt

SEQ ID NO: 69219 - DNA, 601 bp, Human
tattaaggttttgctttaaagtgctagcataaagcattataaagaaacaatgggcattttgatgttcttttagatatggaagccctggcaatgtttccaaggagtataatgaatttgctgaagtatttctgaaggcatttgctgttggtgtccagcaagtaagtctgtttttagtttttctcagtggaaacatggcatctttaagttaatttatatattgcttattcccagtttctttgacatctaaagagtgcctgtttggaccctgtaccaggtctcaaacatttttggtctcaggatmtctttatgttcaaattacttaggataccattgggttctcatttatgtgagttatacctagtaatatttatcatattagaaattagagtaaacagttcattaaaatataataacaggcctattatatgttaagacaataatttttttttctcttgttgcccaggttggagtgcagtggcgtaatctcggctcactgcaacttctgcctcccaggttcaagcgattctcctgcctcatcagcctcccgagtagctgggattataggcatgtgccaccacacccagctaattttgaattttta

SEQ ID NO: 69220 - DNA, 601 bp, Human
tcccagcactttgggaggccagggcgggcagatcacgaggtcaggagttcgagaccagcctggccaacatggtgaaaccccgtctctactaaaaatacaaaaattagctgggcgtggtggtgcgtgcctgtaatcccagctattggggaggctgaggcaggagaatggcttgaacccaggaggcagaggttgcagtgggctgagatcacgccactgcactccagcctgggttacagagcaagactccatctcaaaaaaaaaaaattcttaagaaaaacttgttctaaggctgggcgcagtkgctcacgcctgtaatcccagcactttgggaggccaaggcgggcggatcacgaggtcaggagatcaagaccatcctggctaacacagtgaaaccccatttctactaaaaattcaaaaatgtagccgggcgtggtggcgggcgcctgtattcccagctgcttgggaggctgaggcaagagaatggcgtgaacctggggggtgcagcttgcggtgcgcagagatcctgccactgcattccagcctgggcgacagagcaagactccgtctcaaaaaaaagaaaacttgttctataagaatatgg

SEQ ID NO: 69221 - DNA, 601 bp, Human
ttttgtttttttttttaaaaaaagacaatatcattatgaaagtagctttaaactagtagatcctctgaaatagtcttggggaccactagaggtttgtggaccacattttgtgtgtcagtgttctgaaacatgaagtagagttagaactattgacagatgctaaataggcagttgactgctttgggtaaggttttcccagaagatggctttaacaagatagggttttctcccaatactgtggtttttcaataggtagcaaatgggttaggtgtggtgacttacacctgtaatcccagcactytgggaggctgagatgggagaatcgcttgaggccaggagttagagaccagccggggcaacgtagtgagacactgtctctaacaacaacaacaaaaaaaaccccagaaaaacgaagatagtatatagttttctcttcttttcattcttaatcagaaatgagttaaattatttttcaaagtatacggttgtttttcttgatgatgagcttgtcattaaaatatgtgttaactgtttttactggcttgtaagtggttgaaatttctatttgaacattgatttgtgatcgaaaatttttttccaa

SEQ ID NO: 69222 - DNA, 601 bp, Human
atcggtttcatggaagataatttttccacagatggtccgggggagatggctttgggatgaaactgttccacctcttatcagacaggcaatggtttctcataaggggtgtgcaacctagatccttgaatgcacatttcacagtagggttcacgctcctgtgagaatttccgggagtaatgctcactcacctaccacttatctactgctcctaacaggccatggaccggtaccagtccactgcctggagactggggacccctgccttatagtagatatttcacagacattactgtgtagcacrtaaagcccttgacagatacttaacttacttaattctaacacaatcatgtgtcagaattattcctgttttacggagaaaatatgaggtataaaatggtttattgcctaagctaggcagggtgcggttgggatttatatatgggccttcatggtacttgttcttaactactacctcgggctgcagcatgactatctgcatagtgccctggaatgctcaaaataatcgattgaattttacaaaagataaatcagtgacccccttgatgattaaatatacttttatttggacattgtcaagtgt

SEQ ID NO: 69223 - DNA, 601 bp, Human
ctagcaatgtctgttgtaggtcgttagaaaatgatttgctccatgaagtttttagatttctttcactcatctctttcctttctgaacacgaagtcacacataatcatctagttatgttagtcattttttactgccaattatattatttatattaatattctgggagcagagatatacctatactatctacatttctattcctgaacacttattcatatgtttatactcatctagttttcactagccttcaagtccatgttcatttcttgtctggagtttatagggcaacatttgccctcarcaggctgcctcttcctccctccgttcctctctcccctactggttttttgtgttattgttgttttcttttttaaagagaaaagggtttcctagaaatgtcaacatcttagctttttgtagttctttacgtgagaaaggttaggtgttttagctaccacctgtgtatgagaagttagtggttgtcaacttgctgtaatccagaatggcactacaggataggtgctttgatcacaaagaccaagatgccagagggctagactatgaaagataggaggcagacagctccagatcctcacagcta

SEQ ID NO: 69224 - DNA, 601 bp, Human
aagggtttcctagaaatgtcaacatcttagctttttgtagttctttacgtgagaaaggttaggtgttttagctaccacctgtgtatgagaagttagtggttgtcaacttgctgtaatccagaatggcactacaggataggtgctttgatcacaaagaccaagatgccagagggctagactatgaaagataggaggcagacagctccagatcctcacagctatccagatcctttagtctttcatctgtgcaatgaacattgcagttattcatattaattagggtacctcaagtaatactcagcctgtacacagggtaggaaattgtttccttgatttagatacctgatttaaaggataaagccttactgcaatttatattctgttttgatcaggttcttacaggagttgcaggagaagatgcagagtgtcatgcagcaaaattgttagaggtcatcattctgcagtgcaaagggcgtggcattgaccaggtcagtgaagctaataatgatttgtagttcagaggggtaatcttttccttccactttctttcttcattttttggcatttgttgcatattctgtatgtttttgtttattgagac

SEQ ID NO: 69225 - DNA, 601 bp, Human
ctcagctcactgcaacctctgcctcccaggtgcaagcagttctctgcctctgcctcctgagtagatgggattataggtgcctgccaccacacctggctaattttttatatttttagtagagaaggagtttcgccattttggccaggctggtctcaaactcctgacctcaagtgttctgcccacctcagactcccaaaagtgctgggatcgcaggcatgagccacgtcacccggcccacggtcaattttaataggaacttgtgaagccatgattgatatcatcgtgagcttttatttatttwttatttatttcatatatttttttgagacggagtctcgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggc

SEQ ID NO: 69226 - DNA, 601 bp, Human
ataggtgcctgccaccacacctggctaattttttatatttttagtagagaaggagtttcgccattttggccaggctggtctcaaactcctgacctcaagtgttctgcccacctcagactcccaaaagtgctgggatcgcaggcatgagccacgtcacccggcccacggtcaattttaataggaacttgtgaagccatgattgatatcatcgtgagcttttatttattttttatttatttcatatatttttttgagacggagtctcgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgc

SEQ ID NO: 69227 - DNA, 601 bp, Human
ctgccaccacacctggctaattttttatatttttagtagagaaggagtttcgccattttggccaggctggtctcaaactcctgacctcaagtgttctgcccacctcagactcccaaaagtgctgggatcgcaggcatgagccacgtcacccggcccacggtcaattttaataggaacttgtgaagccatgattgatatcatcgtgagcttttatttattttttatttatttcatatatttttttgagacggagtctcgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcag

SEQ ID NO: 69228 - DNA, 601 bp, Human
gcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtytgcaagttgcaattgcagctttgtattataatccacacctactactcaataccttagaaaatcttcgcttccctaataatgttgaaccagttacaaatcattttattacacagtggcttaatgatgttgactgtttcttggggtaagtgatgtattgcaattttactacatttgctttgggaggaactctgcttatttaagaaaagaaaacagtttttttttttttttttaggcttcatgacagaaagatgtgtgttctcggactctgtgctcttattgatatggaacagataccccaag

SEQ ID NO: 69229 - DNA, 601 bp, Human
atatatatatatcactagcccttctcccaaataaatgtgggatcatacccaaatgctttcattcacagaaaagacttcctttcttctcactagagtgatgtaatcaggaacttcagctgtattaccaacatgtagaacagttcaaaccattatagtatgcaaccaacaaagatttgtttattttacacattctcagcactgtagatacaaagatgaatgagatgtcatgcagttcttcaaaagttttctatccgactgtgggaaagtattacaaagccaaataattatgtatataataatagagttgacacgaagtgctgagtccacttaagagcgagagattatagttcccttttttatatggtggcatgagcctatagtcccagctacttggaagtctgaggtatcagattcgcttgagcccaggagtttgattccagcctgggtaacatagtgaaaccccagttttttgttttttggctttttttcctttgagacggagttttgctcctgttgcccaggctggagtgcaacagcgcgatcttggctcactgcaacatctgcctcccgggttcaagcaattctcctgcctcagcccccc

SEQ ID NO: 69230 - DNA, 601 bp, Human
ataattatgtatataataatagagttgacacgaagtgctgagtccacttaagagcgagagattatagttcccttttttatatggtggcatgagcctatagtcccagctacttggaagtctgaggtatcagattcgcttgagcccaggagtttgattccagcctgggtaacatagtgaaaccccagttttttgttttttggctttttttcctttgagacggagttttgctcctgttgcccaggctggagtgcaacagcgcgatcttggctcactgcaacatctgcctcccgggttcaagcarttctcctgcctcagccccccagatagctgggattataggcacgtgccaccatgcccagcttatttttgtatttttagtagagacaggatttcaccatgttggccaggctggtctggaactcctgacctcagatgatccaccctcctgggcctcccaaagtgctgggattacaggcgtgagccactgcactgagccgtgaaaccccatttctttaaaaaaagttgtggggattacatgagggaatccttgacgcttaaatagtgcttggcagatggcactgaattaacagtattaacaaag

SEQ ID NO: 69231 - DNA, 601 bp, Human
tttgggaggctgaggcgggtggatcacctgaggtttagagttcgagaccagcctgaccaacgtggagaaaccccatctctactgcaaatacaaaattagccaggcgtggtaggcatgcctgtaatcccagctactcgggaggctgaggcaggagaattgcttgaacccgggaggtggaggttgcggtgagccgaggtcgcgccattgcactccagcctgggcaacaagagcgaaactccgtctcaaaaaaaaaaaaaaaaaatttaaacacttggccaggcgtggtggctcatgcctgtaatcccagcactttgggaggccaagacaggagggttgcttgagtttggaagttgaagtccagcctgggcaacatagtgagacatcatctctacaaaaaataaaattagccaggcatggtggtgcatgcctgtagtcccagctacttgggaggctgaggctggaggatcacttgaatgtgggaggtgtaggttatagtgagccattattgtgccactgtactctagcctgggtgccagagtgagaccccgtctccaaaaatgtaaaaacttacgaagttaaatagctcccagacatatctttt

SEQ ID NO: 69232 - DNA, 601 bp, Human
atctctactgcaaatacaaaattagccaggcgtggtaggcatgcctgtaatcccagctactcgggaggctgaggcaggagaattgcttgaacccgggaggtggaggttgcggtgagccgaggtcgcgccattgcactccagcctgggcaacaagagcgaaactccgtctcaaaaaaaaaaaaaaaaaatttaaacacttggccaggcgtggtggctcatgcctgtaatcccagcactttgggaggccaagacaggagggttgcttgagtttggaagttgaagtccagcctgggcaacatastgagacatcatctctacaaaaaataaaattagccaggcatggtggtgcatgcctgtagtcccagctacttgggaggctgaggctggaggatcacttgaatgtgggaggtgtaggttatagtgagccattattgtgccactgtactctagcctgggtgccagagtgagaccccgtctccaaaaatgtaaaaacttacgaagttaaatagctcccagacatatcttttcatctttaaatgtttcagtgtgcaatttttaaaagtacattttaagccaggcgcggtggctcacgcctataatc

SEQ ID NO: 69233 - DNA, 601 bp, Human
tggtggctcatgcctgtaatcccagcactttgggaggccaagacaggagggttgcttgagtttggaagttgaagtccagcctgggcaacatagtgagacatcatctctacaaaaaataaaattagccaggcatggtggtgcatgcctgtagtcccagctacttgggaggctgaggctggaggatcacttgaatgtgggaggtgtaggttatagtgagccattattgtgccactgtactctagcctgggtgccagagtgagaccccgtctccaaaaatgtaaaaacttacgaagttaaatarctcccagacatatcttttcatctttaaatgtttcagtgtgcaatttttaaaagtacattttaagccaggcgcggtggctcacgcctataatcccagcactttgggaggctgaggctggcggattacttgaggtcaggagttcgagagcagcctggccaacatacagtgaaaccctgtctttactaaaaaacacaaaaattagctggacatggtggtgcacacctgtagtcccagctacttgggaagcagaggcaggagaatcgctcgaacctgggaggcagaggttgcagtgagccaaca

SEQ ID NO: 69234 - DNA, 601 bp, Human
tgcctgtagtcccagctacttgggaggctgaggctggaggatcacttgaatgtgggaggtgtaggttatagtgagccattattgtgccactgtactctagcctgggtgccagagtgagaccccgtctccaaaaatgtaaaaacttacgaagttaaatagctcccagacatatcttttcatctttaaatgtttcagtgtgcaatttttaaaagtacattttaagccaggcgcggtggctcacgcctataatcccagcactttgggaggctgaggctggcggattacttgaggtcaggagttygagagcagcctggccaacatacagtgaaaccctgtctttactaaaaaacacaaaaattagctggacatggtggtgcacacctgtagtcccagctacttgggaagcagaggcaggagaatcgctcgaacctgggaggcagaggttgcagtgagccaacattgcgccactgcactccagcctgggtgacagagtgaaactctgtctctaaaaaaaaaaataaaaacaaacaaaagtacattttaggttatacaccattgttaatgcaaacaattatctatagacttttttttataaattaaa

SEQ ID NO: 69235 - DNA, 601 bp, Human
aatctcggctcactgccacctccatctcccgatttcaagtgattctcgtgcctcagcttccgagtagctgagattgcaggcacgcaccaccacacccaactaatttttgtatttttagtagagacgaggtttcactatgttggccaggctggtctcaaaaactcctgactcctgaggcggatggatcacttgaggtcgggagttctagaccaacctggccaacatggtgaaaccctgcctctactaaaaatacaaaaaattacccgggcgtggtggcacgcacttgtagtcccagctactygggaggctaaggcaggagagaatcgcttgcacctgggaggcagagattgcagtgagccaagatcgtgccgctgcactccagcctgggtgacagagccagactctgtctcaaaaaaaaaaaaaaaaaaagatttttttcttaacagtgggaagtgaaaattggctaagaagtctacagcatacagtaaaagagattatattctctacataatgcatgctcccttgcccttatacattggagaaatcatggattttggaacttcctggccactaatgatggttaagctactggcttgtttaa

SEQ ID NO: 69236 - DNA, 601 bp, Human
tcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctrttttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaa

SEQ ID NO: 69237 - DNA, 601 bp, Human
tatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacrtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatgg

SEQ ID NO: 69238 - DNA, 601 bp, Human
ctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttaygtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataa

SEQ ID NO: 69239 - DNA, 601 bp, Human
ttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacracatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccac

SEQ ID NO: 69240 - DNA, 601 bp, Human
tatggggaaacaggtatgctcatgcattgacaatgggcatatatattggtacagccttctctgtggagaagagtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttytttttttttttttttttcgggggactgagtctcactctgccaccaggctggagtgcaatggcccgacatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaat

SEQ ID NO: 69241 - DNA, 601 bp, Human
gaagagtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgayatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatatt

SEQ ID NO: 69242 - DNA, 601 bp, Human
ctgataaatgcatttctttctttctttctttttttttttttttttcgggggactgagtctcactctgccaccaggctggagtgcaatggcccgacatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggygtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgat

SEQ ID NO: 69243 - DNA, 601 bp, Human
tagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggkggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagca

SEQ ID NO: 69244 - DNA, 601 bp, Human
tttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccaygttcaagcgattctcctgcctccgcctcccgagtagctgggattacaggcatacaccaccatgcccggctaattttttgtatttttagtagagacgggtttcaccatgttggctaagctggtcttgaactcctgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaa

SEQ ID NO: 69245 - DNA, 601 bp, Human
tggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgargagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattag

SEQ ID NO: 69246 - DNA, 601 bp, Human
gaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaatttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataa

SEQ ID NO: 69247 - DNA, 601 bp, Human; identical to SEQ ID NO: 27395

SEQ ID NO: 69248 - DNA, 601 bp, Human; identical to SEQ ID NO: 27396

SEQ ID NO: 69249 - DNA, 601 bp, Human; identical to SEQ ID NO: 27397

SEQ ID NO: 69250 - DNA, 601 bp, Human; identical to SEQ ID NO: 27398

SEQ ID NO: 69251 - DNA, 601 bp, Human; identical to SEQ ID NO: 27399

SEQ ID NO: 69252 - DNA, 601 bp, Human; identical to SEQ ID NO: 27400

SEQ ID NO: 69253 - DNA, 601 bp, Human; identical to SEQ ID NO: 27401

SEQ ID NO: 69254 - DNA, 601 bp, Human; identical to SEQ ID NO: 27402

SEQ ID NO: 69255 - DNA, 601 bp, Human; identical to SEQ ID NO: 27403

SEQ ID NO: 69256 - DNA, 601 bp, Human; identical to SEQ ID NO: 27404

SEQ ID NO: 69257 - DNA, 601 bp, Human
ctctaggaaaatctcaccagttcagaaaaacaatgtatgtattgggcagcagctttctcaaactgcctgaggtcccagtgttcattggtggatgcaaaatgatgctaaagaaatggaagtatcacagaaatccaggtgaagcttgtgtgctggattccaaggcagttttctggacaaggcagttgtggagaccaggtgacttcctgactgcccccacccatggcatggcaatttgtggatactttttctgggacttcatcatgactctttctaaataatcctcactgctttgctttttgtrtttttaaatttcttcttcttccagctgattccctccatattttccttttcaacttctgaagggagagtccagcctagttaatcttggacaaagctgtttatactttttctaccagactgcttcctggtctgcaggtggcctgtgggctggcttcccgtggttcaaatgttcaccctgggtccagtcattggctgccccttacctaagtaacagcccagagcaccagtgcttctaaaagttttgtagtaagtacaaagtagtcacaggtgcattcttgcatatctcctacaatcaaaaatt

SEQ ID NO: 69258 - DNA, 601 bp, Human
actctttctaaataatcctcactgctttgctttttgtatttttaaatttcttcttcttccagctgattccctccatattttccttttcaacttctgaagggagagtccagcctagttaatcttggacaaagctgtttatactttttctaccagactgcttcctggtctgcaggtggcctgtgggctggcttcccgtggttcaaatgttcaccctgggtccagtcattggctgccccttacctaagtaacagcccagagcaccagtgcttctaaaagttttgtagtaagtacaaagtagtcmcaggtgcattcttgcatatctcctacaatcaaaaattcaaaacttatgttattcaagaattgtttttgtgttgggatgttcgtgtggagggtatgcttggagcttgtataatcattgtagtacattcctgctttaatgctgctctttattttctcagcaattttctctaatattttgttgactgttcctttatagtagtttttttttcattcttcagagttttattatatttaactcctaaagttactactcagggtcacatttataaccttgagcattaacatgaccacttagtgacat

SEQ ID NO: 69259 - DNA, 601 bp, Human
cccatagtgctgggattataggcgtgagccagcgcacccggccaaaaaatcccattactctttatctgtagacatattaccatttggtattggtaccagtagacaaatagaagactactgaatgggattcttttttttttttttactgtagcttttttctcctttgccttttgtacctcttccttacagactagatctgcaatgtccaatacggttgccactagccatatgtggctgttaagcacttgaaatatgactagtccaaattgagatgtgctgtaagtggattttgaagacataktacgataaaaataatgtaaaatatcaataatttcttatattgataacgttgaaatgatattttggacatattgtgttaaacaaaataattactattaatttcacctgtttcttttaatttttttcaattggttactagagattttttgttttattttattattatatttatttatgtattttgagatggagtcttactctcttgcccagggtggagtgcagtgatgtgattttggctgactgcaacctccacctgctgggttcaaatgattctcttgcctcagcctcccgaatagctggg

SEQ ID NO: 69260 - DNA, 601 bp, Human
ttcttttaatttttttcaattggttactagagattttttgttttattttattattatatttatttatgtattttgagatggagtcttactctcttgcccagggtggagtgcagtgatgtgattttggctgactgcaacctccacctgctgggttcaaatgattctcttgcctcagcctcccgaatagctgggattacaggcatgcaccaccacacccagctaatttttgtatttttagtagagatgaggtttcgtcatgttgaccaggttggtctcgaactcctgacctccagtgatcaasccacctcagcctctgaaaatgctgggattacaggtgtgagccaacatgccttttttttttttttttttttttttttttttggagacggcatctcgctctgtcacccagactggagtgcagtggcgcgatctcagctcactacaacctccacctgctcagttcaagcagttctcctgctcagcctcccgagtagctgagactgcaggcacatgccaccatgcctgtctaattttttgtatttttagtagagacagggttttaccatgctggccaggctggtctcgaactcctgacattgtg

SEQ ID NO: 69261 - DNA, 601 bp, Human
ctcccaaagtgctgggattacaggcgtgagccaccacacccagctcagtaaatttttaatcacatatgtggcttgcacttgtgacttattatatttctcttcattagtgctggatcagaagttcatgacttcaccattctctaaaatgattaattaccgtatttaaggttgagaacctagtacttggttttttgtggtttttgttttttgagacagggtcttgctttgttgcccaggctggagtgcagtggcctgatctcagctcactgcagccactgcctcctgggtttaactgattcayctgcctcagcctcctgagtagctggtatcacaggagcgtgccaccatgcccggctaattttttatatttttgttaaagaaatatttaaaaaaatgttttttatatttcaccttgttggccaggctgatcacaaactcctgacctcaagtgatccacctgcctcggcctcccaaagtgctgggatttcaggcgtgagtcaccgtgcccagcctgaaccttgcttttctaagtctctttttttctacctctaaaagaaaggtattaattagatccatggttatcttaggggcaaaagtttgg

SEQ ID NO: 69262 - DNA, 601 bp, Human
tgagtagctggtatcacaggagcgtgccaccatgcccggctaattttttatatttttgttaaagaaatatttaaaaaaatgttttttatatttcaccttgttggccaggctgatcacaaactcctgacctcaagtgatccacctgcctcggcctcccaaagtgctgggatttcaggcgtgagtcaccgtgcccagcctgaaccttgcttttctaagtctctttttttctacctctaaaagaaaggtattaattagatccatggttatcttaggggcaaaagtttggtgtttttttttttttgtttattttttgttttttgagatggagtctcactctgtcgcccaagctgaagtgcaatggcctgatcttggctcactgtaacctccacctcccagttgaactcctgacctccagtgatccacccacctcagcctcccaaagcactaggattacaggcgtgagccaccgcacctggccaaagattttttttttttttttttttttttttttttgagacggagtctagctctgtcgcccaggctggagtgcagtggcgcgatcttggctcactgcaagctccacctcccgggttcacgccat

SEQ ID NO: 69263 - DNA, 601 bp, Human
ccaccaccacacctggctaattttttgtatttttagtagagatggggtttcaccgtgttagccaggatggtctcgatctcctgacctcatgatccgcctgcctcggcctcccagagtgctgggagccactgtgtgagccaccacgcccggccaaggttatgtcttaattctcagaacatacattaagtttaaataccagtgaagtcattttctatacatggtttttagaagctgattagtatttcactggtgttagcttcaaaattgcccttgagagttttcacttgtgatgacatatcasattgctgtttctttgacagagactgcacatatctcatgctgcataaccctgaaatacctgttatagttttggtcttttaatttagcttttgagttttggattctgtccattttttcccctaaaacatctgtagaatcagctattgctttctattccacagtcattatcctaggtttgtttttatgacttctttcctgcatatttatgattatacaaacttcttttgggctccctacctcatttgtcttttcagtctgttccccgctattactgtagttctctttctaaaacgcagatagc

SEQ ID NO: 69264 - DNA, 601 bp, Human
agcttttttttttttttttgcttttttttttttttgagacagggtctcatttgttacccaggctgggtggcagtggcacaatcttggctcactgcagcctcaacctcctgggttcaagcagtcctcctgcttgatgacagcctgggatgacaggcacgtaccaccatgcccagctaatttttatattttttttgtagagatggggttttgccatgttgcccaggctggtttccaactcctgggctcaagtgatccacctgcttcaatctctcaaaagtgctgggattacagacgtgagctrccgtgcctggtagaactttttgttcttcactatggtatccagactcctccagagtacatgtgttgctgttataatacatgaaaaaaaaatgaagttattaaaataatagttgatttttaaagggttcatagaggctcttctgttttcatgagcaataaacagaaactgatctttttgagacaggatctcattctgatgcccaagctggagtgcagtggggcgatcatagcttactgcagccttgacctcccaggctcaggtgatcctcccacctcagcctcccaagtagctgggaccaca

SEQ ID NO: 69265 - DNA, 601 bp, Human
acgcgatcctcccaccttggcctcctaaagtgttggaattgtaggcatgaaccactgcacttggcctaagaaaattttgttctaataatatttgattcccatttcttatagttttattaagatatatttcacatactagctgggcacagtggtacatgcctgtagtcccagctattcaggaagctgagacggaggattccttgaacccaagaacttgagtctagtgtggacaacatagcaagactccagtctcttaaaatgaaacaagaaaaagatacattttacatacttttttttttttaagtttttgagacagggtcttgctttgtcactgtaattttttctattttatttctgtattacttttttgtttattaagacaggtgtcggctgggcgcggtggctcacacctgtaatccctgcactttgggaggccgaggcaggcggatcacgaggtcaggagttcaagaccatcctggctaacacggtgaaaccccgtctctactaaaaacacacaaaaaaattagcccggcatggtggcgggcgcctctagtcccagctactcaggaggctgaggcaggagaatggcatgaacttggga

SEQ ID NO: 69266 - DNA, 601 bp, Human
gactccagtctcttaaaatgaaacaagaaaaagatacattttacatacttttttttttttaagtttttgagacagggtcttgctttgtcactgtaattttttctattttatttctgtattacttttttgtttattaagacaggtgtcggctgggcgcggtggctcacacctgtaatccctgcactttgggaggccgaggcaggcggatcacgaggtcaggagttcaagaccatcctggctaacacggtgaaaccccgtctctactaaaaacacacaaaaaaattagcccggcatggtggcrggcgcctctagtcccagctactcaggaggctgaggcaggagaatggcatgaacttgggaggcggagctacagtgagcggagatcgcaccacctcactccagcctggggaacagagtgagactccgtctcaaaaaaaaaaaagacaggtgtctcactctgtcacccaggatgcgttgcagtggcacaaatacagctcgctgcagcctaacctcctggactcgcgcgatcctctcacctcagtcctctgagtagctggaactacaggcaggtgccaccatgcacagctgatgtttttgcatt

SEQ ID NO: 69267 - DNA, 601 bp, Human
tattacttttttgtttattaagacaggtgtcggctgggcgcggtggctcacacctgtaatccctgcactttgggaggccgaggcaggcggatcacgaggtcaggagttcaagaccatcctggctaacacggtgaaaccccgtctctactaaaaacacacaaaaaaattagcccggcatggtggcgggcgcctctagtcccagctactcaggaggctgaggcaggagaatggcatgaacttgggaggcggagctacagtgagcggagatcgcaccacctcactccagcctggggaacagagwgagactccgtctcaaaaaaaaaaaagacaggtgtctcactctgtcacccaggatgcgttgcagtggcacaaatacagctcgctgcagcctaacctcctggactcgcgcgatcctctcacctcagtcctctgagtagctggaactacaggcaggtgccaccatgcacagctgatgtttttgcatttttgtagaaatggggtttcaccatttgcccaggctagtctcgaactcctgatctcaaacgatctgccttccttggcctccaaaagtgctgggattataggcttgagccactgtgcc

SEQ ID NO: 69268 - DNA, 601 bp, Human
gagccaccacgcctggcacagcctacacactttaaatttacccatttagagtgtacagctgagtggtttttagtaaattgaaaaaattgaacaattatcacaatcttaattttagaactttaaaaatacccctgaaaagaaaaatttcttgtaattctgttcatatattttagtggtatgaatccttttataaatcttgtgacattttcagggtgaacctagcactgtgagttatgaaggcatataagacacagttcttgacttcaagtagctgatagactaatagggaagaaaaggaaayataaatgtctttacaacaagacagttgattaaagtttcacaccagtgatataagctatatatcacaggtttgctgaggaattgaagaatcatctgtgtttggaatgatgacaacaggcctcatggaagtagggagatggaattttctagccagaaaaaatgtggaattatattattctttgtataggcacttttcagtctataataaacattttctttttgcccattgggaattatgcctactttttttttttttttttgagacggattctcactctgtctccaggctggagtgccgtgg

SEQ ID NO: 69269 - DNA, 601 bp, Human
aaatagcttgtaatttaacaattacactgagatctctactgcttgttttttagttgatttatattacaaggaaaagtcaaagtctttctatattcttgtcatctaatgcagggtacttctcaactcccccaccattattctagcctctgtaactcctcctttctctgcctttaccgttctgggatgtgtgtaattgtagtaggtcattacccagaattatatgccatgtgtgacagtctgcagagataggatgttgcaacactgtcaccacatggctcacagagtagaaagtcattcttcmatttttatgataccttaatttctattttaaaaagcctttaaaaatcagcatttggatttttatgttattacatcccagaaaaatgatcttctagtgaatataagtacagagtagtagtatcatatggattgtaatgtttcctttaggtgactgaaatgacctacccctttctcattgcttttgaaattgaaaacacttttgacattgtttttgggacacaggttctaaaaaaaggcaggtagatggatcacttgagtatatcaaggaatacctgcatccagtgaagatgctacttaggtt

SEQ ID NO: 69270 - DNA, 601 bp, Human
tgtcaccacatggctcacagagtagaaagtcattcttcaatttttatgataccttaatttctattttaaaaagcctttaaaaatcagcatttggatttttatgttattacatcccagaaaaatgatcttctagtgaatataagtacagagtagtagtatcatatggattgtaatgtttcctttaggtgactgaaatgacctacccctttctcattgcttttgaaattgaaaacacttttgacattgtttttgggacacaggttctaaaaaaaggcaggtagatggatcacttgagtatatyaaggaatacctgcatccagtgaagatgctacttaggttgtttttctagagtaggaatagatctgtgagctccagctgtgtatttctgtgactgtccttttgactactgtactttcagagtcactgacttcaaccatgcaatggaattaacctgaccgactcaggctgaaagagtcctaataaagtgatgacctgagattggaaacccacataacagttttgtctttttaattctgaaaatcataatttatctgttttatttctgtattattgattgattgattgattgagacaggtctca

SEQ ID NO: 69271 - DNA, 601 bp, Human; identical to SEQ ID NO: 27405

SEQ ID NO: 69272 - DNA, 601 bp, Human; identical to SEQ ID NO: 27406

SEQ ID NO: 69273 - DNA, 601 bp, Human; identical to SEQ ID NO: 27407

SEQ ID NO: 69274 - DNA, 601 bp, Human; identical to SEQ ID NO: 27408

SEQ ID NO: 69275 - DNA, 601 bp, Human; identical to SEQ ID NO: 27409

SEQ ID NO: 69276 - DNA, 601 bp, Human; identical to SEQ ID NO: 27410

SEQ ID NO: 69277 - DNA, 601 bp, Human; identical to SEQ ID NO: 27411

SEQ ID NO: 69278 - DNA, 601 bp, Human; identical to SEQ ID NO: 27412

SEQ ID NO: 69279 - DNA, 601 bp, Human; identical to SEQ ID NO: 27413

SEQ ID NO: 69280 - DNA, 601 bp, Human; identical to SEQ ID NO: 27414

SEQ ID NO: 69281 - DNA, 601 bp, Human; identical to SEQ ID NO: 27415

SEQ ID NO: 69282 - DNA, 601 bp, Human; identical to SEQ ID NO: 27416

SEQ ID NO: 69283 - DNA, 601 bp, Human; identical to SEQ ID NO: 27417

SEQ ID NO: 69284 - DNA, 601 bp, Human; identical to SEQ ID NO: 27418

SEQ ID NO: 69285 - DNA, 601 bp, Human; identical to SEQ ID NO: 27419

SEQ ID NO: 69286 - DNA, 601 bp, Human; identical to SEQ ID NO: 27420

SEQ ID NO: 69287 - DNA, 601 bp, Human; identical to SEQ ID NO: 27421

SEQ ID NO: 69288 - DNA, 601 bp, Human; identical to SEQ ID NO: 27422

SEQ ID NO: 69289 - DNA, 601 bp, Human; identical to SEQ ID NO: 27423

SEQ ID NO: 69290 - DNA, 601 bp, Human; identical to SEQ ID NO: 27424

SEQ ID NO: 69291 - DNA, 601 bp, Human; identical to SEQ ID NO: 27425

SEQ ID NO: 69292 - DNA, 601 bp, Human; identical to SEQ ID NO: 27426

SEQ ID NO: 69293 - DNA, 601 bp, Human; identical to SEQ ID NO: 27427

SEQ ID NO: 69294 - DNA, 601 bp, Human; identical to SEQ ID NO: 27428

SEQ ID NO: 69295 - DNA, 601 bp, Human; identical to SEQ ID NO: 27429

SEQ ID NO: 69296 - DNA, 601 bp, Human
cactactgtccccttatccatggttttgctttttgtggtttcagttacctgtagtcaaccacagtctgaaaatattaaggtattttaagacagaaagagagagaggagagaaaccgcattcacgtaagttttattccagcatattgttataattcttctattttattattagttattgttgctaatcttttactgtgcctaaattataaattaaactttatcataagtatgtatatatgggacaaaaacatagtatctacagggttaggtactatttgcggtttcacacatccactggggsccctggaacagattttctttggataagagggcactactgtggatagtaagggaaagttaaaaaaacaaaaacaaaacataaaaaggctatgtattcctatgtagttgggtacagaataataatctaaaatagcacatttgctgccgggctcagtgactcatgcctgtaatcccaacactttgggaggttgaggtgggtggatcacctgaggtcaggagttcgagaccagtctggcctacatggtgaaacgcagtctctactaaaaatacaaaaattagccaggtgtggtagtgggtgcct

SEQ ID NO: 69297 - DNA, 601 bp, Human
atattgttataattcttctattttattattagttattgttgctaatcttttactgtgcctaaattataaattaaactttatcataagtatgtatatatgggacaaaaacatagtatctacagggttaggtactatttgcggtttcacacatccactggggcccctggaacagattttctttggataagagggcactactgtggatagtaagggaaagttaaaaaaacaaaaacaaaacataaaaaggctatgtattcctatgtagttgggtacagaataataatctaaaatagcacatttrctgccgggctcagtgactcatgcctgtaatcccaacactttgggaggttgaggtgggtggatcacctgaggtcaggagttcgagaccagtctggcctacatggtgaaacgcagtctctactaaaaatacaaaaattagccaggtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaata

SEQ ID NO: 69298 - DNA, 601 bp, Human
ctattttattattagttattgttgctaatcttttactgtgcctaaattataaattaaactttatcataagtatgtatatatgggacaaaaacatagtatctacagggttaggtactatttgcggtttcacacatccactggggcccctggaacagattttctttggataagagggcactactgtggatagtaagggaaagttaaaaaaacaaaaacaaaacataaaaaggctatgtattcctatgtagttgggtacagaataataatctaaaatagcacatttgctgccgggctcagtgamtcatgcctgtaatcccaacactttgggaggttgaggtgggtggatcacctgaggtcaggagttcgagaccagtctggcctacatggtgaaacgcagtctctactaaaaatacaaaaattagccaggtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaatagtatatttgctgccttc

SEQ ID NO: 69299 - DNA, 601 bp, Human
ttcacacatccactggggcccctggaacagattttctttggataagagggcactactgtggatagtaagggaaagttaaaaaaacaaaaacaaaacataaaaaggctatgtattcctatgtagttgggtacagaataataatctaaaatagcacatttgctgccgggctcagtgactcatgcctgtaatcccaacactttgggaggttgaggtgggtggatcacctgaggtcaggagttcgagaccagtctggcctacatggtgaaacgcagtctctactaaaaatacaaaaattagccasgtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaatagtatatttgctgccttctgagaacttggagtgtgaagatacaggaaagttgaaaaagcaaacctggcttcaaaatccagagcccaaacactttgggaaaaacattttccatgctttttaataatttttagctcttccgattt

SEQ ID NO: 69300 - DNA, 601 bp, Human
gagggcactactgtggatagtaagggaaagttaaaaaaacaaaaacaaaacataaaaaggctatgtattcctatgtagttgggtacagaataataatctaaaatagcacatttgctgccgggctcagtgactcatgcctgtaatcccaacactttgggaggttgaggtgggtggatcacctgaggtcaggagttcgagaccagtctggcctacatggtgaaacgcagtctctactaaaaatacaaaaattagccaggtgtggtagtgggtgcctgtaatcctagctactcgggaggctgaygcaggagaattgcttgaacctggaagatggaggttgcagtgtgcaattgcactccagcctgggttacatgagtaaaattatgtctcaaaaaataataatagtaaaataaaatagtatatttgctgccttctgagaacttggagtgtgaagatacaggaaagttgaaaaagcaaacctggcttcaaaatccagagcccaaacactttgggaaaaacattttccatgctttttaataatttttagctcttccgatttgggaaaataatgtcatattccgtaaaagggctgtgctgtgatctc

SEQ ID NO: 69301 - DNA, 601 bp, Human
gcctacatggtgaaacgcagtctctactaaaaatacaaaaattagccaggtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaatagtatatttgctgccttctgagaacttggagtgtgaagatacaggaaagttgaaaaagcaaacctggcttcaaaatccagagcccaaacactttsggaaaaacattttccatgctttttaataatttttagctcttccgatttgggaaaataatgtcatattccgtaaaagggctgtgctgtgatctcagaattatctattgtcagaaatatattaaataaagattccaagaaaatggccaggcatggtggctcatgactgtaatcccagcactttgggaggctgaggcaggcggatcactttaggtcaggagtttgagaccagcctggccaacatggcgaaaccccgtctctactaaaaatacaaaaattagccgagtgtggtggcagacacct

SEQ ID NO: 69302 - DNA, 601 bp, Human
agccaggtgtggtagtgggtgcctgtaatcctagctactcgggaggctgacgcaggagaattgcttgaacctggaagatggaggttgcagtgtgcaattgcactccagcctgggttacatgagtaaaattatgtctcaaaaaataataatagtaaaataaaatagtatatttgctgccttctgagaacttggagtgtgaagatacaggaaagttgaaaaagcaaacctggcttcaaaatccagagcccaaacactttgggaaaaacattttccatgctttttaataatttttagctcttcmgatttgggaaaataatgtcatattccgtaaaagggctgtgctgtgatctcagaattatctattgtcagaaatatattaaataaagattccaagaaaatggccaggcatggtggctcatgactgtaatcccagcactttgggaggctgaggcaggcggatcactttaggtcaggagtttgagaccagcctggccaacatggcgaaaccccgtctctactaaaaatacaaaaattagccgagtgtggtggcagacacctgtaatcctagctactcggaaggccgaggcaggagaatcacttg

SEQ ID NO: 69303 - DNA, 601 bp, Human
ctattgtcagaaatatattaaataaagattccaagaaaatggccaggcatggtggctcatgactgtaatcccagcactttgggaggctgaggcaggcggatcactttaggtcaggagtttgagaccagcctggccaacatggcgaaaccccgtctctactaaaaatacaaaaattagccgagtgtggtggcagacacctgtaatcctagctactcggaaggccgaggcaggagaatcacttgaaccagggaggcagaggttgcagtgagccgagatcaaaccaccgtactccagcctgggkgacagagcaaaactccatctcaaaacaaaaaacttccaggaaaatgtttagctcttttttttttttagtgacttttaacctctattaactacacatttttgttgttcttttctagtgctaattccacttctatttataattctttgcttctgctttaatttttgttttcttactttattgtatgattcctttgtgcgagtctcctcaaaccctttgtggataaagcgggactaaaacaagcaagcatctagatgttcgctaaatacatactgtgtaccaggcactgcagggaactgagga

SEQ ID NO: 69304 - DNA, 601 bp, Human
ctcatgactgtaatcccagcactttgggaggctgaggcaggcggatcactttaggtcaggagtttgagaccagcctggccaacatggcgaaaccccgtctctactaaaaatacaaaaattagccgagtgtggtggcagacacctgtaatcctagctactcggaaggccgaggcaggagaatcacttgaaccagggaggcagaggttgcagtgagccgagatcaaaccaccgtactccagcctgggtgacagagcaaaactccatctcaaaacaaaaaacttccaggaaaatgtttagctcttttttttttttagtgacttttaacctctattaactacacatttttgttgttcttttctagtgctaattccacttctatttataattctttgcttctgctttaatttttgttttcttactttattgtatgattcctttgtgcgagtctcctcaaaccctttgtggataaagcgggactaaaacaagcaagcatctagatgttcgctaaatacatactgtgtaccaggcactgcagggaactgaggactgagaggcaaagatgtgactcaccgcaacgagctcaaagtctgatggaaaagac

SEQ ID NO: 69305 - DNA, 601 bp, Human
gcagtgagccgagatcaaaccaccgtactccagcctgggtgacagagcaaaactccatctcaaaacaaaaaacttccaggaaaatgtttagctcttttttttttttagtgacttttaacctctattaactacacatttttgttgttcttttctagtgctaattccacttctatttataattctttgcttctgctttaatttttgttttcttactttattgtatgattcctttgtgcgagtctcctcaaaccctttgtggataaagcgggactaaaacaagcaagcatctagatgttcgctraatacatactgtgtaccaggcactgcagggaactgaggactgagaggcaaagatgtgactcaccgcaacgagctcaaagtctgatggaaaagacataaaacagaagaaggtagctaggtgcaatggctcatgcctataatcccattactttgggggccaaggtgggaggatcccttgagtccaggagttcaaaaccagcctgggcaacacagggagacccctttctctatagaaaataaaaaaaataattgggtgtggcaacgtgcacttgtagtcccaactactcaggaggctgaggtg

SEQ ID NO: 69306 - DNA, 601 bp, Human
tgtatgattcctttgtgcgagtctcctcaaaccctttgtggataaagcgggactaaaacaagcaagcatctagatgttcgctaaatacatactgtgtaccaggcactgcagggaactgaggactgagaggcaaagatgtgactcaccgcaacgagctcaaagtctgatggaaaagacataaaacagaagaaggtagctaggtgcaatggctcatgcctataatcccattactttgggggccaaggtgggaggatcccttgagtccaggagttcaaaaccagcctgggcaacacagggagacccctttctctatagaaaataaaaaaaataattgggtgtggcaacgtgcacttgtagtcccaactactcaggaggctgaggtgggaggatctcttgagcccaggagtttgaggctgcaatgagctacgatcatacccctgtaccccagcctgggtgacagagtgagaccctgtctcttaaaaaaaaaagccaaaaaacaaaaatcagaagaagtgcattattaaggtgaaattgaggtgctatgagagtacctagaattgacatcttacctgtattgcttgagcaacaaggaggaaccaca

SEQ ID NO: 69307 - DNA, 601 bp, Human
agaggcagaaacctgctcagagaccttgcgacaggggagaagataaaaagtccaggaaagggcaggtgagtgcagagtgggttcatagggtactatcaggctctatgttcagatttgttttttaagattagaagaagactcagggagagacacattcttgtctgcgatttagaaagagcgctgtataggcttcctaaggtggattgcaaagccagagagacttctgagaagcttttactggaatccatctgtgagatgatggtggttcctactaagatcgtgactgtgagaatgaaggggaaaaggaatcaaagagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtaggtgggaccacaggtgcatgtcaccatggctgactaattttgggatttgtttttctagagatgaggtctcactttgttgcccaagctgattgcgaactcctgggctca

SEQ ID NO: 69308 - DNA, 601 bp, Human
ggcagaaacctgctcagagaccttgcgacaggggagaagataaaaagtccaggaaagggcaggtgagtgcagagtgggttcatagggtactatcaggctctatgttcagatttgttttttaagattagaagaagactcagggagagacacattcttgtctgcgatttagaaagagcgctgtataggcttcctaaggtggattgcaaagccagagagacttctgagaagcttttactggaatccatctgtgagatgatggtggttcctactaagatcgtgactgtgagaatgaaggggaaagggaatcaaagagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtaggtgggaccacaggtgcatgtcaccatggctgactaattttgggatttgtttttctagagatgaggtctcactttgttgcccaagctgattgcgaactcctgggctcaagc

SEQ ID NO: 69309 - DNA, 601 bp, Human
taaggtggattgcaaagccagagagacttctgagaagcttttactggaatccatctgtgagatgatggtggttcctactaagatcgtgactgtgagaatgaaggggaaaaggaatcaaagagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtagstgggaccacaggtgcatgtcaccatggctgactaattttgggatttgtttttctagagatgaggtctcactttgttgcccaagctgattgcgaactcctgggctcaagcagtcctcctgcctcagcctcccaaagtggtgctggggttatagcatgagccaccgtgcctggctgttttttttgtttgtttttttgtttttttttttaatttaaataagagcatttgtagatgttgcatcagagagaatgtgaaaaatatagaaatgtcatgtaaattaccgagtgctgggcttggcacat

SEQ ID NO: 69310 - DNA, 601 bp, Human
agagagacttctgagaagcttttactggaatccatctgtgagatgatggtggttcctactaagatcgtgactgtgagaatgaaggggaaaaggaatcaaagagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtaggtgggaccacaggtgcatgycaccatggctgactaattttgggatttgtttttctagagatgaggtctcactttgttgcccaagctgattgcgaactcctgggctcaagcagtcctcctgcctcagcctcccaaagtggtgctggggttatagcatgagccaccgtgcctggctgttttttttgtttgtttttttgtttttttttttaatttaaataagagcatttgtagatgttgcatcagagagaatgtgaaaaatatagaaatgtcatgtaaattaccgagtgctgggcttggcacatggtaattttacaataaggt

SEQ ID NO: 69311 - DNA, 601 bp, Human
agctttttctagaattgtcactgggcttcaagacttccaccaaagtcaaaatcagtcggcgatggactacctcaaacagcttgaattgaattaaaatgaaccatagcactagaaaggcatgtaatttgatctgaaatattgcgcaggaacaatatcaagtctcaggcaagacaggcaattagcaactttgtgataataaagaatttgaaatagctcttgagttcataactcgttgcctgcctgtgtgttttggttgggggattcaaaatgtatatgttactattttacctgtgacattacwataagcatctgatggatttacactagtaacattgatcttttcccattttactcccttttactgattataaatgttataaacattaaaaactggaaaatacattaaattgtaatgaaggaaaaaaaatggtcgatcttcactcctcctgctcaaagatgagcttcacattttagtgtctctggctgttaagtcctatttatgtgtagatacatacactccgtataaatttttatcgtatttaaaatacttaaactagttttgtgttttgctttttcaggtaataagagcatttttctttat

SEQ ID NO: 69312 - DNA, 601 bp, Human
gttgtctggacataaaagataaagtatttgtagagtaatttaatcgagtaggtcttagggcatagctctccatattacatacccaatttccttgcaaacttcaaccaaaaaaaaaaaaaggaaaaaactttattggaattttagagttagagcacattgtactttattcactttggaataaaccgtttggctctttcattctttaattaaggtataaactagttgtgatactttccttctctttattcggctcaaatgagtctcactgatgcaaaataaacactagatactatgtaactaytgggaataaaggaggccttctgcccaccccacctctaacctgacgaagcccctgatgaagtcaaaggaagataaatccacgcagtgctggaatatactgtggaacctcatgatatattcattatgagtcctcctctccagcacaccccagttagtaagttccttagataaaccaaatctatgcacaaatgaactcactattaaaaattagttctcctagcgcttgaacccgggaggcggaggttgcagtgagccgaaatcgcaccactgcactccagcctgggtgatagagtgagactcc

SEQ ID NO: 69313 - DNA, 601 bp, Human
gtcaaaggaagataaatccacgcagtgctggaatatactgtggaacctcatgatatattcattatgagtcctcctctccagcacaccccagttagtaagttccttagataaaccaaatctatgcacaaatgaactcactattaaaaattagttctcctagcgcttgaacccgggaggcggaggttgcagtgagccgaaatcgcaccactgcactccagcctgggtgatagagtgagactccatccgaaaaaaaaaaaaaaaaaaaaaaaaaaaacagttagttctcctgtaagcattcctrtgtccttaatatcactttctgttcctgccttgcatctccgcatctttttcttcgtctctggccgaatgctgtaaacgctcataaatatcaagtaataagatgcaaagagattgcaaactaaaactgaaaaccttaaagatgcagtttgtcatgaagctgctgaaagagatattggagaaatgccaaaatacctccaaagccaaagtctggctgtgtgactgtggagcatttaaaagcttctcatgacttagtttcctcacttgaaaactggaataatatctgcctgattaaccacatgaa

SEQ ID NO: 69314 - DNA, 601 bp, Human
tgatacctaaaagcactacttaaataataaagtacctggccgggcaccgtggctcaggcctgtaatcccagcactttgggaggcctaggtgggcagatcacgaggtcaggagttcgagaccagcctggccaacacagtgaaacgtcatctctactaaaaatacaaaaaattagccagttgtggtggcatgtgcctgtaatcccagctacttgagaggctgaggcaggaaagttgtttgaacctgggagttagacccttaacagcccaagaggagaaattggtaggaatggtatcaagacargtgcttcagaatagaagttgcataacaaccagttaatagaggaccttggttaaaaaagaaaatgatagtcttcaaaaatatttttgcaaaacttttttcatcactggggtacaaaagtcaagaaaagaatgtcatctcacataattttgtcagaaaaatgatcttccctccccaccaaatctaacactcaaataattctttgttctaaccattagggcatatttataatgatgacttattttgattttttttagtgtaaaatcttaagccctttaaaaatgacatattattcggcgttag

SEQ ID NO: 69315 - DNA, 601 bp, Human
atttataatgatgacttattttgattttttttagtgtaaaatcttaagccctttaaaaatgacatattattcggcgttagtctctatattttgaatacctactgctgtgtaacaaaccacctacccatttggggtgctctaacagaataacatagcctgggtggcttaccaaaaaaaaagaaatttggtcaggcttcgtgggtgacaactgtaatcccagcagtttgagaggccgaggcaggtggatcatgaggtcaggagttcgagaccagcctggccagcatggtgaaactccgtctcygctaaaaatacaaaaaattagctgggcatggtggcgtgcacctgtaatcccagctactcaggaggctgaggcaggagaatcgcttgaacccaggaagcagaggttgcagtgagccgagatcgcaccactgcactccagcctgggtgacaaagtgagactccatctcaaaaaacaaaacaaaacaaatttatttctcatcattctgaaggctgagaagtctaagattgaagccctggcagatttggtgtctgggagggcctatgtcctggtttgcagatggtcatcttgctgtgtgttcac

SEQ ID NO: 69316 - DNA, 601 bp, Human
aggtggatcatgaggtcaggagttcgagaccagcctggccagcatggtgaaactccgtctccgctaaaaatacaaaaaattagctgggcatggtggcgtgcacctgtaatcccagctactcaggaggctgaggcaggagaatcgcttgaacccaggaagcagaggttgcagtgagccgagatcgcaccactgcactccagcctgggtgacaaagtgagactccatctcaaaaaacaaaacaaaacaaatttatttctcatcattctgaaggctgagaagtctaagattgaagccctggcakatttggtgtctgggagggcctatgtcctggtttgcagatggtcatcttgctgtgtgttcacatggtggaaggaaggaggaagctctttggggtcttttttataaagggactaattccatttatgaagcctttaccttcatcagttgatcacctctcaaaggccccacctgctaatactgttactggggattaggatttcaacataggaattttggagggacacacacatttatagcaccatccctaagccagaggttacaaacaaccaccattttattgtccctcatcattctgtgggtt

SEQ ID NO: 69317 - DNA, 601 bp, Human
aagcctttaccttcatcagttgatcacctctcaaaggccccacctgctaatactgttactggggattaggatttcaacataggaattttggagggacacacacatttatagcaccatccctaagccagaggttacaaacaaccaccattttattgtccctcatcattctgtgggttggtcagattctgccagttgcatttagctgggcctgacatcatttgggatcttggctggactagaatgtccagggtaactcacttatctgctaccttcacagggacggcctcaaggctgaaatgaytgggggccctgggatggctggagactctctttctctccatattgtctcagggcctcttctccatgtaggaaggtagccagattcttacattgcaactcggggttttgcaaggcacaaaagcagaagctgcttccaatgatatgggtcccaaactggctttgcatcactttattcacattctgttggttaaagtgattcaccgaccagctctggtacagggtagaagggggctacacaaggatttgagtattggaatgcactgaaggtcatcatggagactaacccactgtaggaagcaca

SEQ ID NO: 69318 - DNA, 601 bp, Human
ggttttgcaaggcacaaaagcagaagctgcttccaatgatatgggtcccaaactggctttgcatcactttattcacattctgttggttaaagtgattcaccgaccagctctggtacagggtagaagggggctacacaaggatttgagtattggaatgcactgaaggtcatcatggagactaacccactgtaggaagcacattcatcgaaaacgtcatttccagtactgcttatccatggataatgaggacctcctgtagctgtagtcactttggtgcatcgtttccaaaaacctaatgagytgtgatgtcaattgcagctgtcaatctacttttaatcacaggcctcaaatgaagaaattcatttagaggataagcaaattacagcttcagttttgttcataaacttaagccccttattgctaatttttttgaaagaacaagtttatgctgatttgtccaaggatactcagcaaatatttggaaaatagttcaaagtttaatgtataatcataatcctattgcttcttggccttttggcaaagatcaagtgtagtgtctgttcttatcagtttaataatcataatcctgaacatttatata

SEQ ID NO: 69319 - DNA, 601 bp, Human
ctgacctcgtgatctgcccacctcggcctcccaaagtgctgggattacaggcctgagccaccatgcccgacctcatactttcttatttaagtggtgcttttaggtatcgttttacttgctttttatttcaaatcttatgtggttaatcaggcagatattccagttttcaagtgaggaaactaagtcatgagaagcttttaaatgctccacagtcacacagccagaaaacactggagccaagactccaagttttgggttcttcttttttatttttttaagacagggttttactttgttggcyaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaattcttttttt

SEQ ID NO: 69320 - DNA, 601 bp, Human
tgttggccaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaatttttttttttttttttttttttttgagacagggtctcactctgtcacccagattggagtgtagtggtgtgatttgggctcactgcagcctctggcttccaggctcaagcaatactcccacctcagcctctcaagtagctgggactataggcacacatcaccatgcctggctaatttttgtgtttttagtagagatgggctggccatattgcacaggctggtatcaaacccttgagctcaagcagtctgcctgccttggcctcccagagtgctgggattacaggcatgtgccaccatgctggg

SEQ ID NO: 69321 - DNA, 601 bp, Human
ttggccaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaattctcttttttttttttttttttttgagacagggtctcactctgtcacccagattggagtgtagtggtgtgatttgggctcactgcagcctctggcttccaggctcaagcaatactcccacctcagcctctcaagtagctgggactataggcacacatcaccatgcctggctaatttttgtgtttttagtagagatgggctggccatattgcacaggctggtatcaaacccttgagctcaagcagtctgcctgccttggcctcccagagtgctgggattacaggcatgtgccaccatgctgggcc

SEQ ID NO: 69322 - DNA, 601 bp, Human
tggccaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaattcttctttttttttttttttttttgagacagggtctcactctgtcacccagattggagtgtagtggtgtgatttgggctcactgcagcctctggcttccaggctcaagcaatactcccacctcagcctctcaagtagctgggactataggcacacatcaccatgcctggctaatttttgtgtttttagtagagatgggctggccatattgcacaggctggtatcaaacccttgagctcaagcagtctgcctgccttggcctcccagagtgctgggattacaggcatgtgccaccatgctgggcct

SEQ ID NO: 69323 - DNA, 601 bp, Human
ggccaggttggagtgcagtggtgtgatcaaggctcactgcagcctcagcctcaacctcgcaggttcaagtgatcctcccacctcagcctccagagtagcttggaccacaggagtgccccaccatgcccagctaatttttgtagagacaaggtgttgctatgtttcccaggctggtctcaaacttctagactcaagcaattgtcccacctcagcctctcaaagtcctggaattacaggcttgagctgctgtgcctggcattggggttttattcaaaccacccctccatcctagaattctttcttttttttttttttttttgagacagggtctcactctgtcacccagattggagtgtagtggtgtgatttgggctcactgcagcctctggcttccaggctcaagcaatactcccacctcagcctctcaagtagctgggactataggcacacatcaccatgcctggctaatttttgtgtttttagtagagatgggctggccatattgcacaggctggtatcaaacccttgagctcaagcagtctgcctgccttggcctcccagagtgctgggattacaggcatgtgccaccatgctgggccta

SEQ ID NO: 69324 - DNA, 601 bp, Human
agatagatagatagatagatagatggatgtctgtctgtctgcacatgcatgtaaaatacacattttattttattttttttttagagatggggtttcaccatgttggccaggctagtattgaactcctgacctcaaatgattcacccacctcggccttccaaagtgctgggactacaggcgtgagctactgtgcccagcctaaaatatacatttaaaaatccattgtgcaagtatagctttcattgtttgttagtgatctataggtggtcagtaatatccatttcaagctaaaggaatcacygatgcatggatgccatctggaagttatctggtcaaccccttcatttcacagatgggaaaaacaggtgtggagtggttaaccaagttgcccaaacccacacagctatttagtgaagagccatggattcttacctctgaacccatcattttaccaactagaccacaccacctcaagaatagccttccagatgaaactatgagaggaatatagatattttacatgtttaaaacatttgtctgtagtttgccaggacttaaaagtaatacaaattttaagtgctttactgatcaaatacagcta

SEQ ID NO: 69325 - DNA, 601 bp, Human
actgtgcccagcctaaaatatacatttaaaaatccattgtgcaagtatagctttcattgtttgttagtgatctataggtggtcagtaatatccatttcaagctaaaggaatcactgatgcatggatgccatctggaagttatctggtcaaccccttcatttcacagatgggaaaaacaggtgtggagtggttaaccaagttgcccaaacccacacagctatttagtgaagagccatggattcttacctctgaacccatcattttaccaactagaccacaccacctcaagaatagccttccrgatgaaactatgagaggaatatagatattttacatgtttaaaacatttgtctgtagtttgccaggacttaaaagtaatacaaattttaagtgctttactgatcaaatacagctaaagaccagttgtgcagctggctcaaagtatcactgtttctgggaggcaacctatgactagggtttcatgggacagaaaatcccctgtagaaaaagcagaggacagacttcaacgtggagagttcttcatgaagaaaagcaggtgataaccattgtattcaaataacttggtgtatgtttcactctc

SEQ ID NO: 69326 - DNA, 601 bp, Human
accccttcatttcacagatgggaaaaacaggtgtggagtggttaaccaagttgcccaaacccacacagctatttagtgaagagccatggattcttacctctgaacccatcattttaccaactagaccacaccacctcaagaatagccttccagatgaaactatgagaggaatatagatattttacatgtttaaaacatttgtctgtagtttgccaggacttaaaagtaatacaaattttaagtgctttactgatcaaatacagctaaagaccagttgtgcagctggctcaaagtatcactrtttctgggaggcaacctatgactagggtttcatgggacagaaaatcccctgtagaaaaagcagaggacagacttcaacgtggagagttcttcatgaagaaaagcaggtgataaccattgtattcaaataacttggtgtatgtttcactctcaggaatatatgttgctagtaaaatcaagaattttacatcaaacattctcaaggcattgagtgtggaaccttctgagaatgaaaagggcagagatgagatctcgtttttcaaattaagtaaaatttaaaggtcagttattccgacagtgt

SEQ ID NO: 69327 - DNA, 601 bp, Human
aacctatgactagggtttcatgggacagaaaatcccctgtagaaaaagcagaggacagacttcaacgtggagagttcttcatgaagaaaagcaggtgataaccattgtattcaaataacttggtgtatgtttcactctcaggaatatatgttgctagtaaaatcaagaattttacatcaaacattctcaaggcattgagtgtggaaccttctgagaatgaaaagggcagagatgagatctcgtttttcaaattaagtaaaatttaaaggtcagttattccgacagtgtcttgacaataatrttgcacttgtcccaactctaggatgttactatagtgagtaatgttgcacttcgatctgggttgaaatactgttttcttcctccctctcccttttcctccctcgtttccgttttttttttttttggagttggagtgttgctcttgttgcccaggctggagtgcaatggcacgattttggctcactgcaacctccgcctcccgggttcaagcgattatcctgcctcaggcttctgagtagctggtattacaggtgcctgccaccacagctgactaatttttgtatttttagtggagacgggg

SEQ ID NO: 69328 - DNA, 601 bp, Human
attgtattcaaataacttggtgtatgtttcactctcaggaatatatgttgctagtaaaatcaagaattttacatcaaacattctcaaggcattgagtgtggaaccttctgagaatgaaaagggcagagatgagatctcgtttttcaaattaagtaaaatttaaaggtcagttattccgacagtgtcttgacaataatattgcacttgtcccaactctaggatgttactatagtgagtaatgttgcacttcgatctgggttgaaatactgttttcttcctccctctcccttttcctccctcrtttccgttttttttttttttggagttggagtgttgctcttgttgcccaggctggagtgcaatggcacgattttggctcactgcaacctccgcctcccgggttcaagcgattatcctgcctcaggcttctgagtagctggtattacaggtgcctgccaccacagctgactaatttttgtatttttagtggagacggggttttactatgttggccaggctagtctcgaacacctgacctcaggtgatttgcctgcctcagcctcccaaagtgctgggattacaggcttgagccaccgtgccc

SEQ ID NO: 69329 - DNA, 601 bp, Human
tcaaataacttggtgtatgtttcactctcaggaatatatgttgctagtaaaatcaagaattttacatcaaacattctcaaggcattgagtgtggaaccttctgagaatgaaaagggcagagatgagatctcgtttttcaaattaagtaaaatttaaaggtcagttattccgacagtgtcttgacaataatattgcacttgtcccaactctaggatgttactatagtgagtaatgttgcacttcgatctgggttgaaatactgttttcttcctccctctcccttttcctccctcgtttccgttttttttttttttggagttggagtgttgctcttgttgcccaggctggagtgcaatggcacgattttggctcactgcaacctccgcctcccgggttcaagcgattatcctgcctcaggcttctgagtagctggtattacaggtgcctgccaccacagctgactaatttttgtatttttagtggagacggggttttactatgttggccaggctagtctcgaacacctgacctcaggtgatttgcctgcctcagcctcccaaagtgctgggattacaggcttgagccaccgtgcccagcccca

SEQ ID NO: 69330 - DNA, 601 bp, Human
caccacagctgactaatttttgtatttttagtggagacggggttttactatgttggccaggctagtctcgaacacctgacctcaggtgatttgcctgcctcagcctcccaaagtgctgggattacaggcttgagccaccgtgcccagccccatttaaaaaaaaaaaaaatgttttcagttggccactaaacagagaaatttgggaagccactggtaccagttacaagtttgtagaccacagtctacacaaaggccatctgctcaaccctggtgacttgaggttgactggcccaagttaaaytgaagagttaatgaagccacaagccgattttttttattcaaggagtctgatgtgttttctgggttttcaaatggcttcaatggatttacttaccagtttaagatgaacacctcacatcaaggaatgcaggatggcaaaagcctgagctgacccagaggaggagacctttcccaggctgacctgtctgcaaaggccttttcccagcactgtcacttcctgggttcgtcactgccatagtcctcgtaattgtttagaatttgcacatttcctcaggttttcttcttacattcttagtcaatt

SEQ ID NO: 69331 - DNA, 601 bp, Human
gagagagtagaagcatgatgactgtgtccaaggagggactcctggtgtcaccgttggtcagtgtccaggcccaggctgcttcaaagaagatatattgcaggtctgaacctgtatgcacaatggaagtattcaaacaagctttaaaaaaaaaaaggatgcatttaaaaaatatttttgtgacaaatcaaatgtcagtgttaagtgcagtgtttctagagtgcagccgcgctctgtgatgtaacacttcaaaaaatagaagtgctgatctatttgggccagacagcacttttttcttagaagkccatttatttggaggatacttttatagtaccagcaagtccagttagaaagttccatctgctctgcctcttactgcttctggtttcttgccatctacactggtgtcatctcagacaagacactacctgattttttctggataatagcgacatcctatggggctccctgcaggtacaacgggccccctcccttcatccattcgtacacggctgccaggctcttcacttcatattgtctgcaaaaaaccctgagatgccttcccgtttttttgtcagttagggtttcttcagagccaccaaac

SEQ ID NO: 69332 - DNA, 601 bp, Human
tgacaaatcaaatgtcagtgttaagtgcagtgtttctagagtgcagccgcgctctgtgatgtaacacttcaaaaaatagaagtgctgatctatttgggccagacagcacttttttcttagaagtccatttatttggaggatacttttatagtaccagcaagtccagttagaaagttccatctgctctgcctcttactgcttctggtttcttgccatctacactggtgtcatctcagacaagacactacctgattttttctggataatagcgacatcctatggggctccctgcaggtacaaygggccccctcccttcatccattcgtacacggctgccaggctcttcacttcatattgtctgcaaaaaaccctgagatgccttcccgtttttttgtcagttagggtttcttcagagccaccaaactattaggttggtgcaaaaataattctggtttttaccatcacttcattttactcatagtattaggtcggctctggccgaatgctgtaaacgctcataaatattaagtaataagaggcaaagagattgcaaactaaaactgaaagcgttaaaaatggcagttgtcatgaagctgctgaa

SEQ ID NO: 69333 - DNA, 601 bp, Human
aagtgctgatctatttgggccagacagcacttttttcttagaagtccatttatttggaggatacttttatagtaccagcaagtccagttagaaagttccatctgctctgcctcttactgcttctggtttcttgccatctacactggtgtcatctcagacaagacactacctgattttttctggataatagcgacatcctatggggctccctgcaggtacaacgggccccctcccttcatccattcgtacacggctgccaggctcttcacttcatattgtctgcaaaaaaccctgagatgcsttcccgtttttttgtcagttagggtttcttcagagccaccaaactattaggttggtgcaaaaataattctggtttttaccatcacttcattttactcatagtattaggtcggctctggccgaatgctgtaaacgctcataaatattaagtaataagaggcaaagagattgcaaactaaaactgaaagcgttaaaaatggcagttgtcatgaagctgctgaaataaatattggagaaatgccaaaatacctcaaagaccaagtttgggtgggtgagtgaggagcataagaaagctccgatg

SEQ ID NO: 69334 - DNA, 432 bp, Human
cctaatactatgagtaaaatgaaacaagggatgtatgataagaattagacctttcatggttgggggaggagttgggaaagtcaactgaaaactgatccaccaaaactcagttttgtaatttgactatagcattttttttttttttgagatagagtctcgctctgttgtccaggctagagtgcagtggcgcaatcttgactcactgcaccctccacctcccaggttcaagcaattctcctgcctcagcctcccgagtagcctcccgagtgatgacagacatgtgccaccaggcccagctaatttttgtattttttatagagacagggtttcatcatgctggccaggctggtctcgaactcctggccttaagtgatctgcctgcctcaacctcccaaagtgttgggattacaggtgtgagccactgtgcctgac

SEQ ID NO: 69335 - DNA, 577 bp, Human
cctaatactatgagtaaaatgaaacaagggatgtatgataagaattagacctttcatggttgggggaggagttgggaaagtcaactgaaaactgatccaccaaaactcagttttgtaatttgactatagcattttttttttttttgagatagagtctcgctctgttgtccaggctagagtgcagtggcgcaatcttgactcactgcaccctccacctcccaggttcaagcaattctcctgcctcagcctcccgagtagcctcccgagtgatgacagrcatgtgccaccaggcccagctaatttttgtattttttatagagacagggtttcatcatgctggccaggctggtctcgaactcctggccttaagtgatctgcctgcctcaacctcccaaagtgttgggattacaggtgtgagccactgtgcctgacctaatttgaccattgcatttaaaattgttagacgagtaccttcaaccaggtcaagggctgggtataacagagtccggggtgggagaagagcctatgtttatgaaataaggacagtgtatttcagttaagagaagctctcctcatt

SEQ ID NO: 69336 - DNA, 601 bp, Human
accctccacctcccaggttcaagcaattctcctgcctcagcctcccgagtagcctcccgagtgatgacagacatgtgccaccaggcccagctaatttttgtattttttatagagacagggtttcatcatgctggccaggctggtctcgaactcctggccttaagtgatctgcctgcctcaacctcccaaagtgttgggattacaggtgtgagccactgtgcctgacctaatttgaccattgcatttaaaattgttagacgagtaccttcaaccaggtcaagggctgggtataacagagtcmggggtgggagaagagcctatgtttatgaaataaggacagtgtatttcagttaagagaagctctcctcattcacaggtaaaatagagtcctggaaagtcctaccctctgcaattcaaaatgccactgaaaaatatattcaatctacatagacggaatcatcttaagtataatggccagggtgaaatagctgtgaggaactctcagtgaaactaaactaaaattgcccccaaactaccgtcctgcacaccaaatcttcaacaattaggtgaattgtctaagtattttgtagaagttgattta

SEQ ID NO: 69337 - DNA, 601 bp, Human
tgacctaatttgaccattgcatttaaaattgttagacgagtaccttcaaccaggtcaagggctgggtataacagagtccggggtgggagaagagcctatgtttatgaaataaggacagtgtatttcagttaagagaagctctcctcattcacaggtaaaatagagtcctggaaagtcctaccctctgcaattcaaaatgccactgaaaaatatattcaatctacatagacggaatcatcttaagtataatggccagggtgaaatagctgtgaggaactctcagtgaaactaaactaaaatygcccccaaactaccgtcctgcacaccaaatcttcaacaattaggtgaattgtctaagtattttgtagaagttgatttatgcatatggttttagaatacacatattttaaacatgcgtattttaaataagacaaatcctatttatcgtttctggctttcagctgtgctggaggactgtcctctgattctcttctcttatcccttttattttttgtctttaaaccctctgtgctttttcagttctagatgcatcagaattagaaatgttgttccccttggctaggctgtaatagtaattgca

SEQ ID NO: 69338 - DNA, 601 bp, Human
agggctgggtataacagagtccggggtgggagaagagcctatgtttatgaaataaggacagtgtatttcagttaagagaagctctcctcattcacaggtaaaatagagtcctggaaagtcctaccctctgcaattcaaaatgccactgaaaaatatattcaatctacatagacggaatcatcttaagtataatggccagggtgaaatagctgtgaggaactctcagtgaaactaaactaaaattgcccccaaactaccgtcctgcacaccaaatcttcaacaattaggtgaattgtctaartattttgtagaagttgatttatgcatatggttttagaatacacatattttaaacatgcgtattttaaataagacaaatcctatttatcgtttctggctttcagctgtgctggaggactgtcctctgattctcttctcttatcccttttattttttgtctttaaaccctctgtgctttttcagttctagatgcatcagaattagaaatgttgttccccttggctaggctgtaatagtaattgcagtctatcctcagtcctcagattgttcaaatttcacatttgaagtgcaacagaacttt

SEQ ID NO: 69339 - DNA, 601 bp, Human
tatgcagtttggtacttttctagcaaaagtggtagcattttatcaatttagctcagtttctgcccctctgtgactctctggaacacgtctgtaagatggtcagccagaaggaaagaaacggcaaattaacccatatggaagcttgcatctattattaatggtactgtgatttcatcaacggaaggcatgaactacacactccttgctctcagtagcaaggaataagacactgaacagtaaattcctatccatcatcattggaaaatattgccctgtatagtgcctggcagctgtgtggtgrttctctgaagagacactgcctgcttttctcttagccaccatttgaattgcctagctgatagaagtttggcttccagaaaggcactatcaaacaaaatcaatggccatgttagccacaagtcctaagttctgtccaaaagtctaaatccatcatttatgccttataagccaatatatcgcaaacacctgagttccagataattgcagtggcttgctataaattggcctacaattctgtcaccctctgacctctgatgttgttttcaccttgtcttacgtgtgtactatacccttcacaaat

SEQ ID NO: 69340 - DNA, 601 bp, Human
tattattaatggtactgtgatttcatcaacggaaggcatgaactacacactccttgctctcagtagcaaggaataagacactgaacagtaaattcctatccatcatcattggaaaatattgccctgtatagtgcctggcagctgtgtggtgattctctgaagagacactgcctgcttttctcttagccaccatttgaattgcctagctgatagaagtttggcttccagaaaggcactatcaaacaaaatcaatggccatgttagccacaagtcctaagttctgtccaaaagtctaaatccrtcatttatgccttataagccaatatatcgcaaacacctgagttccagataattgcagtggcttgctataaattggcctacaattctgtcaccctctgacctctgatgttgttttcaccttgtcttacgtgtgtactatacccttcacaaattttcccctttgttcccccaaatcatctcccctctcatcagccactttctctgaaaagaaataatctaggatatacgtgaatagttcctagaattcgcaaaacaaagctactatttgttgaatatggtctgcgtgccaaatgcatctaca

SEQ ID NO: 69341 - DNA, 601 bp, Human
acactgaacagtaaattcctatccatcatcattggaaaatattgccctgtatagtgcctggcagctgtgtggtgattctctgaagagacactgcctgcttttctcttagccaccatttgaattgcctagctgatagaagtttggcttccagaaaggcactatcaaacaaaatcaatggccatgttagccacaagtcctaagttctgtccaaaagtctaaatccatcatttatgccttataagccaatatatcgcaaacacctgagttccagataattgcagtggcttgctataaattggcstacaattctgtcaccctctgacctctgatgttgttttcaccttgtcttacgtgtgtactatacccttcacaaattttcccctttgttcccccaaatcatctcccctctcatcagccactttctctgaaaagaaataatctaggatatacgtgaatagttcctagaattcgcaaaacaaagctactatttgttgaatatggtctgcgtgccaaatgcatctacaggtatttttacctgtggtatctaatttatttttacgacagtctatgaaatgtgcttcgttattttaatttacagatg

SEQ ID NO: 69342 - DNA, 601 bp, Human
gtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcaggtaaaaagcctaagttctttgacartatttgttcataaattcagaacagccagaaccttggaaatgccctgggttcagaggtagctgggcatgctacggaaatttgctagctagcaaagacatctgccagttggggccccagttagtaacactgtatttcataaagaaagtgccaattttgcaagcaagccttgtggtaaagaaaaaagaaaataataataataagtgtcaaggaaagagatcttagtgcactggtcattgcaaaatccaacgtgataatagttagatttgtgtgtatcgtatctgtcctcagtattggcaccac

SEQ ID NO: 69343 - DNA, 601 bp, Human
cttggaaatgccctgggttcagaggtagctgggcatgctacggaaatttgctagctagcaaagacatctgccagttggggccccagttagtaacactgtatttcataaagaaagtgccaattttgcaagcaagccttgtggtaaagaaaaaagaaaataataataataagtgtcaaggaaagagatcttagtgcactggtcattgcaaaatccaacgtgataatagttagatttgtgtgtatcgtatctgtcctcagtattggcaccacagtctatttgtaaacctcacttttccatcttmagttatgctacctcgattttttttcaccctggattttataataaccagcaatgaagattcactgtagggtgaaacttggcagtcaaagacttggcacatttgtgaatatgtttcagtttcctttcacaaaacaggagaggtggaagaaaattcattcccctgtgttttgtcataatatggtcttaagaatgggcagaaggaagtaaattgtttagggacaaaaagaataaggtgcaaaaccttttttgcacgtgtatgtgttctctttctaaacacacatgtatctatttatacatgttt

SEQ ID NO: 69344 - DNA, 601 bp, Human
acaaaaagaataaggtgcaaaaccttttttgcacgtgtatgtgttctctttctaaacacacatgtatctatttatacatgtttacacatatatgtatatattcgtatgtatcttccattgcctgcatgacaggcatagggtgtcagctcattctttgcaaaagatcacttactctctggagtattttgtatttcaaaattttttctgcattattttccaaccaggactttatttttttaatgtatttttgttgtttaaagactatgctgatgatgaggattatatattcttccaaccactyttagtggtaactatacatatgaacccaaaagtctaatagtagtatagtgtgctgtgaattttctatgctgtctatgataaaagactggaataaataggagagaattaaagcatttcttgatgccttgtgcggtgatgcaagcgtgtagtcctagctacatgggagcctgaaatgggaggttcacttgatctcaggagttccaagtccagcctgagtaacatggtgagacctctgcttctttaaaaaaaacaaagaagaaagaaaaagaatgacttgatacacgggacatagattcaattc

SEQ ID NO: 69345 - DNA, 601 bp, Human
ttttctgcattattttccaaccaggactttatttttttaatgtatttttgttgtttaaagactatgctgatgatgaggattatatattcttccaaccactcttagtggtaactatacatatgaacccaaaagtctaatagtagtatagtgtgctgtgaattttctatgctgtctatgataaaagactggaataaataggagagaattaaagcatttcttgatgccttgtgcggtgatgcaagcgtgtagtcctagctacatgggagcctgaaatgggaggttcacttgatctcaggagttscaagtccagcctgagtaacatggtgagacctctgcttctttaaaaaaaacaaagaagaaagaaaaagaatgacttgatacacgggacatagattcaattcattggcggtctttctatattctagatgctgctccccaggttaagttacagatttttttttgcttcatcctgaatgtactctcattaagtcactttgtccccctccagcttcctaaagctataaatttcttgttaaataatcatggtatgatattatcgaatcttggatttagtgcaacttgttgatttttgatttggcca

SEQ ID NO: 69346 - DNA, 601 bp, Human
tggcaaccaggttggtatcaagatccatacttggctatcttgaggaatcttctggttgcactgataaagtagaggcatgcttctatatactggtcacagagacaatgcatcagactgtgaaaactagactctttggacccagtgagaactttgaattctaactctcattggtgtaacatcttggacagcttaatttgaatttaaaacaatgtattttataatgttgccttgtatgatatgggatatatgtagcacatttactgagtaaggatgatactttttaaacattgtgaagtacctyataccttcaaaaatgtattacactaatacttttaaattttataaaatgttttagattcttaaaagcgttgcattctgcagttattatacagtgtaattgttctatatgtctattagaacataatcatttatcatgttcaagtattctgcatttctactaatttaaatatatatatatatatggagagagagagagagagagagagagtctgtctctctgttgcccaggctggagtgcagtggcatgattttggctcactgcagcctcaccctcccaagttcaagtgatcctccaacctca

SEQ ID NO: 69347 - DNA, 601 bp, Human
atcttctggttgcactgataaagtagaggcatgcttctatatactggtcacagagacaatgcatcagactgtgaaaactagactctttggacccagtgagaactttgaattctaactctcattggtgtaacatcttggacagcttaatttgaatttaaaacaatgtattttataatgttgccttgtatgatatgggatatatgtagcacatttactgagtaaggatgatactttttaaacattgtgaagtacctcataccttcaaaaatgtattacactaatacttttaaattttataaartgttttagattcttaaaagcgttgcattctgcagttattatacagtgtaattgttctatatgtctattagaacataatcatttatcatgttcaagtattctgcatttctactaatttaaatatatatatatatatggagagagagagagagagagagagagtctgtctctctgttgcccaggctggagtgcagtggcatgattttggctcactgcagcctcaccctcccaagttcaagtgatcctccaacctcagcctcccaagaagctgggactacaggcatgtgcctccacacctggc

SEQ ID NO: 69348 - DNA, 601 bp, Human
tctaactctcattggtgtaacatcttggacagcttaatttgaatttaaaacaatgtattttataatgttgccttgtatgatatgggatatatgtagcacatttactgagtaaggatgatactttttaaacattgtgaagtacctcataccttcaaaaatgtattacactaatacttttaaattttataaaatgttttagattcttaaaagcgttgcattctgcagttattatacagtgtaattgttctatatgtctattagaacataatcatttatcatgttcaagtattctgcatttctrctaatttaaatatatatatatatatggagagagagagagagagagagagagtctgtctctctgttgcccaggctggagtgcagtggcatgattttggctcactgcagcctcaccctcccaagttcaagtgatcctccaacctcagcctcccaagaagctgggactacaggcatgtgcctccacacctggctaatttttatattttttgtagagataggttcttgccctgttgccgaggctggtctcaaactcctgagctcaagcaagtcactcgtcttggcctctcaaagttctgggact

SEQ ID NO: 69349 - DNA, 601 bp, Human
acagcttaatttgaatttaaaacaatgtattttataatgttgccttgtatgatatgggatatatgtagcacatttactgagtaaggatgatactttttaaacattgtgaagtacctcataccttcaaaaatgtattacactaatacttttaaattttataaaatgttttagattcttaaaagcgttgcattctgcagttattatacagtgtaattgttctatatgtctattagaacataatcatttatcatgttcaagtattctgcatttctactaatttaaatatatatatatatatggggagagagagagagagagagagagtctgtctctctgttgcccaggctggagtgcagtggcatgattttggctcactgcagcctcaccctcccaagttcaagtgatcctccaacctcagcctcccaagaagctgggactacaggcatgtgcctccacacctggctaatttttatattttttgtagagataggttcttgccctgttgccgaggctggtctcaaactcctgagctcaagcaagtcactcgtcttggcctctcaaagttctgggactataggcatatgccattgtacctggtcat

SEQ ID NO: 69350 - DNA, 601 bp, Human
gatgatactttttaaacattgtgaagtacctcataccttcaaaaatgtattacactaatacttttaaattttataaaatgttttagattcttaaaagcgttgcattctgcagttattatacagtgtaattgttctatatgtctattagaacataatcatttatcatgttcaagtattctgcatttctactaatttaaatatatatatatatatggagagagagagagagagagagagagtctgtctctctgttgcccaggctggagtgcagtggcatgattttggctcactgcagcctcaccctcccaagttcaagtgatcctccaacctcagcctcccaagaagctgggactacaggcatgtgcctccacacctggctaatttttatattttttgtagagataggttcttgccctgttgccgaggctggtctcaaactcctgagctcaagcaagtcactcgtcttggcctctcaaagttctgggactataggcatatgccattgtacctggtcataaatttcttttaattgcgtgcttggcattccttgggattcctgaatgtaaggatgtacctttcattgtttctgaaaagcctcagc

SEQ ID NO: 69351 - DNA, 601 bp, Human
ttgtttctgaaaagcctcagccattatctctttaaatactgtttcactcacatgttatttatcatctgtatcacaaactccaatttgatatatgtagggctttcttacctatactctgtatttcttaacacctctttcatatttccatccacgtgcatcactgagctataatttcttcagtttgatcttcctatttactacttctctttccaacggaatcaatctgtcacttagccaatatatttggtttataatgttgagaactacatggtttttctgttacctattaagttctagttgkttacttttcaaatctgcttggttaattttgatcatttatgttcctttcaacatggtttcgattcaacctttaaaaaaatattaaacatacaatgtataacttgtaattgataaatctaacttctactgcctttgttttactctgatatagtttactagttcttctggctgtcattgataggaggttatttccttatgttttagagtacaattttttgttgtaacatcagacatcttggaaattattatgagtattaggttggtttcctcttacccctggtttttttttttggttatttat

SEQ ID NO: 69352 - DNA, 601 bp, Human
acctatactctgtatttcttaacacctctttcatatttccatccacgtgcatcactgagctataatttcttcagtttgatcttcctatttactacttctctttccaacggaatcaatctgtcacttagccaatatatttggtttataatgttgagaactacatggtttttctgttacctattaagttctagttggttacttttcaaatctgcttggttaattttgatcatttatgttcctttcaacatggtttcgattcaacctttaaaaaaatattaaacatacaatgtataacttgtawttgataaatctaacttctactgcctttgttttactctgatatagtttactagttcttctggctgtcattgataggaggttatttccttatgttttagagtacaattttttgttgtaacatcagacatcttggaaattattatgagtattaggttggtttcctcttacccctggtttttttttttggttatttattttttatttctggtaggcagttgtggcactacttacgtgggacactttatactaaattttttaattgtggtaaaatgtgcataacataaaatttatcatcttttaa

SEQ ID NO: 69353 - DNA, 601 bp, Human
tacctattaagttctagttggttacttttcaaatctgcttggttaattttgatcatttatgttcctttcaacatggtttcgattcaacctttaaaaaaatattaaacatacaatgtataacttgtaattgataaatctaacttctactgcctttgttttactctgatatagtttactagttcttctggctgtcattgataggaggttatttccttatgttttagagtacaattttttgttgtaacatcagacatcttggaaattattatgagtattaggttggtttcctcttacccctggtttttttttttggttatttattttttatttctggtaggcagttgtggcactacttacgtgggacactttatactaaattttttaattgtggtaaaatgtgcataacataaaatttatcatcttttaaacattttgaaatgtacagttcagtaatgttgagtgtattcactccccatggcctgtgacaaacgccattctactttctgtctctatgaatttgactactctaggtacctcatgtagatggaatcacataaagctttttgtgactgtttaaactaaattttagacttgagagact

SEQ ID NO: 69354 - DNA, 601 bp, Human
actacacctatatatacacatatgtatatatttatgtatatacacacacatatgtattttttttctgttaaacaataaagatacattaccagatttccatttggctgcagtttcaatatatctctctagaatgggtcagaacagaatggaaaggttgacctgacatcagacaaactcagaacattctagaaaattctgagaccatcgctagagcagccatccattctgtacctatctgatggattattcacggttccagtgcatgaaaaagacatacatgaaagtatgagcatttcagaarggaggcagctagggaacatggctttagaaaaagcagtgcattcggaaaaacataccgaataaagtaacagaaaaaaataatcagggaggcagatgcaggcattgttagctctttgaagtggctgttcacagcaagacagtggccatgctgaagtttgactgggtcagcctctcacagactctctgaggtctgcagggctgtgcatacgatctgagccgtactgaaaggccaaggacttcagctttctgtaacggggacaaatcacaaagggcatgtatttcatgcaacgaaatgcacaga

SEQ ID NO: 69355 - DNA, 601 bp, Human
catcatgccttttcagacattaaaaaccaaaaaaaaagatctgaggctaccttgtgattggaagataatcaggccgtcgctgtgcttcatagccccctccagaatgctgggactctccaatgggactgaccctcagtcttacctacccatgatcagtttatttttcccctttaaagtagtatttccatcatttcagtatacaaaaataaaatattacagtgtgcccccaatcacattgaagcaggtaaatatttttgaagatatacaatcttcattaggattcatgcatttgtatgggtgaacacacacacacacatacactcattgtgacaacaacaacaacaaattgctacatggctatccaaaaggggcatttgggaccctgagagggaagagttaatgaatggccatcaccttaggagacctcttaactacattgttgtcatgtgaccgttggtgacctgcttaaggtcatttactaggagataacagcttgacaagataaatctgcttctgtgtctaggccgtcccctaaccatctgctccctttaagaaacatgggcctgttggttgctgtgaatttaaccctagggaacattgc

SEQ ID NO: 69356 - DNA, 601 bp, Human
gataattaagtgaaggaaaatagcgcatcactgtctttgaaaattcctagctgaggaaggtagaggaattgacctaagggtttctgaaagacaacaagagggaaacatttagggaactggccgacagcacattttattccctttgcctctgatcattcgtgccaaattggccaaactcttggaaagctataattttgatatgtttttcatgctcttaattagatgaaataagagagtgggatatcacatcattcattcattccacaaatacttgcatgtctaattaccatataccagacgytgggctgtagcctgaagaacaacccactctctgccttcaaagtcattatttaattataattatggtgatttttaaccttaaggttttctgtgaaaaaccacaaaaaataattatttggtttccttggaacttacacacatttaatccctctgaatattcgtgaattaacgggaagtcattcaaaaacaattccaagcaaatgtttgacaaactgaaactgagcaaaacatcgtgatatcgttaagtagtacaggggtgtttgagaataattggaatgctatgtgcatgtatttgtttgta

SEQ ID NO: 69357 - DNA, 601 bp, Human
gagggaaacatttagggaactggccgacagcacattttattccctttgcctctgatcattcgtgccaaattggccaaactcttggaaagctataattttgatatgtttttcatgctcttaattagatgaaataagagagtgggatatcacatcattcattcattccacaaatacttgcatgtctaattaccatataccagacgttgggctgtagcctgaagaacaacccactctctgccttcaaagtcattatttaattataattatggtgatttttaaccttaaggttttctgtgaaaarccacaaaaaataattatttggtttccttggaacttacacacatttaatccctctgaatattcgtgaattaacgggaagtcattcaaaaacaattccaagcaaatgtttgacaaactgaaactgagcaaaacatcgtgatatcgttaagtagtacaggggtgtttgagaataattggaatgctatgtgcatgtatttgtttgtaacatctagaatcctatgaatatgacactgagtttcttttattcttaaaaacaattttttttttaaatttttaagagtaaaagagacagggacttgct

SEQ ID NO: 69358 - DNA, 601 bp, Human
ggtgatttttaaccttaaggttttctgtgaaaaaccacaaaaaataattatttggtttccttggaacttacacacatttaatccctctgaatattcgtgaattaacgggaagtcattcaaaaacaattccaagcaaatgtttgacaaactgaaactgagcaaaacatcgtgatatcgttaagtagtacaggggtgtttgagaataattggaatgctatgtgcatgtatttgtttgtaacatctagaatcctatgaatatgacactgagtttcttttattcttaaaaacaattttttttttwaatttttaagagtaaaagagacagggacttgctatgtttcccaagttaattttgaactccttcctcaagtgatcctcctgccttggcctcccaaaatgctggggttaccggcttgagccactgagccggccagaaaaattatttttaaccctaaagtgttatgcaaaatttccccacccctgccctagttattgtttactgtgtattttctctcaacatgcagaacgtatggaaggaagaaagggaaagggagagggagggaggcagaaaggatggaaggaaggggagggagggagaaga

SEQ ID NO: 69359 - DNA, 601 bp, Human
atttgtttgtaacatctagaatcctatgaatatgacactgagtttcttttattcttaaaaacaattttttttttaaatttttaagagtaaaagagacagggacttgctatgtttcccaagttaattttgaactccttcctcaagtgatcctcctgccttggcctcccaaaatgctggggttaccggcttgagccactgagccggccagaaaaattatttttaaccctaaagtgttatgcaaaatttccccacccctgccctagttattgtttactgtgtattttctctcaacatgcagaasgtatggaaggaagaaagggaaagggagagggagggaggcagaaaggatggaaggaaggggagggagggagaagagaaagaaagaaggaaaaaaggaaacagaaagaaatccaggcaaatatctgacaaagtaaaatgcaccaaaattctgtatattcataaatagtgccaaataaaatgcaataaagttatggtgataattaataattaattgtggagtattccagattatactattttgggcagacctgccttcctggtgaaagggaaacgctggccatgtgctctatccagtacattc

SEQ ID NO: 69360 - DNA, 601 bp, Human
ttttttttaaatttttaagagtaaaagagacagggacttgctatgtttcccaagttaattttgaactccttcctcaagtgatcctcctgccttggcctcccaaaatgctggggttaccggcttgagccactgagccggccagaaaaattatttttaaccctaaagtgttatgcaaaatttccccacccctgccctagttattgtttactgtgtattttctctcaacatgcagaacgtatggaaggaagaaagggaaagggagagggagggaggcagaaaggatggaaggaaggggagggagggagaagagaaagaaagaaggaaaaaaggaaacagaaagaaatccaggcaaatatctgacaaagtaaaatgcaccaaaattctgtatattcataaatagtgccaaataaaatgcaataaagttatggtgataattaataattaattgtggagtattccagattatactattttgggcagacctgccttcctggtgaaagggaaacgctggccatgtgctctatccagtacattctacccaccaaagccttccacgagtaattttttttctaaagcaatttttcataactctgacaccatt

SEQ ID NO: 69361 - DNA, 601 bp, Human
taaagtgttatgcaaaatttccccacccctgccctagttattgtttactgtgtattttctctcaacatgcagaacgtatggaaggaagaaagggaaagggagagggagggaggcagaaaggatggaaggaaggggagggagggagaagagaaagaaagaaggaaaaaaggaaacagaaagaaatccaggcaaatatctgacaaagtaaaatgcaccaaaattctgtatattcataaatagtgccaaataaaatgcaataaagttatggtgataattaataattaattgtggagtattccarattatactattttgggcagacctgccttcctggtgaaagggaaacgctggccatgtgctctatccagtacattctacccaccaaagccttccacgagtaattttttttctaaagcaatttttcataactctgacaccattcccatgaaatgtgacattttaacaaataggattgccaggtctgtgagatttatcttcactctcctcaataccgtcattccctgaaccgtgtatcgccttacatgaaaaacgcaacctcttttgtgctatgtggtagctgaagagttcgtatggtaaaaag

SEQ ID NO: 69362 - DNA, 601 bp, Human
ggaaggggagggagggagaagagaaagaaagaaggaaaaaaggaaacagaaagaaatccaggcaaatatctgacaaagtaaaatgcaccaaaattctgtatattcataaatagtgccaaataaaatgcaataaagttatggtgataattaataattaattgtggagtattccagattatactattttgggcagacctgccttcctggtgaaagggaaacgctggccatgtgctctatccagtacattctacccaccaaagccttccacgagtaattttttttctaaagcaatttttcatamctctgacaccattcccatgaaatgtgacattttaacaaataggattgccaggtctgtgagatttatcttcactctcctcaataccgtcattccctgaaccgtgtatcgccttacatgaaaaacgcaacctcttttgtgctatgtggtagctgaagagttcgtatggtaaaaagctcttcctgggatgtataaactgtgaaatgcattctaaaataaagttttaattacactttgtaattcggagccaacttctgggtttagtctaatttaaacaagggtttttctctcttgcagccatct

SEQ ID NO: 69363 - DNA, 601 bp, Human
gtagctgaagagttcgtatggtaaaaagctcttcctgggatgtataaactgtgaaatgcattctaaaataaagttttaattacactttgtaattcggagccaacttctgggtttagtctaatttaaacaagggtttttctctcttgcagccatctgttccttttgcttaagcctacacttaagtcataatattgaaagggtgacgtcactccttccttatgatgtcattaaacatttctttagcgacccaagcagtcagagaactgaataagtgatggggggagatgcttgttaaaatatrgataatagcatactgaattattttatttttcattcccagttattctccaatatcaaaaatattgttcaatgaaagtcatgcctccgtgcaaaaagaatcccataaaaaataaatctttgaaatacctacgtatttggtcataaactagtacattaatgcaaacgtaccactctcatttttggcttgggtctggatcaaactaaaattcttggcaaattattagtggaagtagcaaattacatatttttaatcataggcaatatttagaccacacattaaaaacttacatcatctctattt

SEQ ID NO: 69364 - DNA, 601 bp, Human
tattaagtctataattctagctgagtttagtaattattttaagtagttgttgaaaaactttaaaaaaataagaattccacatagctgtacaaatattcattggttctaaattgataaactcaagggggaggagtacaaagattttttggaattacttttttttttttttttttttgagacagtgtcttgctctcttacccaggctggagtgcagtggcaccatctcagctcactgcaacctccacctcccaggttcaagcgattcttgtgcctcagcctcctaagtagctgagattacaagcgtgcactaccacgctcagccaattttgtatttttagtagagacgaggttttgccatgttggccaggctggtctcaaactatcgacctcaagtgatccacccacctcagcctcccaaagtgctgggagtataggcgtgagccaccatgcccaaccttcaattacttttttggtaaacaatttttaatgatcagtcactgaaattcaacaattttttcaataaatcagttgtatatataagcattctgttgttattttatttgtatgccaatttttaaaacatacttgatcaagtctgtaa

SEQ ID NO: 69365 - DNA, 601 bp, Human
caacaattttttcaataaatcagttgtatatataagcattctgttgttattttatttgtatgccaatttttaaaacatacttgatcaagtctgtaagttttatcagggaatgcaatttatgatgcataaattcagatgtcagggcctgagctagttccatgagccacatagagctgccctcacaggcccaccacttgcccaaggaattcacagagtcaaatggctgaggagttacaattaaatcaaagctcagcacaatggaaagggcactagattaggagttggaatacctgcattgtgkgtcactttaaagaacacccatgctttcctttctttatttgtgcagtgacattaatacgtgacataattatttcaccagtctattgtgagtttcacagcctgctccttgttcttgttatttaatggtgccaacatctaatcagttgcccaagcaagacaggcttgtgattctcctcctgcgtggctgtccctgtggtgccaatgcctcatccttcactcttgctgctgtgctccgtaatctggctaataacagcgctatttacccagctgttagcctaaagacctccagatacaagctctc

SEQ ID NO: 69366 - DNA, 601 bp, Human
ccagctgttagcctaaagacctccagatacaagctctcctgtccactcctctggtgttctctgaattcagcccctcatttatcatttgaattattataagtctccaaacacaaatccctcccttagttttggtcccagatctagcctccacaatccaccagatctttccaaaggcaaatctaattatatccctgatcctgacttaaaagcctccaatgggtcacctttgcctcaggcacaaaatccgaaggtcttggtcttctggttccctcgcctccctccaccttatctctcgttattyccagtatgcacacagtctctgagccaaagccacactgaccatgtctttgagtgccctgtattggttgtccttatatgcatctcacacatgctattctctctgctaggaatgttctatttccccttatctatttagcagaatctttcttcagaatgcaattcaccaggggttttctcctctatgaagcttttccagaaacagccaaccactgtttgatatctccttctctttgccaacctagttcctagcagcactcttaccatgacacttggtaaattctgtatagcaagtatttgtttc

SEQ ID NO: 69367 - DNA, 601 bp, Human
tgatcaacaatttcttgttaaatggaatgatggatagatggatggatagatggatggatgattcccctctcttctccccttcctctgataaactacacccttatattcaggaacagcaagctccctttttgcctctcagcaggtggttctctggatttttttttttttttttttgagatgaaatctcacactgtcacccaggctggaatgcagttgcgcgatctcggctcactgcagcctttgcctcctgggttccagcagttctcctacctcagcctcccaagtagctaggattacaggygcctgccaccatgcctggctaatttttgtatttttagtagagacgaggtctcaccatgttggccaggctggtctcaaactcctaacctcaggtaatccactcgacttggcctcccaaagtgctgggattacaggcatgagccatatgcccagcctctctggatcattcatcttgatccctaccaacatttgtctaaatggtgtcctttaagactcaactcaaatgaatcaaagtgaatcaagtgaaaaaaattaagtgcttcattcttcgttcgcaatactgtgtatttatttgtacttc

SEQ ID NO: 69368 - DNA, 601 bp, Human
tgcctgccaccatgcctggctaatttttgtatttttagtagagacgaggtctcaccatgttggccaggctggtctcaaactcctaacctcaggtaatccactcgacttggcctcccaaagtgctgggattacaggcatgagccatatgcccagcctctctggatcattcatcttgatccctaccaacatttgtctaaatggtgtcctttaagactcaactcaaatgaatcaaagtgaatcaagtgaaaaaaattaagtgcttcattcttcgttcgcaatactgtgtatttatttgtacttmaatgttttttagcacatttaactataattattagcttaaacatcttccttctgcagactttaatttccttgagacagcatcttaaatttcttattcgtgtctatattcctaacacagagaatagcacaagatagctgatagtagatgttcactgaattaatttatgaaggtgtgtttcaatgtgtgaaatgaaataatatacctgagagttatttgaaactgtaaagcccaagacaaatggtaggtgcttttgttatcttgatcctacccacggatcaaattctttcctctgctccttag

SEQ ID NO: 69369 - DNA, 601 bp, Human
gccaccatgcctggctaatttttgtatttttagtagagacgaggtctcaccatgttggccaggctggtctcaaactcctaacctcaggtaatccactcgacttggcctcccaaagtgctgggattacaggcatgagccatatgcccagcctctctggatcattcatcttgatccctaccaacatttgtctaaatggtgtcctttaagactcaactcaaatgaatcaaagtgaatcaagtgaaaaaaattaagtgcttcattcttcgttcgcaatactgtgtatttatttgtacttcaatgttttttagcacatttaactataattattagcttaaacatcttccttctgcagactttaatttccttgagacagcatcttaaatttcttattcgtgtctatattcctaacacagagaatagcacaagatagctgatagtagatgttcactgaattaatttatgaaggtgtgtttcaatgtgtgaaatgaaataatatacctgagagttatttgaaactgtaaagcccaagacaaatggtaggtgcttttgttatcttgatcctacccacggatcaaattctttcctctgctccttagttctt

SEQ ID NO: 69370 - DNA, 601 bp, Human
cttggcctcccaaagtgctgggattacaggcatgagccatatgcccagcctctctggatcattcatcttgatccctaccaacatttgtctaaatggtgtcctttaagactcaactcaaatgaatcaaagtgaatcaagtgaaaaaaattaagtgcttcattcttcgttcgcaatactgtgtatttatttgtacttcaatgttttttagcacatttaactataattattagcttaaacatcttccttctgcagactttaatttccttgagacagcatcttaaatttcttattcgtgtctatrttcctaacacagagaatagcacaagatagctgatagtagatgttcactgaattaatttatgaaggtgtgtttcaatgtgtgaaatgaaataatatacctgagagttatttgaaactgtaaagcccaagacaaatggtaggtgcttttgttatcttgatcctacccacggatcaaattctttcctctgctccttagttctttctagctagggagcccacagacccttgtctaaattatcacttcatgcagacttcctttctcccacacagagtgcattttgacattaaactaaacccctca

SEQ ID NO: 69371 - DNA, 601 bp, Human
ttgatcctacccacggatcaaattctttcctctgctccttagttctttctagctagggagcccacagacccttgtctaaattatcacttcatgcagacttcctttctcccacacagagtgcattttgacattaaactaaacccctcagcatatggataagatctagaatataaaagggggttgaaaatagaatcacctgtcttgcattatagtaccagccttaagaaactgggtatatgataactgtattctgacaataaagagccgaatcactttggacaccatttttttttttagctgrtgacaatttattttccctaaatttatgcctgtttcttatatacagaaaagttacttactagttgagcaaaagtataaaatatgcagcagaggaaatgatatcatatgaatgacatgaacaagtacttgataccaaaatctggtcttccttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccga

SEQ ID NO: 69372 - DNA, 601 bp, Human
gacaatttattttccctaaatttatgcctgtttcttatatacagaaaagttacttactagttgagcaaaagtataaaatatgcagcagaggaaatgatatcatatgaatgacatgaacaagtacttgataccaaaatctggtcttccttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccgacyttaaaagctgggaaagattggagtaagaaagaatagaattattcatggatggccaggcgcagtgtctcacactgtaatcccagcactttgggaggccaaggcaggcagatcagctggcgcatcagctgaggtcaggagtttgagaccagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcg

SEQ ID NO: 69373 - DNA, 601 bp, Human
tataaaatatgcagcagaggaaatgatatcatatgaatgacatgaacaagtacttgataccaaaatctggtcttccttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccgaccttaaaagctgggaaagattggagtaagaaagaatagaattattcatggatggccaggcgcagtgtctcacrctgtaatcccagcactttgggaggccaaggcaggcagatcagctggcgcatcagctgaggtcaggagtttgagaccagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcgccactgcactccagcctgtgtgacggagcgagactgtctcaaaaaactaaaataaaaaacaactctcaaga

SEQ ID NO: 69374 - DNA, 601 bp, Human
gataccaaaatctggtcttccttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccgaccttaaaagctgggaaagattggagtaagaaagaatagaattattcatggatggccaggcgcagtgtctcacactgtaatcccagcactttgggaggccaaggcaggcagatcagctggcgcatcagmtgaggtcaggagtttgagaccagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcgccactgcactccagcctgtgtgacggagcgagactgtctcaaaaaactaaaataaaaaacaactctcaagaagtattcatggatatagaatgcagaatgaggaaaactggctgaggttagcacctc

SEQ ID NO: 69375 - DNA, 601 bp, Human
cttctgggaaatcccaggatgttttgtaaatgacattgcaatcatttcatccaccttgaagatgggacttttcttcagtgtgaaatgcggtagctcttctgtgcgtcacaatcacttcactgacttttcaggggaagaagtgaaaaataccgaccttaaaagctgggaaagattggagtaagaaagaatagaattattcatggatggccaggcgcagtgtctcacactgtaatcccagcactttgggaggccaaggcaggcagatcagctggcgcatcagctgaggtcaggagtttgagamcagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcgccactgcactccagcctgtgtgacggagcgagactgtctcaaaaaactaaaataaaaaacaactctcaagaagtattcatggatatagaatgcagaatgaggaaaactggctgaggttagcacctccactcttctaagatgtgcta

SEQ ID NO: 69376 - DNA, 601 bp, Human
aagaaagaatagaattattcatggatggccaggcgcagtgtctcacactgtaatcccagcactttgggaggccaaggcaggcagatcagctggcgcatcagctgaggtcaggagtttgagaccagcctggccaacatggcgaaaccctatctctactaaaaatacaaaattagctgggtgtggtggtgggcacttgtaatcccagctactcgggaggctgaggcaggagaatcgcttgaacccaggagatgaaagctgcagtgagccaagatcgcgccactgcactccagcctgtgtgacrgagcgagactgtctcaaaaaactaaaataaaaaacaactctcaagaagtattcatggatatagaatgcagaatgaggaaaactggctgaggttagcacctccactcttctaagatgtgctatgagatcattggtgactgggagggacaggacctctgtttaatcctcatctgctggatggcacacagagttcattttcccatggtaatatactgacattaggggtcaaccctctccaagtgaaaaagaaagtcacttgcataaatgcaacttcagtagcgctttggcagtccctggaagc

SEQ ID NO: 69377 - DNA, 601 bp, Human
ggatatagaatgcagaatgaggaaaactggctgaggttagcacctccactcttctaagatgtgctatgagatcattggtgactgggagggacaggacctctgtttaatcctcatctgctggatggcacacagagttcattttcccatggtaatatactgacattaggggtcaaccctctccaagtgaaaaagaaagtcacttgcataaatgcaacttcagtagcgctttggcagtccctggaagccatccagctgaatgtcaatttcacatgggtaagtcaccttgttagacgttcacggygcaaggtgcttgttcctagatgtcactacgatggtgagtgtgtctccgtagtgtgagtgccttggaggaggaacggagttgccctggtgcctgggtgttcttacccctggaggggcagcctggtttaagaacacggcctcaacacaaaagcagtttgggtttgtttgaagctcttcaggttgagacctgagtttatcttttctgagacttaaagtcctcatctgtaagatggggacagtcacaccttcctgatagagcttctgtaaggattaaatgagctggggctgtattaaatacctg

SEQ ID NO: 69378 - DNA, 601 bp, Human
ctcttctaagatgtgctatgagatcattggtgactgggagggacaggacctctgtttaatcctcatctgctggatggcacacagagttcattttcccatggtaatatactgacattaggggtcaaccctctccaagtgaaaaagaaagtcacttgcataaatgcaacttcagtagcgctttggcagtccctggaagccatccagctgaatgtcaatttcacatgggtaagtcaccttgttagacgttcacggcgcaaggtgcttgttcctagatgtcactacgatggtgagtgtgtctccrtagtgtgagtgccttggaggaggaacggagttgccctggtgcctgggtgttcttacccctggaggggcagcctggtttaagaacacggcctcaacacaaaagcagtttgggtttgtttgaagctcttcaggttgagacctgagtttatcttttctgagacttaaagtcctcatctgtaagatggggacagtcacaccttcctgatagagcttctgtaaggattaaatgagctggggctgtattaaatacctgatgactatcaggtgttgattttcttgtttcccgtcccaccccttatta

SEQ ID NO: 69379 - DNA, 601 bp, Human
tggtttaagaacacggcctcaacacaaaagcagtttgggtttgtttgaagctcttcaggttgagacctgagtttatcttttctgagacttaaagtcctcatctgtaagatggggacagtcacaccttcctgatagagcttctgtaaggattaaatgagctggggctgtattaaatacctgatgactatcaggtgttgattttcttgtttcccgtcccaccccttattaatatctcataccacatactacttattttcaggactttcctttgaaaacctgtgtgatcactcacactattttmttcccctgaattttgcactcagtttgctttgtcaataagaagaatttaaaggaattcattcccttttttatttttaatttaattattttatttatttatttatttatattttggagacagggtctcgcttgctctgtcacctaggctggagtgcagtggcttgatcgtgactcactgcagcctcaacttcccgggctccaacaatcctcccacctcagtctcccgagtagctgggaccccgggtgtgcaccaccctcacctggctgattttttgtatttttgttagaaatggggttttgc

SEQ ID NO: 69380 - DNA, 601 bp, Human
cttaaagtcctcatctgtaagatggggacagtcacaccttcctgatagagcttctgtaaggattaaatgagctggggctgtattaaatacctgatgactatcaggtgttgattttcttgtttcccgtcccaccccttattaatatctcataccacatactacttattttcaggactttcctttgaaaacctgtgtgatcactcacactattttcttcccctgaattttgcactcagtttgctttgtcaataagaagaatttaaaggaattcattcccttttttatttttaatttaattatattatttatttatttatttatattttggagacagggtctcgcttgctctgtcacctaggctggagtgcagtggcttgatcgtgactcactgcagcctcaacttcccgggctccaacaatcctcccacctcagtctcccgagtagctgggaccccgggtgtgcaccaccctcacctggctgattttttgtatttttgttagaaatggggttttgccatgttgcccaagctggtctggaattcatgagctcaagtgacccttccacctcagcctcgcaaagtgctgggattacaagcatgagc

SEQ ID NO: 69381 - DNA, 601 bp, Human
tcccttttttatttttaatttaattattttatttatttatttatttatattttggagacagggtctcgcttgctctgtcacctaggctggagtgcagtggcttgatcgtgactcactgcagcctcaacttcccgggctccaacaatcctcccacctcagtctcccgagtagctgggaccccgggtgtgcaccaccctcacctggctgattttttgtatttttgttagaaatggggttttgccatgttgcccaagctggtctggaattcatgagctcaagtgacccttccacctcagcctcscaaagtgctgggattacaagcatgagccactgtctgcagctgaattcatttcttaattgccttcacgttaatgtttagttaccccaaggaggtcatatcaataaatgtcagttaaaaaatcagaaaaaaaactgcatatatatgtatgtatgtcttggttttttttatgacagcaaatttctcttcccctctttttctttctatttgtttgtttatgttatagaggcagggtctctctgtgtttcgtctcaaactcctgggctcaagcaaccctcccagaggcttggcctcccaaagtgc

SEQ ID NO: 69382 - DNA, 601 bp, Human
tattttttatttgtttatatttctttttttagagtcaggggctcactctgtcacccaagctggagtctagtggtgtgaccataggtcactgcagccttgaactcttgggctcaagcaatcctcctcactcagcctttcaagtagctgggaccacaggcgtgagccaccatgcctgccatctccccattcctcttttattttatttttttatttttgttttttgagacacagtctcactctgtcacccaagctggagtacagtggcacgatctcggctcactgcaacctctgccttccaggktcaagcgattcttctgcctcatcctcctgagtagctgggactgcagcacgtgccaccacacccagttaatttttgtatttttagtaaagccagggtttcaccatgttggccaggctggtcttgaactcctgacctcaaatgatccacctgcctcagcctcccaaagtgctgggattacaggtgtgagcccccatgctcagccaatatttgtaatattcatttcttagttgacttcacactagtgtttagttatccagagggggtcatatcactatatgtcagttaaaaaaatgaataact

SEQ ID NO: 69383 - DNA, 601 bp, Human
aagtgcagtgtgagggtaccacggggaggaaatttcaaattaaaaattaaagcacactctgtgcacattcagtcattgtaattctggaaaatgtcctttgagtaaaaaacaatatttagcaataggagaagccatacagtatggtggtttacagcgtaagttctaactttgagatgaatttaaattctagcacatcaccttgagtgactatctaatcaagtcccagtttctcagtcttcagaattgagagctgctgggatcatggagggtattaaatgagataatacatataatgcacttygcacaatgtcagacacatagtaagttctcataattgtcagcatgatgataatgatgctaagtgactttactttttattttcaattggagctaaggctaaagagttttctaaggctttacatttaccacggacttttcactaagtatatgcctcgatatagcactgaaaatttaggaaagttattctcaaggcattgggccaaaggacagaaaaagacattaggagcagaaataagagtatgatccaacctgtaactggtgactccatttccgtgctgactcctgccctcccccagtaccc

SEQ ID NO: 69384 - DNA, 601 bp, Human
aagcatcattaaactaagtctgtagtacccaagtactttagaggggaaaactcctttttagatgagtaagttctgttatttctagtaacaaattgaacttactgttttatactcacatcattaagagccatttcagaagtgtctgttactcgacttcaactatgttcttgttcttgtacattgtgtgcttaaaacttctagtatgtacatgtggaaaatgggctcttcataataacagttcatctgtcgcattgtttctaggactattcttgataagaaagagctcttggagtttgctcarcttggctgctacttggaatatgatctctttggtactgaactacttcattaccaactcggcccagatattgacatgcctgatgataacaaaagaattagaaggtaaatatggtaaagcctctcatagcattccctttccctagccctttttgattgtcatatctagggaagtattagcaaagattcagaaaacagtaagcaggccgaaccacagacttgcagagaaaaatatatctatgctgtttcagggagaaaaatctctctatattattttaaggagaaaatgagtcatcctaagtag

SEQ ID NO: 69385 - DNA, 601 bp, Human
ataaggtctaaagactaaatattatgtaaaatgaatgcaaccttccaaaactgtataatgtgtgatgctggcagataattgtaggagtcattctttgtaatcaagtagaaaattttaggcgtcaatgatagctacctagtttggtcttggtcacatggtgataagaagattgaatgaaccaagttagaatacctaggaggagaaataaattggagattgacaaggaagactttcgtttgggaatatctaagtgttgctacccagtgaagccctaagatatggtttgtatgtgatagttgamccgtgggaatgaatgacatcactcagagaagaagatgaggacagagacctggggacagagacatttaaggaatggagtaggaaccgttgctcaaggaaaggtcgaggagaagttttcaaagtgataacatgagagatatatattcttatggaagtcagtagagaggaagtctcagggcagaagggcttgaatgccggtaataagtgacaaatatcaagggaaataaagactgaaaagcatccattggatttcacaattaggaggctcacattttataaacagagtgcaatctcagtggaa

SEQ ID NO: 69386 - DNA, 601 bp, Human
gtagaaaattttaggcgtcaatgatagctacctagtttggtcttggtcacatggtgataagaagattgaatgaaccaagttagaatacctaggaggagaaataaattggagattgacaaggaagactttcgtttgggaatatctaagtgttgctacccagtgaagccctaagatatggtttgtatgtgatagttgaaccgtgggaatgaatgacatcactcagagaagaagatgaggacagagacctggggacagagacatttaaggaatggagtaggaaccgttgctcaaggaaaggtcraggagaagttttcaaagtgataacatgagagatatatattcttatggaagtcagtagagaggaagtctcagggcagaagggcttgaatgccggtaataagtgacaaatatcaagggaaataaagactgaaaagcatccattggatttcacaattaggaggctcacattttataaacagagtgcaatctcagtggaaaaggcttgagaaatgggtgggccgtgaggaagaggagagaggatgttgaggtgactctttcaagaagcgtggcagtggagggaagcaaggagatgggtctggag

SEQ ID NO: 69387 - DNA, 601 bp, Human
agaagttttcaaagtgataacatgagagatatatattcttatggaagtcagtagagaggaagtctcagggcagaagggcttgaatgccggtaataagtgacaaatatcaagggaaataaagactgaaaagcatccattggatttcacaattaggaggctcacattttataaacagagtgcaatctcagtggaaaaggcttgagaaatgggtgggccgtgaggaagaggagagaggatgttgaggtgactctttcaagaagcgtggcagtggagggaagcaaggagatgggtctggagttasaagtcaataaaggatcaagggaagcttctagtaagagttgagcaatgtttatgtgacttaagagcaaaagcagagacagagccagagagaatgagtccagggaagtggtgcccattccacagggttactatagaattgacatgaaataatgttttccaagtttttgtctgagtgtctggtgcagaatatggaagtgttcaatagatgttgactttaaaaactctggatagataagaaatatagagcaaggttcctaaggcaacaaatagatggaatctggggaacaaatagaaagtcggt

SEQ ID NO: 69388 - DNA, 601 bp, Human
ggcagaagggcttgaatgccggtaataagtgacaaatatcaagggaaataaagactgaaaagcatccattggatttcacaattaggaggctcacattttataaacagagtgcaatctcagtggaaaaggcttgagaaatgggtgggccgtgaggaagaggagagaggatgttgaggtgactctttcaagaagcgtggcagtggagggaagcaaggagatgggtctggagttacaagtcaataaaggatcaagggaagcttctagtaagagttgagcaatgtttatgtgacttaagagcaaragcagagacagagccagagagaatgagtccagggaagtggtgcccattccacagggttactatagaattgacatgaaataatgttttccaagtttttgtctgagtgtctggtgcagaatatggaagtgttcaatagatgttgactttaaaaactctggatagataagaaatatagagcaaggttcctaaggcaacaaatagatggaatctggggaacaaatagaaagtcggttgaaaggatgctttctccatggaaatgagagggcatgacacagcgatggggtgaatgcaaacagaagt

SEQ ID NO: 69389 - DNA, 601 bp, Human
gtggcagtggagggaagcaaggagatgggtctggagttacaagtcaataaaggatcaagggaagcttctagtaagagttgagcaatgtttatgtgacttaagagcaaaagcagagacagagccagagagaatgagtccagggaagtggtgcccattccacagggttactatagaattgacatgaaataatgttttccaagtttttgtctgagtgtctggtgcagaatatggaagtgttcaatagatgttgactttaaaaactctggatagataagaaatatagagcaaggttcctaaggcracaaatagatggaatctggggaacaaatagaaagtcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacct

SEQ ID NO: 69390 - DNA, 601 bp, Human
tttccaagtttttgtctgagtgtctggtgcagaatatggaagtgttcaatagatgttgactttaaaaactctggatagataagaaatatagagcaaggttcctaaggcaacaaatagatggaatctggggaacaaatagaaagtcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacctagttgagtctagaaatcatgattgcatgcctgtgtattggcaccaatgcacacgatttggtgattattttccaaagcaaaactgttttgcgttttggtagtggaaccagagaagttgtgtgcgtacaagcagaaaatgggaacagttcaagagattgagggttgggattctatctgaaagagatggataaca

SEQ ID NO: 69391 - DNA, 601 bp, Human
gtttttgtctgagtgtctggtgcagaatatggaagtgttcaatagatgttgactttaaaaactctggatagataagaaatatagagcaaggttcctaaggcaacaaatagatggaatctggggaacaaatagaaagtcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacctagttgagtctagaaatcatgattgcatgcctgtgtattggcaccaatgcacacgatttggtgattattttccaaagcaaaactgttttgcgttttggtagtggaaccagagaagttgtgtgcgtacaagcagaaaatgggaacagttcaagagattgagggttgggattctatctgaaagagatggataacaatggagg

SEQ ID NO: 69392 - DNA, 601 bp, Human
atagaaagtcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacctagttgagtctagaaatcatgattgcakgcctgtgtattggcaccaatgcacacgatttggtgattattttccaaagcaaaactgttttgcgttttggtagtggaaccagagaagttgtgtgcgtacaagcagaaaatgggaacagttcaagagattgagggttgggattctatctgaaagagatggataacaatggaggagttgagatgagggtcatgggatccaagttggagggaagaaagcatagagaggaatggtcagatagacaggaaaagcatagcagggcaaataagtggactgcaggctttaatgaagtgggtggagcat

SEQ ID NO: 69393 - DNA, 601 bp, Human
tcggttgaaaggatgctttctccatggaaatgagagggcatgacacagcgatggggtgaatgcaaacagaagtcttagtgagggaaacaggagactgaggacacatggccacatgtcctctagtgtctctgtgaggtggacatggttatctcctgagaaaaaaagagtggatttagggcagcactgtgtagagcaggagaaaggctaggaatggctgtcaggtcaatgagagagatcttgacatggatgtgttatgtgcgagacctagttgagtctagaaatcatgattgcatgcctgtgyattggcaccaatgcacacgatttggtgattattttccaaagcaaaactgttttgcgttttggtagtggaaccagagaagttgtgtgcgtacaagcagaaaatgggaacagttcaagagattgagggttgggattctatctgaaagagatggataacaatggaggagttgagatgagggtcatgggatccaagttggagggaagaaagcatagagaggaatggtcagatagacaggaaaagcatagcagggcaaataagtggactgcaggctttaatgaagtgggtggagcatatatatat

SEQ ID NO: 69394 - DNA, 601 bp, Human
agtagaagaagtgagtggaaaaagtagaaaaatgtaacatgatcggagtgggaaactgaagatggagatttcagagggggagcagtagttccctatgataacaagaactagaatataattatgagaacagaaaagtggttgccgtggaagtagcaaagctggaattgagaagtgatgtccaggaaccatgagattcaagtattgctagttgaataaggcacactgggttgaggggaagatcttgagccagtggtcatagttgggacatcctgaggatctttccctgggaagtcacatttaygtctgtatgccttctgctgtctccaagtactggcattctgccttgatcacctcattaatagtactatgcttcaagtttagtatcattagggaaagctagttaatcagtgttgcattagttaagtaagatggcaactctcaactctacatgagcaaatgacttcacctgtcttgaccaatgaagttctgtcttttaatactcagatcagttatttgacaagtagatgtattgtttctttgtttatttttgttttattattttaatttacttgcccaggaacccgattcaatacaggtgaac

SEQ ID NO: 69395 - DNA, 601 bp, Human
cggagtgggaaactgaagatggagatttcagagggggagcagtagttccctatgataacaagaactagaatataattatgagaacagaaaagtggttgccgtggaagtagcaaagctggaattgagaagtgatgtccaggaaccatgagattcaagtattgctagttgaataaggcacactgggttgaggggaagatcttgagccagtggtcatagttgggacatcctgaggatctttccctgggaagtcacatttacgtctgtatgccttctgctgtctccaagtactggcattctgccytgatcacctcattaatagtactatgcttcaagtttagtatcattagggaaagctagttaatcagtgttgcattagttaagtaagatggcaactctcaactctacatgagcaaatgacttcacctgtcttgaccaatgaagttctgtcttttaatactcagatcagttatttgacaagtagatgtattgtttctttgtttatttttgttttattattttaatttacttgcccaggaacccgattcaatacaggtgaacctgttcccctaaagccctagtagttagtttatactcagaggag

SEQ ID NO: 69396 - DNA, 601 bp, Human
gaggggaagatcttgagccagtggtcatagttgggacatcctgaggatctttccctgggaagtcacatttacgtctgtatgccttctgctgtctccaagtactggcattctgccttgatcacctcattaatagtactatgcttcaagtttagtatcattagggaaagctagttaatcagtgttgcattagttaagtaagatggcaactctcaactctacatgagcaaatgacttcacctgtcttgaccaatgaagttctgtcttttaatactcagatcagttatttgacaagtagatgtaytgtttctttgtttatttttgttttattattttaatttacttgcccaggaacccgattcaatacaggtgaacctgttcccctaaagccctagtagttagtttatactcagaggagactattccttgcctaagggcatctggaatttaaaatagtgcagtgcattcagtcattctcatctttcacaatctcaaaaacatgatttcctgatcaatgccctcaacatatgttttatttcttttttctttttttctttttcttttttttttttttttgagatggagacttgctctgtcgcccagg

SEQ ID NO: 69397 - DNA, 601 bp, Human
gtctccaagtactggcattctgccttgatcacctcattaatagtactatgcttcaagtttagtatcattagggaaagctagttaatcagtgttgcattagttaagtaagatggcaactctcaactctacatgagcaaatgacttcacctgtcttgaccaatgaagttctgtcttttaatactcagatcagttatttgacaagtagatgtattgtttctttgtttatttttgttttattattttaatttacttgcccaggaacccgattcaatacaggtgaacctgttcccctaaagccctrgtagttagtttatactcagaggagactattccttgcctaagggcatctggaatttaaaatagtgcagtgcattcagtcattctcatctttcacaatctcaaaaacatgatttcctgatcaatgccctcaacatatgttttatttcttttttctttttttctttttcttttttttttttttttgagatggagacttgctctgtcgcccaggcaggagcgcagtggcgcaatctcacctcactgcaagctctgcctcccaggttcacgccattctcctacctcagcctcccgagtagctggg

SEQ ID NO: 69398 - DNA, 601 bp, Human
gtgtctcgcatgaggctcccagaccttctagaacaagagaaagaagatccgtaaaggggcatctgtgaaggagatagaagggtcagatgaccgatggctcccccagcattccttcttagctccttttagccatttgtttaccctttactgtgctaaatatagctattctggatgtatggaaataataaaaattattataatataaatctgtgtatatatatataaaatacctgtgtgctattccatacgtacgtgtatgtgtgtgtgcttaatcttccttaaattaaaccatgcattctckcttgacccaaggacagcccatgttaagcactgaatgcccttttgggttgcgtgtgctccagtacccactgtcttgcacacttgattttcatcatgcatgaaaggaccacagggtccttttctgagccatcgtagtcttaaaccttgaagtgcatgaacacagaagcacgcttctgcctacctctggtgttcagcaccagaaattctgtgtctaacacctgttttcaatcttctgctccatttctcaaatcttattatatctctgccttttcacactttgtagtctctctctaatatttgt

SEQ ID NO: 69399 - DNA, 601 bp, Human
tgttttcaatcttctgctccatttctcaaatcttattatatctctgccttttcacactttgtagtctctctctaatatttgtttgcaaacactaactcatttgtatttctataattaccgtgattttttgtcttctcgtctgtagtggctcccccttttctggcagcatctctgtaactcctgttcttccatataatggcacaacaggagagatgatcttttagtgtaagcaggacggggcaggttttcttcatagtcaggatatgattgtgtgtccagagccataacgttatctttctcataagtagtctccagattcttgacttaatgggttctaaggattcccggttttaagtatgagtatcttgtcctctatactctttcattctacttcatgatttgataacattgtgtttcaaggtctgacaaaggacatcttaaaggaatttgtttatccacatgatctgcctttatagtgtgagaaattatatttatcagataagaaacataggcaaaaattttggaaaatgcccagaaaatatcagggagaaagtgtttcctaaaacctcctataccgtgatacttctttgcagttgtggat

SEQ ID NO: 69400 - DNA, 601 bp, Human
agtgtgagaaattatatttatcagataagaaacataggcaaaaattttggaaaatgcccagaaaatatcagggagaaagtgtttcctaaaacctcctataccgtgatacttctttgcagttgtggatcaaggtttgtcaccctaagcttcagtattgtgtgtgcattctgtcaaatctttgtctttttatgtgataatataacttatcttagataattcccctaaactgagtgtgttccaaaagtaactgcagatcagaacttcaggatagtatacaaatttcaatgaggcaaaaaatcayagtggcacaaaagtcattacatgcacttataggacaggcatggttcttctctgctagtgcttgcattcctttgacctgcagatacaaagtctattcttccattataatttattttaaaatatgtgttctcagagggcagggctttgtgcttgagttttttttgtgtgtgtagtaccccacgttttgctcactgtagtagttattaaatatgactcatgtactaggacaccaagaaatgcttttgaaacaaaaaagatacctttcaaataatcagcctctggaggaaggcactgtccgtcc

SEQ ID NO: 69401 - DNA, 601 bp, Human
caactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctkcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataa

SEQ ID NO: 69402 - DNA, 601 bp, Human
cctatcacctagttcataaccgcccctgaccgccctcacttggaggcatgtgaatctgcaatccctggttttaagggagagggtaacaccatagacaggggttacaggaaaatgacactgaaagtgacccagtgattaaactgggcagtgaaactgaaggcaagagggcaagttaggaggatttcaccacagcatgaggaggtgacaaaagcctgaaccaagttcggagaataaatactcagaagaatgtaaagattcaagaaatgcttaaaacgctccaggcacaagaatgcttattaaycatggaacttttctgtgtcatttgttcatggacaaagactgtattaggagacaggaagaaggactcaaaattaattttcaatttataattaaagtgactattaagcaaactgtggaaaatccacctcaatgccatacagcagagacaaccgatgaggcacagctgtctgtgtgattctcatcgtggactctcaggatcgttttccaggtggaacagaacaaatcctactgcaaaccctctgcgcgaagcccctgacaagtgaggtttacaagcaggggctggggtctaaaccagtacaat

SEQ ID NO: 69403 - DNA, 601 bp, Human
tcagtacaatcctatgtgagaggagtcacaaagcaatacacacgaccaccttcacagaggagggaagggatatgttagcctggtgcagacggataaggttttacacaggtggtgatgtctaagctgactcttagaagtaaaaggatttcaggtgcaaacgactgagaaagagggaaaacagaatttgtaaaggcaccaagatctgaacgagtaggctctggtccaggaagggcaacaggttcagaatggctggaatgccagctgcatggaagggtaaggttgtgttcagattcagaaaggscttgtacatcacgccaagaaacctggagcattaccgtcgataatggacaacctggagaagtgcggagagggtttaaaccaaagccacgtcagcctgaagaactgctttagctcacttatcacaggtttttcaaatattagaattagtagccaacatctaaaaattagcaaatttcacataaaaatatagaatcttggttcctttaagaaaataatctggcacattgggccaacattcctatggtgacatgtgtctgagtagcaggtgcagcagctggccccttcaagtgggacacctatc

SEQ ID NO: 69404 - DNA, 601 bp, Human
tcttcattcctcaactatttttgagcatctactgtgctccaggcactattattaaaaaaatgcaagcatgaatattgcacagcttttgtcttcccaatgtcccagcagagaagagagacttctagattaaaaaagaaaaaaatcagtacaatcctatgtgagaggagtcacaaagcaatacacacgaccaccttcacagaggagggaagggatatgttagcctggtgcagacggataaggttttacacaggtggtgatgtctaagctgactcttagaagtaaaaggatttcaggtgcaaaygactgagaaagagggaaaacagaatttgtaaaggcaccaagatctgaacgagtaggctctggtccaggaagggcaacaggttcagaatggctggaatgccagctgcatggaagggtaaggttgtgttcagattcagaaaggccttgtacatcacgccaagaaacctggagcattaccgtcgataatggacaacctggagaagtgcggagagggtttaaaccaaagccacgtcagcctgaagaactgctttagctcacttatcacaggtttttcaaatattagaattagtagccaacatct

SEQ ID NO: 69405 - DNA, 601 bp, Human
tctacgtttcctcccttttccttctgccaagacatatcaatagcatcaactccaacctctgtcccaggcaggttttcgaaccgtgaaaaccgtgaattcacagtaaacctgactctgcagttctctccatgcctaaatggctatccatcgcctttcagggtctcctgaacatctcccttcttctctcttgtcacatcctggagttgatatcccaaactcacaggcctaatccatcattctttcattttcttcattcctcaactatttttgagcatctactgtgctccaggcactattattwaaaaaatgcaagcatgaatattgcacagcttttgtcttcccaatgtcccagcagagaagagagacttctagattaaaaaagaaaaaaatcagtacaatcctatgtgagaggagtcacaaagcaatacacacgaccaccttcacagaggagggaagggatatgttagcctggtgcagacggataaggttttacacaggtggtgatgtctaagctgactcttagaagtaaaaggatttcaggtgcaaacgactgagaaagagggaaaacagaatttgtaaaggcaccaagatctgaacgagt

SEQ ID NO: 69406 - DNA, 601 bp, Human
ccagggagctgtgactgcaccactgcattccagcctgggtgacagagcgagaccctgttttcaggaaaaaaaaaaaaaaaaaagaaaaaaaaattcttacacttataattaatgtagccatgtgaagtattttaatacttgtatatattaagcactgtgtcagtgtgtgtgcactgctgagaagtgagccctggtggaggcttcgaagagcatcctggaaccccctaggctccgagaagtcctgaggtcagggagtttgcagagagcagccttggctcaatgctacagaagccagaggagrtggaatctgcaaatctccaaattcacttccacccaacttcccaaaaagtactattatccgttgttagctacttctttaggaaaatttaagaatgatctcgcttttcaccacccaatgttataccggaaatatatttcaggaagcaagtggctatcttttcttccttaataaaagccaaggcttcaaagagataacggagctgaaccgaaatagctaagccattctccccatttataaatattacataaagtctcctcttcaaaagccgaagggtacaaagctcctctgctgaaagcagcc

SEQ ID NO: 69407 - DNA, 601 bp, Human
tgtgtaatgccagcactttaggaggccaagatgggggcactccttgagcccaggagtttgaggccagcctgggcagcatagcaagaccccatctctacaaagaaataaaaaataaaaccattagccaggcgtggtggcgtgtacctatagtcccagctactcgggaggctgaggtgggaggattgcttgagcctgggagggtgaggccccagggagctgtgactgcaccactgcattccagcctgggtgacagagcgagaccctgttttcaggaaaaaaaaaaaaaaaaaagaaaaaaaaattcttacacttataattaatgtagccatgtgaagtattttaatacttgtatatattaagcactgtgtcagtgtgtgtgcactgctgagaagtgagccctggtggaggcttcgaagagcatcctggaaccccctaggctccgagaagtcctgaggtcagggagtttgcagagagcagccttggctcaatgctacagaagccagaggaggtggaatctgcaaatctccaaattcacttccacccaacttcccaaaaagtactattatccgttgttagctacttctttaggaaaatttaagaa

SEQ ID NO: 69408 - DNA, 601 bp, Human
ttagtctaacttggaaaaaaaatgataaaggcttgaccacccagagagggcaatacacttgaagagattaaaaaatcaggaaacacttaaataagagaaatgaaagaaagttcctccggctacagctgggattctgtctctatggaaatggaagctgattacagggcccttcaaaatcaactttatcaaccagatgaagacagctgctgcttgggaaagagtttctgcagtgaaatctctttaataaaaagaataaaatcagcagcattacgattatgctgggaagcttttttttttttttaagagacaaggtcttgttctgtcacctagtaacacgatcatagctcactacaaactcaaactcctgggttccagcaatcctcccaccgcagcctccctgaaagctgggacttgcacatcaccctcagctcattttttaattttttgtagagatggggtctcactctattgcccacactggtgttcttggaagctttaacgagaatgtgtgtgcaaattacatgccatgttaaaacaaaatgatggaaaataaataaattaggacaaattttaaataaatagctatctaaatcaattagaa

SEQ ID NO: 69409 - DNA, 601 bp, Human
aaaattagccaggtgtggtggcgcacgcctgtaaccccagttactggggaggctgaggcaggagaatcgcttgaacccaagaggtggaggctgcagtgagcagagatcacgccactgcactccagcctgggcaacagagcaagactccatctcaaaaacaaaaaacaaaaattaaaaaacaaaaaaatgattttaatagattatatctaaaattacaggtcctccccagctctttaatctatcccccaaagaaggtcgacatggatagcatgtgttccaggtttaacaagacttttgagayagctcttccagataacccatgatcatatttgtttattattttgcctggtcctttagaaagaccactcccttgaaagcaggttgttttcgagatttatctgaaaaatattttagtctaacttggaaaaaaaatgataaaggcttgaccacccagagagggcaatacacttgaagagattaaaaaatcaggaaacacttaaataagagaaatgaaagaaagttcctccggctacagctgggattctgtctctatggaaatggaagctgattacagggcccttcaaaatcaactttatcaacc

SEQ ID NO: 69410 - DNA, 601 bp, Human
tgccattaccgattcagtcatgccaaaggggctacacctcttctttgtttcaatgaagcatttccagttttaaccctatcatacaatcaaaaatagaagttgtcagttccatcttgttcctgatagctggaaactgcttccctctggaaactgcggagaagcctgcaggaaggagacagagtacatgctccttctccagagctatgctttctcccttagccaacctgaatctcttaactaaaagcagtaacattccttcttcaataaatttttcccaagtactatgccaagtagagagacrcttcagctaggctggatgggatggtgggtcagaactgagtattctcgaggggcctccttgaggaggtcacaggaaatggagtcatgtgaatagttaagtccttccttctttcaacaagcactaactgacaagggggcaagggctagctggagcgagaaaaacgaaaagggctccccaggccaagaagcggcgtgtttaaaaacagaaaggtgggcacatacacacaacctagaggagtgaaaacataaataattttaaggccgggcacagtggctcacgcctgtaatcccagaactttgg

SEQ ID NO: 69411 - DNA, 601 bp, Human
cgaggctacagtgaggcaagatcatgccactgtagtccagcctgggcaacaagagtgagaccttgtctcaaaaacacaaacaaacaatggaccacaaatatgacagcggtcccacgagataacaataatgtactatatttttactgtatgtttttgtataaagacacacacactcaccatcatgttacaattccctatgggattccatacaatcacatgctgtacagttttgtagcctaagagcaaaagcctgagtcacaagcacaccatctagcccaggtgtgtagtaggctacaccatytgggtgtgtgtagggacattctgggaatgaccacacaatgacaaaatcttattatgcatttctcataacgtatccccaccattaagtaatgcatgagtgttctaataatagcaagtattaagaccatcaggtaccgggtggtacactaggcccttatagatattaattcacaatgaccctatgaggtgctcttattattcccattttatagatgaggcacctgaggcacagagaggtcaagcaacttgcccaaggatacacagctagtagcaaacaaaaaagatgcttacaaaaaagcca

SEQ ID NO: 69412 - DNA, 601 bp, Human
ccgggaggctggggcaggcagatcgcttgagtccaggagttcaacaccagcctgggagaaatggcgaaaccccatctctataaaaattacaaaaatttgccggcagtggtggcatgtgcctgtaatctacgctacttgggaggctgaggtgggaggatcacttgagcccaggaagccgaggctacagtgaggcaagatcatgccactgtagtccagcctgggcaacaagagtgagaccttgtctcaaaaacacaaacaaacaatggaccacaaatatgacagcggtcccacgagataacartaatgtactatatttttactgtatgtttttgtataaagacacacacactcaccatcatgttacaattccctatgggattccatacaatcacatgctgtacagttttgtagcctaagagcaaaagcctgagtcacaagcacaccatctagcccaggtgtgtagtaggctacaccatctgggtgtgtgtagggacattctgggaatgaccacacaatgacaaaatcttattatgcatttctcataacgtatccccaccattaagtaatgcatgagtgttctaataatagcaagtattaagac

SEQ ID NO: 69413 - DNA, 601 bp, Human
caccatcacagataaaatggtttttacaatagtcatgcaccgcttaataatgtttcactcaacaatgaaccacccgggaggctggggcaggcagatcgcttgagtccaggagttcaacaccagcctgggagaaatggcgaaaccccatctctataaaaattacaaaaatttgccggcagtggtggcatgtgcctgtaatctacgctacttgggaggctgaggtgggaggatcacttgagcccaggaagccgaggctacagtgaggcaagatcatgccactgtagtccagcctgggcaacaagagtgagaccttgtctcaaaaacacaaacaaacaatggaccacaaatatgacagcggtcccacgagataacaataatgtactatatttttactgtatgtttttgtataaagacacacacactcaccatcatgttacaattccctatgggattccatacaatcacatgctgtacagttttgtagcctaagagcaaaagcctgagtcacaagcacaccatctagcccaggtgtgtagtaggctacaccatctgggtgtgtgtagggacattctgggaatgaccacacaatgacaaaatctta

SEQ ID NO: 69414 - DNA, 601 bp, Human
tgagacgaggtacggtggctcacacctgtaatcctagcactttgggaggctgaggcaggcggatcatgatgtcaggagactgagaccatcctggctaacacggtgaaatcccgtctctacgaaaaatacaaaaaattagccgggcttggtggcgggtgcctgtagtcccagccactggggaggctgaggcaggagaatggcgtgaacctgggaggcagagcttgcagcgagccgagatcacgccactgcactccagcctgggtgacacagcaagactctgtctcaaaaaaaaaaaaaaaaagaattctgaaaatgaatgccttacggtaaggcaggccctaggagtcacctctccttggcatccaagcctggccctggtgagcccttcggggctaggatacaacacagcacagtatcacacagcaaacctttcagacacactcaagagtgaactccaaccgggcgcagtggctcacacctgtaatcccaacactttgagtggcgaaggcaggtggatcacctgaggccaggatttcaagaccagcctggtcaacatggcaaaaccccatccccatctctactaaaattaaaaaaattcgcc

SEQ ID NO: 69415 - DNA, 601 bp, Human
aaactaccatttaatgtacttcaggtttattctatttgatacatgaaccaatatttccccaacacaatcttttccagccccatactttgtagtgttttaagctaatgttctaagtttgaagacaaaagaaaatgaattaacatacggtatacaaagatctcacatctgatcattccattctattgagattaatagtttttcaggaaaccataaagaaagtggggagggttctgctaatattgatggagattaagttgcttcttatgttttcttcaacagttaaagctctgcaaccatcctrtaaacccaagtttccaagctggcagggctagcccaataacactattttatttgcttaacacagtgttttaaagaattctgagacgaggtacggtggctcacacctgtaatcctagcactttgggaggctgaggcaggcggatcatgatgtcaggagactgagaccatcctggctaacacggtgaaatcccgtctctacgaaaaatacaaaaaattagccgggcttggtggcgggtgcctgtagtcccagccactggggaggctgaggcaggagaatggcgtgaacctgggaggcagagct

SEQ ID NO: 69416 - DNA, 601 bp, Human
gggataaacataggtagtgtccctgaatgcattcctaaattgttacagaatcattagcccagacaggacagctaccatggcttctagaacatgaccgggtggccacaggcactcagcatgctcgctgaattagccgttatcttcatctcctccacagggtatgtgcatatgactgtcagaaaccagtaaggcaaaacaggagaagctgagaacactgcttccgacgtctgcaggtgtggcttcaaatctgggctctaccacttattgcctgggtgactttgagcaagttaatgatgctccytaaatctgtttccttacctattaactatataatgacaatacattgtgaggtttgaaagattaatccatacagagggcttagcacaatgcctggtatgtggtaaatgtgtgcgtgtattatattaatacactccatgcatagatggcatggtatttcaatcatattatctattattttcatcctcctaacaaagagtgcacaacgttgtagaatacaaacatataataaattacataggcatctttgacacgccctaaagacttaagcatttacagctgtttcattatttatttattttga

SEQ ID NO: 69417 - DNA, 601 bp, Human
tgatgtgtacgtagaaaatcccaaagaatcaacaaagaagaactgaaactaataactacagcaagtttgcaggatacaaggtaatatacaaaggcaattgcttttctatataaaaaaatagaattttacattaaaaacacaccatttacattaacaccaaacaaatgaaatatttagatatatagctaacaaaatatgtacaagctctatatgagaaaagcttcaaagctagtatggaagaaatcaaagacctaaataaacaatgagatacttcaggttcatgaacaggaagactcaacaytgttatgatgtcagttcttcccaagttgatctacatatcaattccagtcaaaataccagcaagtttatggatatcaacaaactgatcctaaaatttacatggaaaggcagaacagccaatgcaatattgaagaaaatacagttggagcactgacactgaccaacttcaaaacttaatgtcagttatagtaacaagacagtgtggagttggtgaaacaatagacaagtaggtcactggaataaaatagaaagcccagaaatagacccacacaaatataatcagctaatctttggcaaaagt

SEQ ID NO: 69418 - DNA, 601 bp, Human
cgtccttgttaacgcagtaaggtaagaaaaagcagcaaaatgtatgcagattggaaaggatgaattaaaactgtctttctccacagataatatgatgtgtacgtagaaaatcccaaagaatcaacaaagaagaactgaaactaataactacagcaagtttgcaggatacaaggtaatatacaaaggcaattgcttttctatataaaaaaatagaattttacattaaaaacacaccatttacattaacaccaaacaaatgaaatatttagatatatagctaacaaaatatgtacaagctctrtatgagaaaagcttcaaagctagtatggaagaaatcaaagacctaaataaacaatgagatacttcaggttcatgaacaggaagactcaacactgttatgatgtcagttcttcccaagttgatctacatatcaattccagtcaaaataccagcaagtttatggatatcaacaaactgatcctaaaatttacatggaaaggcagaacagccaatgcaatattgaagaaaatacagttggagcactgacactgaccaacttcaaaacttaatgtcagttatagtaacaagacagtgtggagtt

SEQ ID NO: 69419 - DNA, 601 bp, Human
ttaatgttaaggaactagttgctttcctactacagttgggaacaaggcaaggatgtcccctctcaccacttctagccaaaatcagattggacgtccttgttaacgcagtaaggtaagaaaaagcagcaaaatgtatgcagattggaaaggatgaattaaaactgtctttctccacagataatatgatgtgtacgtagaaaatcccaaagaatcaacaaagaagaactgaaactaataactacagcaagtttgcaggatacaaggtaatatacaaaggcaattgcttttctatataaaaaawtagaattttacattaaaaacacaccatttacattaacaccaaacaaatgaaatatttagatatatagctaacaaaatatgtacaagctctatatgagaaaagcttcaaagctagtatggaagaaatcaaagacctaaataaacaatgagatacttcaggttcatgaacaggaagactcaacactgttatgatgtcagttcttcccaagttgatctacatatcaattccagtcaaaataccagcaagtttatggatatcaacaaactgatcctaaaatttacatggaaaggcagaacagcc

SEQ ID NO: 69420 - DNA, 601 bp, Human
aagaacatcattgaccatgaaaactcactaaccaaaaagatgcccagaacacagggcaaaactataattgactatttcaaaacaaggtaaaaagccattacaacaatgatacatgacacaaaacagaaacataaatctgatttccaaaaattcagcaataaagggacaaaacttaagaaaaaaattagaaacaaaaaaaattatttcagaaatgaaagctaaattcaaagacatataagagcaaataaacacaatacgtaatactttacaagaaacagaagttaaagtggggatttcttcyttttttttttttttttttttttgagatggaatctctctctgttgcccagactggagtggagcggggcaatctcggctcactgtaacctccgcctctcgggttcaagggattctcctgcctcagcctccagagtagctgggattataggtgcccaccaccacgcccggctaattcttgtatttttagtagcgacggggttttaccatgttggccaggctggtctcgaactcctgacctcacctgatatgcctgcctcggcctcccaaagtgctgggattataggcatgagggatttctttt

SEQ ID NO: 69421 - DNA, 601 bp, Human
ctcttagaggcagcatcgaccacacatcctgattagcctggaatggtcttggattataccagctgtccctctaaaaaatgtcctggtttggaggataagctacacgaccacacaacttacggaacagagaatatggaccaaccacctaacacgctaggtataagaatcatggacactgagaggtggatttagaaagacaatggcagttcagaaagagatgttacttatcgtaggatgacaaactgagaaatgctttagggtagagagtacaccatgcacccaggggacctacacaactcaygggtgatggagtcaatcccaggcttatctgagcacagagatgaaaaacagggaaggcatatgatagggtctggctctgtgtcccctcctaaatttcatgttgaattgtaatcgtttgtgttgagggagggacctggtgggaagtgactggatcatgggggtggattcccccttgcttttctcatgatggtgagtgagttctcaccagatctggttgtttgaaagtgtgttagcacctccctatttgttctctctttctcctgctcccatcacgaagacgtgatttcttccccttcgcctt

SEQ ID NO: 69422 - DNA, 601 bp, Human
ttaaaagttgtgttttcttttctttttctttaatggagaagagaaattcagtcgttgcttcagccgatcacaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagacagacrtatttatacaaccagtcactcctttccactcgggaatggtgagttcactgtgagtcttgtatggaaactgagctgttagaaaagaagggagaaaaggtctaccgaaatagaatgggttatttaaaagtacaaaagctgcccccgttgaacgtgtcgggaaaatgggagcaggctgtaccactgacccgctactggtgccttgctgaccgtaatcacacctggtagattttctgctgtgttgataacatcttctaatgctcctgctaaccagacaccattcagaatgagctcccccaaagc

SEQ ID NO: 69423 - DNA, 601 bp, Human
acttagcaggagagaaactaaaaaagtttaaaagttgtgttttcttttctttttctttaatggagaagagaaattcagtcgttgcttcagccgatcacaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggwcaggcaaagaccaagtggagacagacatatttatacaaccagtcactcctttccactcgggaatggtgagttcactgtgagtcttgtatggaaactgagctgttagaaaagaagggagaaaaggtctaccgaaatagaatgggttatttaaaagtacaaaagctgcccccgttgaacgtgtcgggaaaatgggagcaggctgtaccactgacccgctactggtgccttgctgaccgtaatcacacctggtagattttctgctgtgttgataacatcttctaatgctcctgctaaccagac

SEQ ID NO: 69424 - DNA, 601 bp, Human
attagcaaggaaaaaaaaatgttgctcttctcaaaaaagtgcaaagttcacaagctcaggttcacgaggacagatttaatgagggaaaactggttcttttcagtcatttcattgtgtcctttcaacaaacacttagcaggagagaaactaaaaaagtttaaaagttgtgttttcttttctttttctttaatggagaagagaaattcagtcgttgcttcagccgatcacaccactagaatgtatttttctttctcactcttgccacaggaccacatggtaaagtaggtaagaggaagaaaamcaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagacagacatatttatacaaccagtcactcctttccactcgggaatggtgagttcactgtgagtcttgtatggaaactgagctgttagaaaagaagggagaaaaggtctaccgaaatagaatgggttatttaaaagtacaaaagctgccccc

SEQ ID NO: 69425 - DNA, 601 bp, Human
gtcactgaagtcaaaagaaaactgaaggtactcccatcttcccttaatttctccgaaaatagcacaagcaactaattagcaaggaaaaaaaaatgttgctcttctcaaaaaagtgcaaagttcacaagctcaggttcacgaggacagatttaatgagggaaaactggttcttttcagtcatttcattgtgtcctttcaacaaacacttagcaggagagaaactaaaaaagtttaaaagttgtgttttcttttctttttctttaatggagaagagaaattcagtcgttgcttcagccgatcrcaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagacagacatatttatacaaccagtcactcctttccactcgggaatggtgagttcactgtgagtcttgtatggaaact

SEQ ID NO: 69426 - DNA, 601 bp, Human
tgagagtcactgaagtcaaaagaaaactgaaggtactcccatcttcccttaatttctccgaaaatagcacaagcaactaattagcaaggaaaaaaaaatgttgctcttctcaaaaaagtgcaaagttcacaagctcaggttcacgaggacagatttaatgagggaaaactggttcttttcagtcatttcattgtgtcctttcaacaaacacttagcaggagagaaactaaaaaagtttaaaagttgtgttttcttttctttttctttaatggagaagagaaattcagtcgttgcttcagcygatcacaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagacagacatatttatacaaccagtcactcctttccactcgggaatggtgagttcactgtgagtcttgtatgg

SEQ ID NO: 69427 - DNA, 601 bp, Human
tctgagagtcactgaagtcaaaagaaaactgaaggtactcccatcttcccttaatttctccgaaaatagcacaagcaactaattagcaaggaaaaaaaaatgttgctcttctcaaaaaagtgcaaagttcacaagctcaggttcacgaggacagatttaatgagggaaaactggttcttttcagtcatttcattgtgtcctttcaacaaacacttagcaggagagaaactaaaaaagtttaaaagttgtgttttcttttctttttctttaatggagaagagaaattcagtcgttgcttcasccgatcacaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagacagacatatttatacaaccagtcactcctttccactcgggaatggtgagttcactgtgagtcttgtat

SEQ ID NO: 69428 - DNA, 601 bp, Human
accaagaaagatgggtgagctgcaactggcagacaattagcagtgtctcacacctgcagaccatccatctgagagtcactgaagtcaaaagaaaactgaaggtactcccatcttcccttaatttctccgaaaatagcacaagcaactaattagcaaggaaaaaaaaatgttgctcttctcaaaaaagtgcaaagttcacaagctcaggttcacgaggacagatttaatgagggaaaactggttcttttcagtcatttcattgtgtcctttcaacaaacacttagcaggagagaaactaaaraagtttaaaagttgtgttttcttttctttttctttaatggagaagagaaattcagtcgttgcttcagccgatcacaccactagaatgtatttttctttctcactcttgccacaggaccacatggtaaagtaggtaagaggaagaaaaacaagagcagaaaagaaaaagttaataaaagatctttgagaaaaatatttagggcaacaaaggactccaggtcgggtctgcagggaaggcagtgaagctgaaagaatcaacagacccccacaaagcccggtcaggcaaagaccaagtggagac

SEQ ID NO: 69429 - DNA, 601 bp, Human
tcaccccaatctacccaattccaatacatctcagggctcattctagttttctcccttcccgtatttgtaattctctcctctaacgacgagaactccgcttcgttggcctttaaaccgtttacttatttaataaatgcccctatatagagctacataaaatggttatcttacagtgaaaccgggacagctctgtgctcatctgcaaggacacctggaagtttggtactgattcttaatcaagataaggaggagtgggccagcttaaagttaaaaacgcccctggtggtccccagagccagcytgcttgaacattcagggaggtgcggatcggatcgatgccttacacctggacacagggcctgggttggcttggtgactggccaagcacagaagacagtgcttgatgtttctgcccaggctctcctgacaccaagattccttggacacgtgttgatggttcataatctggagacaaaatgtgccctttggagccacaacagtgagtctcttgggtcactgatgctggcttgtgctttcttcctacagctgaaccacctcctgtgcttttattaagtcttcacgtgagcaggtgctgtggaat

SEQ ID NO: 69430 - DNA, 601 bp, Human
aaacaaagaacttgttctaacaatttcaagttttcaatgctttcaagtaagttttgctcatgaaatgctcaccaatggtctggcaattcaggtcagcatagcatttactatctctgaatggaaccacttccagagcaacaatgtcattttttttctctttggtttataaacatgataagaaagaatcttcaggccaggcgccacggttcatgcctgtaatcccagccctttgggaggccaaggcaggacgatcgcttgagcccaggagttcaagaccaacctgggtaacacggcaagaccytgtctcaaaaaaaagaaaagaatcttcaaagtagagctaactacaaaaggacaaaatacaggatgacaatattctcatcttagtgtcaccaaagtaaactaaggtttctgcaaataatcattcttcattagtttctcccaaggaaacagtaacagactcagcagtgccataggattacctaaatgtcagaaactgtaacaaatgagaaacatcacttacttgttagcttgttatggctgaggaccagttgtgtgatatgggataaggtaactaaaaagaaaagaaaaaaaaaaaggtcag

SEQ ID NO: 69431 - DNA, 601 bp, Human
tgtatacaattttgcatcttttcctccatcaagcagggacagaaagtgtattaaacagttaaaactttccctttcgaggaggaaatataaatgaaaacaaagaacttgttctaacaatttcaagttttcaatgctttcaagtaagttttgctcatgaaatgctcaccaatggtctggcaattcaggtcagcatagcatttactatctctgaatggaaccacttccagagcaacaatgtcattttttttctctttggtttataaacatgataagaaagaatcttcaggccaggcgccacggktcatgcctgtaatcccagccctttgggaggccaaggcaggacgatcgcttgagcccaggagttcaagaccaacctgggtaacacggcaagaccttgtctcaaaaaaaagaaaagaatcttcaaagtagagctaactacaaaaggacaaaatacaggatgacaatattctcatcttagtgtcaccaaagtaaactaaggtttctgcaaataatcattcttcattagtttctcccaaggaaacagtaacagactcagcagtgccataggattacctaaatgtcagaaactgtaacaaatgag

SEQ ID NO: 69432 - DNA, 601 bp, Human
aatttttcttttggggaagccagactcaaaaatttgaaaaatgcagatgtaaaggtatatcatgtatacaattttgcatcttttcctccatcaagcagggacagaaagtgtattaaacagttaaaactttccctttcgaggaggaaatataaatgaaaacaaagaacttgttctaacaatttcaagttttcaatgctttcaagtaagttttgctcatgaaatgctcaccaatggtctggcaattcaggtcagcatagcatttactatctctgaatggaaccacttccagagcaacaatgtmattttttttctctttggtttataaacatgataagaaagaatcttcaggccaggcgccacggttcatgcctgtaatcccagccctttgggaggccaaggcaggacgatcgcttgagcccaggagttcaagaccaacctgggtaacacggcaagaccttgtctcaaaaaaaagaaaagaatcttcaaagtagagctaactacaaaaggacaaaatacaggatgacaatattctcatcttagtgtcaccaaagtaaactaaggtttctgcaaataatcattcttcattagtttctcccaagga

SEQ ID NO: 69433 - DNA, 601 bp, Human
ggcaagcaaaaagaactgagtcattaggaatgggaaaggagcgtgggtccctgtcattaaaatctttaaagccacagctctacgaagaaaacggcccatcatgcacacaagatagtcatataaaaataggcattcatctatgctaagcagatacgtctactgtggggctctatggatacccagcagaatttttcttttggggaagccagactcaaaaatttgaaaaatgcagatgtaaaggtatatcatgtatacaattttgcatcttttcctccatcaagcagggacagaaagtgtattraacagttaaaactttccctttcgaggaggaaatataaatgaaaacaaagaacttgttctaacaatttcaagttttcaatgctttcaagtaagttttgctcatgaaatgctcaccaatggtctggcaattcaggtcagcatagcatttactatctctgaatggaaccacttccagagcaacaatgtcattttttttctctttggtttataaacatgataagaaagaatcttcaggccaggcgccacggttcatgcctgtaatcccagccctttgggaggccaaggcaggacgatcgcttga

SEQ ID NO: 69434 - DNA, 601 bp, Human
ccttctgccaggtgcgtactgcatcacaggcaggtgctcaaagaaagcattatttccgaaaggatcttcaatctgaaactcttcccattgggccaggatggctttgcattctgactttgccaatgactttgttgcattcaaagttagtacctgcccattcatagcaaaaaggcagaagaaaaaaattcacttgcaactattcttcccgtctccttaaacacatcatgcatatatacatatctaggaaagttgctacagacagattaagtcccccgctgacttcaaaaacccatcaacgctrccccaagctcccaggtttaaattcaaataggggcaccataatagtcttggagcattaacagcaattagcttgacaatacattaatatttttatgaactgcagtatttaaaagttcaggaatttctgctcccagattcttgaggaatttcagaatcacagatcccactttcagcttccttgtcgcctcacttttactgccctgggtagacatgtcaaggccaaaaccactggcaagaaaaggcaagtcaaccacgtgccacactgtttcaataaccctgtagatcttaagtcagtggagtc

SEQ ID NO: 69435 - DNA, 601 bp, Human
agatcctgggcccagaggcagggctacggggggacagaagatgatccatcttcctagagcagcaaatggagaggagaggctggcatgggatgtggggcagattagggcagtttctgaaaggcagagaggggcagtgagtgcatgagagtaagccagccttctgccaggtgcgtactgcatcacaggcaggtgctcaaagaaagcattatttccgaaaggatcttcaatctgaaactcttcccattgggccaggatggctttgcattctgactttgccaatgactttgttgcattcaaagtyagtacctgcccattcatagcaaaaaggcagaagaaaaaaattcacttgcaactattcttcccgtctccttaaacacatcatgcatatatacatatctaggaaagttgctacagacagattaagtcccccgctgacttcaaaaacccatcaacgctgccccaagctcccaggtttaaattcaaataggggcaccataatagtcttggagcattaacagcaattagcttgacaatacattaatatttttatgaactgcagtatttaaaagttcaggaatttctgctcccagattcttgagga

SEQ ID NO: 69436 - DNA, 601 bp, Human
ctgagtaacacatcacagcccatcattccttggctctatgattgtaaagatgagatggccatcatttattggacataaggtcatataccttttttttttttttttttttgagatagggtcttgccctgtcacccaggctggagtgcagtagtacaatcacagctcactgcagcctcaaactcctgggttgaagtgatcctcacactacagcctccacagtagctgagatgcctggctcatgttttttttaagagatggggtcttgctatgttgcccaggctgaaggtcatgtatctttagrgcatcacgctctaccatgtttgaaatgagcacacaacgagtaagaaacagaagtctgtggcagccacatctactcaagtccctataccagttaatcccaaagaaaccatctgatcccaatgttccccactttctctccagccagcagtttcctctctgcccttccctgtcattcacatacctcctgggagcaatgaacactcggtttatacaggtaattactgcgaagccactaagggcccagtcacaggcattcaggaagaatatgaaatgatccatgcttccacaaaagctgaccatc

SEQ ID NO: 69437 - DNA, 601 bp, Human
gaaacacaggaagatgaccttcggcattattgctgccttcccacgcatctgagcggtcatgaaaacagtttccctggctgcgagtcctttgtgtgcctgagtaacacatcacagcccatcattccttggctctatgattgtaaagatgagatggccatcatttattggacataaggtcatataccttttttttttttttttttttgagatagggtcttgccctgtcacccaggctggagtgcagtagtacaatcacagctcactgcagcctcaaactcctgggttgaagtgatcctcacaytacagcctccacagtagctgagatgcctggctcatgttttttttaagagatggggtcttgctatgttgcccaggctgaaggtcatgtatctttagagcatcacgctctaccatgtttgaaatgagcacacaacgagtaagaaacagaagtctgtggcagccacatctactcaagtccctataccagttaatcccaaagaaaccatctgatcccaatgttccccactttctctccagccagcagtttcctctctgcccttccctgtcattcacatacctcctgggagcaatgaacactcgg

SEQ ID NO: 69438 - DNA, 601 bp, Human
gggattggattaaggagcagactaaaaaagactcagctgacagtggcttgaaagggagggtaaccacagaggccaggggcaggaaggaaaagcaaagaaacacaggaagatgaccttcggcattattgctgccttcccacgcatctgagcggtcatgaaaacagtttccctggctgcgagtcctttgtgtgcctgagtaacacatcacagcccatcattccttggctctatgattgtaaagatgagatggccatcatttattggacataaggtcatataccttttttttttttttttttttgagatagggtcttgccctgtcacccaggctggagtgcagtagtacaatcacagctcactgcagcctcaaactcctgggttgaagtgatcctcacactacagcctccacagtagctgagatgcctggctcatgttttttttaagagatggggtcttgctatgttgcccaggctgaaggtcatgtatctttagagcatcacgctctaccatgtttgaaatgagcacacaacgagtaagaaacagaagtctgtggcagccacatctactcaagtccctataccagttaatcccaaagaaacca

SEQ ID NO: 69439 - DNA, 601 bp, Human
atttactggacataaggtcatatttttatttttttttaattttttttttgagatagggtcttgccctgtcacccaggctggagtgcagtagtagcttgcaatgtttacgtgtgggttttgctgttggaataaaatttttttaaaacttaaggaaaacttcacttaaaaacgtaatgcccagagcttgttttatcactgctacagaatgcaattcatttcctgttgtacattcatttcatattctccccaacacaatggaattgagcagtatacgaatcagcataaatatgcacaaaatacrcattttcctgatttttacagttatttttgaattaaaatctggttacataaatacttcaaactttcttccacagattaaaaaaaaaaactcaaatatgcccaatacaaaatactatggaaagcagtataattctttcaacgtaaggatattggaggaagagaaatgtttctaatttgagaaagtagccataataaacactaaaaaatgatacgtgaaactgaatattttcatggtaggagaacaaaaaacacagcatacctccttctataaggatttaccttaaatgtggtaaaaactgca

SEQ ID NO: 69440 - DNA, 601 bp, Human
cattttgccataaaacttaggtttactacctgcctggccatttccgatgcattaaatgatgagatatggtcacagtgaagacctgaaattgtaggcaaaactgccaatacctcaggaaaaggttttacatggcagttaaaagtataaaactaaacaattacattcagagacccacacttttgaaaagttttacataaatgtcggctcctcaatgtttgcacagagcaaaaagatatccttggttatttcttgcacaaaatgacgaatgtctaatcctcaacacacatgggtcacaaaattwaaaaaaaaaaaaaaaaactactgccgtatttaagcccatcattccttggctctatgattgtaaagatgagatggccatcatttactggacataaggtcatatttttatttttttttaattttttttttgagatagggtcttgccctgtcacccaggctggagtgcagtagtagcttgcaatgtttacgtgtgggttttgctgttggaataaaatttttttaaaacttaaggaaaacttcacttaaaaacgtaatgcccagagcttgttttatcactgctacagaatgcaattcatttcct

SEQ ID NO: 69441 - DNA, 601 bp, Human
gtagataatcaatgtatacatctgcataaaatttaaaagtattaaattctatgtacttagaatattatctttgataaataaattattgaaaccaccaaagaaggtatcttagtatttcttgtttgttataattctaaattcatacataagctgtaactaataggaaatagtgtatattaaaaaaaaaaaacccacattttgccataaaacttaggtttactacctgcctggccatttccgatgcattaaatgatgagatatggtcacagtgaagacctgaaattgtaggcaaaactgccartacctcaggaaaaggttttacatggcagttaaaagtataaaactaaacaattacattcagagacccacacttttgaaaagttttacataaatgtcggctcctcaatgtttgcacagagcaaaaagatatccttggttatttcttgcacaaaatgacgaatgtctaatcctcaacacacatgggtcacaaaatttaaaaaaaaaaaaaaaaactactgccgtatttaagcccatcattccttggctctatgattgtaaagatgagatggccatcatttactggacataaggtcatattttt

SEQ ID NO: 69442 - DNA, 601 bp, Human
tttcatacaagccatgcacaagaacttttgcataaagcatgacaaataatctatgaaggagggaataactacagacttaagaacagcaaggtctgagaagagtggtgaaggtcgtcctcaggaattcagacagttaattcttctcaatcatcccagcaatctattatgtctgcataaaaaggtttcaatgtattatgctttttaaaaactgctaaattttcttcattataattggatctacaaattttaagaatgcagtattttcatgtgaaatatgctgcttaatttgtttataatatgwcttatggtagataatcaatgtatacatctgcataaaatttaaaagtattaaattctatgtacttagaatattatctttgataaataaattattgaaaccaccaaagaaggtatcttagtatttcttgtttgttataattctaaattcatacataagctgtaactaataggaaatagtgtatattaaaaaaaaaaaacccacattttgccataaaacttaggtttactacctgcctggccatttccgatgcattaaatgatgagatatggtcacagtgaagacctgaaattgtaggcaaaa

SEQ ID NO: 69443 - DNA, 601 bp, Human
agaggcagcaggggacacggcggagcagccacttggaagctgtacagaaagctctgtcgcctcctcattctggtcacttaatcactttacacctgcctcctccacgtaatacagagtgggggttcaacaaattcactcttttctctttcacttcctgctgaagttattatataggtgttgttcttgatggtcccacaggctgtggggtgccttgtatttctttccacacagtgctggttcagttggatgaaaaggagggcttcacagagaaagatgagcattcatctcaactttctgaagrataagccaaattcagagaaaggggtaggaacatcagtttttttaaaaaaatcaggtgactagaacaaagaatagataggcaggggaaaaaagctaaagaaccagcaaaaaattagacaaaagagggttcagactgaaaacagcaaaacgcaaggtcaatgagtttgttactggttatcaattgtatctgagtggttttggtctatgaggctgactgatgaacagaaagaaaaatggaaatgggaaaggtattccgttaaaaaaaaaaaaaactgcatatgcccatatgcccacacacgtt

SEQ ID NO: 69444 - DNA, 601 bp, Human
gggacgtcaagtgcacacacagatcacttgcagaggcagcaggggacacggcggagcagccacttggaagctgtacagaaagctctgtcgcctcctcattctggtcacttaatcactttacacctgcctcctccacgtaatacagagtgggggttcaacaaattcactcttttctctttcacttcctgctgaagttattatataggtgttgttcttgatggtcccacaggctgtggggtgccttgtatttctttccacacagtgctggttcagttggatgaaaaggagggcttcacagagraagatgagcattcatctcaactttctgaaggataagccaaattcagagaaaggggtaggaacatcagtttttttaaaaaaatcaggtgactagaacaaagaatagataggcaggggaaaaaagctaaagaaccagcaaaaaattagacaaaagagggttcagactgaaaacagcaaaacgcaaggtcaatgagtttgttactggttatcaattgtatctgagtggttttggtctatgaggctgactgatgaacagaaagaaaaatggaaatgggaaaggtattccgttaaaaaaaaaaaa

SEQ ID NO: 69445 - DNA, 601 bp, Human
tcattagtttctgtcttctttcacaattaagaattaatctaggctgggagcagtggctcacacctgtaatcccagcactttgagaggccgaggtgggtggattgctggagcccaggagtttcagaccagcctgggcaacagggcgaaaccccacctctacaaaaaaattagctttgcatggtggtgcatgcctgcagtcctagctactccggaggctgaggtgggaagatcacttgagcctggaggttaaggctgcagtgagctgagattgcatcactgcactccaacctgggcaacaacktgagaccctgtctcaaaaaaaaagaaaaaaaaaaagaaaaggaattaatccatcaaatccatcaagaggccacaagtggactgcttctcttcctaccagaccttatgtttagggtcactgcatgaggagggcaggaaggggaggaaaaggaagaggcccagggctaggaaaatccaccaaatccacatgggagctttgatcattcccttcgaaataacccaactatggcttttaaccttaggaattctcccgttcttcgactggaaggagtaaggatccagagccacaggaacgcttcgt

SEQ ID NO: 69446 - DNA, 601 bp, Human
tcccaaagcatcttcaggaggacgtatgaactctgaaatcttgcaggaacaccacttctaaattgcactacaattctgatgtgcgacccctccagcaaagccatacatcaataaagagctttaattggggagctgggagggagaggcagcactgagaggaaaggaaatggcattcagtggcctggggaggaagtgacatccagcgaagggtaagaaaaggaagggtaggaaaaatgcctagaaaattccaaaacactggaaagagagaggagtagaatatgaaaaaaaaaaaaaaaaaaamcaagaaaaaaaaacttcaatccatcaatggaaaaaagcagtctcagtgttataaaaggactgatctaggctcttttatatgagtacatgcctttactatgtataatatatatggatgtatatctacacataagcctcgattattaacattacaaggtagatagtcagcaagtcacattctatcttgcactcttttacatgcacacagaaaaagcacgttttgtcattagtttctgtcttctttcacaattaagaattaatctaggctgggagcagtggctcacacctgtaatcccagcac

SEQ ID NO: 69447 - DNA, 601 bp, Human
ggctgcttaaatgcttcttcatatatggttagctaagtgcttggcatagtttgtttcagatggacaatgaggggggaaacagagcaaaaatgcacaacagagaatttctgtaccataaacagcctataaaaatgaatattaagaagcatatatacttatggttgtcatatacgatcttctaagtgcaactttttttttccttttggttttcttgcattgccgtcagaagaagaaatgcttcttcgtatatgattagctaagtgcttggcacagtttgtttcagatggctaatggggggggrgaaacagagcaaaaatgcacaaaagagaatttctgtaccacaaacagtctataaaaatgagtattatgaagcatatatacttatggttgtcatatatgatcttataggtgcaattttttttttcttttggttttcttgcattgccaccagaagaaagatggagatctccaaatcccttccgggatgatgtacattgaagctgcttaaataacccagtatctgaaaagctgtcctcttaacattgcattaataacaatataagctcaattttaaatgatgaaatattcaccctccctagtt

SEQ ID NO: 69448 - DNA, 601 bp, Human
gagtggctgcttaaatgcttcttcatatatggttagctaagtgcttggcatagtttgtttcagatggacaatgaggggggaaacagagcaaaaatgcacaacagagaatttctgtaccataaacagcctataaaaatgaatattaagaagcatatatacttatggttgtcatatacgatcttctaagtgcaactttttttttccttttggttttcttgcattgccgtcagaagaagaaatgcttcttcgtatatgattagctaagtgcttggcacagtttgtttcagatggctaatggggsgggagaaacagagcaaaaatgcacaaaagagaatttctgtaccacaaacagtctataaaaatgagtattatgaagcatatatacttatggttgtcatatatgatcttataggtgcaattttttttttcttttggttttcttgcattgccaccagaagaaagatggagatctccaaatcccttccgggatgatgtacattgaagctgcttaaataacccagtatctgaaaagctgtcctcttaacattgcattaataacaatataagctcaattttaaatgatgaaatattcaccctccct

SEQ ID NO: 69449 - DNA, 601 bp, Human
aaagacataacttcaaaagggccatcgaattcacctaccggtcttatttattttttacaggtttttcataagcagtcactcacttctgagtggctgcttaaatgcttcttcatatatggttagctaagtgcttggcatagtttgtttcagatggacaatgaggggggaaacagagcaaaaatgcacaacagagaatttctgtaccataaacagcctataaaaatgaatattaagaagcatatatacttatggttgtcatatacgatcttctaagtgcaactttttttttccttttggtttycttgcattgccgtcagaagaagaaatgcttcttcgtatatgattagctaagtgcttggcacagtttgtttcagatggctaatggggggggagaaacagagcaaaaatgcacaaaagagaatttctgtaccacaaacagtctataaaaatgagtattatgaagcatatatacttatggttgtcatatatgatcttataggtgcaattttttttttcttttggttttcttgcattgccaccagaagaaagatggagatctccaaatcccttccgggatgatgtacattgaagctgcttaaat

SEQ ID NO: 69450 - DNA, 601 bp, Human
tgaatctgggaatggaactcctagcaagggatggcagcggcacattttgtttttctttcaaagcaaagaaagacataacttcaaaagggccatcgaattcacctaccggtcttatttattttttacaggtttttcataagcagtcactcacttctgagtggctgcttaaatgcttcttcatatatggttagctaagtgcttggcatagtttgtttcagatggacaatgaggggggaaacagagcaaaaatgcacaacagagaatttctgtaccataaacagcctataaaaatgaatattamgaagcatatatacttatggttgtcatatacgatcttctaagtgcaactttttttttccttttggttttcttgcattgccgtcagaagaagaaatgcttcttcgtatatgattagctaagtgcttggcacagtttgtttcagatggctaatggggggggagaaacagagcaaaaatgcacaaaagagaatttctgtaccacaaacagtctataaaaatgagtattatgaagcatatatacttatggttgtcatatatgatcttataggtgcaattttttttttcttttggttttcttgcat

SEQ ID NO: 69451 - DNA, 601 bp, Human
aaatttttttaagacccaaaacataaaaagaaattagaaatccatttctgtgcaataatataaaaggaatccctcccctggccttacccggcatgccccttccactctcttcctctccatcctttccgctccactgatactcacccaaggttcaggtgtttgagtttctgaaggctactgatctgtgtgggcagctcctcgatttggttattaaaaaagttgagcacctccaaattcttcagttctgcgatgttcggtggcaccactatggaaacaaaaatgctgagtgtgaatctgggamtggaactcctagcaagggatggcagcggcacattttgtttttctttcaaagcaaagaaagacataacttcaaaagggccatcgaattcacctaccggtcttatttattttttacaggtttttcataagcagtcactcacttctgagtggctgcttaaatgcttcttcatatatggttagctaagtgcttggcatagtttgtttcagatggacaatgaggggggaaacagagcaaaaatgcacaacagagaatttctgtaccataaacagcctataaaaatgaatattaagaagcatatat

SEQ ID NO: 69452 - DNA, 601 bp, Human
atacaatgaaagcactaaaacctgccctccgtacctcacaaatgttgagagggtcaagtgctgcaaagcaatacacaaaaatagattatcattattattatttactgctccctggttctgcaacctcagctgaatcaaaactcctctcttcacctttgcataaagaaagacaggactgtcacctctcagctaaagagaagaattgcataaatgaatgaagcatcattagggaaaatattcttccctccacggcacgaaggtgctttgtaaactattccaatttaacacagagaggaaaaaraaatcagccatattaccacttgtccgccagttcatgctatgcaaataagtcccttctcggtcagcagaactgagataaaattttactggacagaaaatacaataaaaatttaacttccttattgcgccaacaattagcctctcaattagctctcaaatatgcactaatgtaggccactgaaagaatatattaaaacaataaaatttttttaagacccaaaacataaaaagaaattagaaatccatttctgtgcaataatataaaaggaatccctcccctggccttacccggcatgcccct

SEQ ID NO: 69453 - DNA, 601 bp, Human
gttctaccggctgtataggaagcgtggcagcagctgcttgtggggaagtctcagggagcttttactcatggtggaaggcaatgcaggagtatgcttattacatggcaggagcaagacagcacaaggggggaggtgctacgcacttttaaacaaccaggtctcacagtaactcactcgctatcacaaggacagtaccaagaggggatagtgctaaaccattcaggagagctccgcccccaggatccaatcacctcccaccaggccccacctccaacactggggattacaattccacatgagrtttgctggggacacagacccagaccataacaatggggtctgaaggagccttcagacccagaaccatcttcccagcttggccgctaacctcaggggtgaccaggagccaggcccttagcccctttgaaaaggcttggcttcctctgtatacaatgaaagcactaaaacctgccctccgtacctcacaaatgttgagagggtcaagtgctgcaaagcaatacacaaaaatagattatcattattattatttactgctccctggttctgcaacctcagctgaatcaaaactcctctcttcacc

SEQ ID NO: 69454 - DNA, 601 bp, Human
agatgaaattctgatgccgcagttccggttggggtctatggatctatttgtctgttctcccattgctataaaggaatgcctgaggctgggtaacttacaagaaaagaggtttaaccgactcgtggttctaccggctgtataggaagcgtggcagcagctgcttgtggggaagtctcagggagcttttactcatggtggaaggcaatgcaggagtatgcttattacatggcaggagcaagacagcacaaggggggaggtgctacgcacttttaaacaaccaggtctcacagtaactcactcrctatcacaaggacagtaccaagaggggatagtgctaaaccattcaggagagctccgcccccaggatccaatcacctcccaccaggccccacctccaacactggggattacaattccacatgagatttgctggggacacagacccagaccataacaatggggtctgaaggagccttcagacccagaaccatcttcccagcttggccgctaacctcaggggtgaccaggagccaggcccttagcccctttgaaaaggcttggcttcctctgtatacaatgaaagcactaaaacctgccctcc

SEQ ID NO: 69455 - DNA, 601 bp, Human
aaaaaaaccatctcatctcaagcgatgttcctccctccttttaacttcactttccctcagacataagaataaaggctgcccatggatctcataaagttggtccctaagcccaagtgaacttcaaaataatgtgtctgaccaaattccttgtgggagcaataaactaaaaatcactccatgaatgagattttttttcatgactgctccctattatattggcaaatacggccagacgcagtaatcccagcactttgggaggcggaggcagacggacatgaggtcaagagattgagaccatccyggccaacatggtgaaaccccatctctactaaaaatacaaatattagctgggcatggtggcgcacgcctgtagtcccagctactcgggacgctgagggaggagaatcgcttgaacccaggaggcggaggctgcagctagcccagatcgcctggtgacaaagcaagactctgtctcaaaaaaaaaaaacaaaaacaaaaaaacctgggaaatacctggccagcatctattgccactccacgtcaatcactaacttaactagagcatttagtggctacaaatttaatgaacatatgactttgc

SEQ ID NO: 69456 - DNA, 601 bp, Human
cagatgggtatacaggctccaaatttgtagggagaaaaaaaaaaaaaccatctcatctcaagcgatgttcctccctccttttaacttcactttccctcagacataagaataaaggctgcccatggatctcataaagttggtccctaagcccaagtgaacttcaaaataatgtgtctgaccaaattccttgtgggagcaataaactaaaaatcactccatgaatgagattttttttcatgactgctccctattatattggcaaatacggccagacgcagtaatcccagcactttgggaggcrgaggcagacggacatgaggtcaagagattgagaccatcctggccaacatggtgaaaccccatctctactaaaaatacaaatattagctgggcatggtggcgcacgcctgtagtcccagctactcgggacgctgagggaggagaatcgcttgaacccaggaggcggaggctgcagctagcccagatcgcctggtgacaaagcaagactctgtctcaaaaaaaaaaaacaaaaacaaaaaaacctgggaaatacctggccagcatctattgccactccacgtcaatcactaacttaactaga

SEQ ID NO: 69457 - DNA, 601 bp, Human
cctgttggtccacaaccgccagcatatctgtgacctcattggtctgttcctgtttataaccagccttgccccaataggtaaggtcagggaccataaccttcaccttggctccccggtactaggaagattcctgacatagaatagtcacttacatagtcatggaatcaatgaaaacgtaaataagacaattatgatgataacaatagctaactaatactaggtactgctcagtatgtgccaagcactgttcctagtgattgagattttatatatatatatataaaatagatataatgtgtayatatatttcatttaataaatgaacaaattaacagtaagaatatacatctatatgtagttttagcttctttctcacatacaaattaaagatcaggatagaatagcctgtaaaaccaagatataaatggagcatcttttcatttctgctttgccagatgggtatacaggctccaaatttgtagggagaaaaaaaaaaaaaccatctcatctcaagcgatgttcctccctccttttaacttcactttccctcagacataagaataaaggctgcccatggatctcataaagttggtccctaagc

SEQ ID NO: 69458 - DNA, 601 bp, Human
caggggacactacagctgcagaacacaggatccgggaaggtcaaacctgtaacagctaactctggtcaatgacaaatggttctcaaatgatcagcatcgtgtgcctaggtggagagtagttgccaagaagaggacagaggttgttcagaattgctacattaggataattgttattcatgaaacccagaactaagttcattcatcagcaaccttacctagttctgggggcagaacggtgaggcggttcccctgaatgtggagctctttaagctgggtaagctccccgatttccttaggcagygagatcaggtcgttatccctaaggctgagctaaacagaagaaaacaagttgtcaacatatttacacattaaaaggtgctccacagaaactctcatcctctatgtcctctcttctactaaagctcaatcctttccatgtatttacaagtgccggcggataatcaagaaacactatcaggagtagtggtttattcccacaaaacaaaccttactcctgctcaaattgacttgattctacccctacaaggctgcagcagtgaattgattttctaagaatttagataaattacttactatctgc

SEQ ID NO: 69459 - DNA, 601 bp, Human
ccatgttgcacaggctggtctcagactcctgggctcaagctatccgcctgcttcggcctcccaaagtgctgggattacaactgggagccaccgtgcccggcccgagatctctcctttaacaagaagttttttgccttgaaaatgtttgcaaaaagcgtttcttgattctgtcaccctgctcccaaagcaacacgtgactacttgcaactcagtaaagagaagtgttgagttgctcctcagcccttaaaaaatcattaaataatcctctaggtggatttttaacactagcaagagagctaasggaaatggcaagagaggaggcgggacttcccagctggtccacgaaatcacgtgactgccttccctttagactaatatggctgccaacagaactcaaggtgctgataggcgtgctctgtgtctcagtcttcctatgcgtaaccattagccacatgagcctgctcataaccttcctaacgtcctgtcatccaaggtccttgcttcattaattcattcagtcagtgttttctgagcacctactgtacccgagggaacaaatacaaaaatgtccctgccctcctggtgattgcattctaatttc

SEQ ID NO: 69460 - DNA, 601 bp, Human
gaaactgcatttctaggaatcctcttaccagcatatgggtgggaaaaaggacctcaccgtgatcaggaagctggacccagaggagggactgtcaggttcaaatctcacctgactcactagctgtgtccccacagacttgtcagcaaccaactctctctatgcctcagtgtcctcatctttaaaaagtctccttataattcttacgataattataggtgatattgcaggaaaaacatttacagtgccttgcaattccaggccttaatagatactacctattattataatagctgttactgtrttagtagtatactaatcttgactttttaaaaaaaatcaccattcaaaaataaatagtccatttgtcttcatcttgagttttgcttgtgacagtgacttctaaaggtttatcacgtacttacaactgtttgtctataatcaggaaaaactgctatcaggcaaatgttaagattaagcttttctacatacggctcgcaaaaataaagtcatttaaagccttccccctcaattctacacctgaataaaaatatacatgatttgttaatggaaagccttacagaaatgttgaacaaatatgacc

SEQ ID NO: 69461 - DNA, 601 bp, Human
ctatcgccttctcaatgagacacccttaaggcatctcaaatttaagatatctgaggctcaggtcaggatgacctcctctcctcaatccctctcctaatctactcttcctaaaatctttcccagccttccagttgcttagaccaaaaacctcacagttaaccttaactctctcacccctcatctaaactgtcaccaattcctgttagttttgccttggaaacagatccagtatccgaccattacttctaccactaccagtaccatctggatgaagccagcatctactcccaccaggattgcwatgatagtctcctatctctcagactctccacttccacccttgccctctgccctccagcctattttcagcacagcagccaaagaactcctctgaaaaacagtcaggggctacacaccatggctcatgcctgtaatcccagtgcttcaggaggctgaggcaggaggatcactcaagcacaggagtttgagactagcctgggcaatacagcaacaccccatctccacaaaaaactgagaaaaccagtggggcacagtggtgcacgcctgtagtcccagctacttgggaggctgaggcaggagg

SEQ ID NO: 69462 - DNA, 601 bp, Human
ctccagcaatggggagccatctgtggtgtcaaccgaggtggccacagtccctgaatggccacggatgtctgcctgggagtcagcccgacccattaacatcctcgatccttctggcttcagtgtttaggaaccatagtgcttcaggctcaatctttcactctctgcagtcacacacaagggatctcatccaatttgtactcttaaatgtatgctgataatgccccaaactatatatgcagcctagacgtctcttctggactctagattcttataccctatcgccttctcaatgagacacccytaaggcatctcaaatttaagatatctgaggctcaggtcaggatgacctcctctcctcaatccctctcctaatctactcttcctaaaatctttcccagccttccagttgcttagaccaaaaacctcacagttaaccttaactctctcacccctcatctaaactgtcaccaattcctgttagttttgccttggaaacagatccagtatccgaccattacttctaccactaccagtaccatctggatgaagccagcatctactcccaccaggattgcaatgatagtctcctatctctcagact

SEQ ID NO: 69463 - DNA, 601 bp, Human
gttattaccctcattttacatgaggtgtagaagggaggtaaaataacattatctgttctagtccgttttcacgctactcatagagacatacccgagactgggcaatttacaaaagaaaggtttaactggacttatagttccacgaggctggggaggcctcacaatcatggtggaaggcaaggagaagcaagtcacatcttacatgaatggcaggagccacaagagagggcttgtgtaggagacccccatttttaaaaccatgagatcttgtgagacccattcagtatcacaagaacggcacaggaaagacccgcccccatgattcagtcatctcccaccaggtccctcccacaacgcgtgggaattatgggagctaccagatgagatttgggtgaggacacagagccacatcatatcaatatctgaaggtcacagaacaaggcagtgggagagtgaggtttgaacccaagcctagtgatggagagtccagcacttaacctctatcctctactgtttacatttaaaaaacgttttaaacctctggataaaataaatgggaaccagttgacagaatgacagtaacagaagagaagataaacaa

SEQ ID NO: 69464 - DNA, 601 bp, Human
aggctaaattctttaagcagattatccttttaatcctcacaaagacaccaggaggtgggagctgttattaccctcattttacatgaggtgtagaagggaggtaaaataacattatctgttctagtccgttttcacgctactcatagagacatacccgagactgggcaatttacaaaagaaaggtttaactggacttatagttccacgaggctggggaggcctcacaatcatggtggaaggcaaggagaagcaagtcacatcttacatgaatggcaggagccacaagagagggcttgtgtakgagacccccatttttaaaaccatgagatcttgtgagacccattcagtatcacaagaacggcacaggaaagacccgcccccatgattcagtcatctcccaccaggtccctcccacaacgcgtgggaattatgggagctaccagatgagatttgggtgaggacacagagccacatcatatcaatatctgaaggtcacagaacaaggcagtgggagagtgaggtttgaacccaagcctagtgatggagagtccagcacttaacctctatcctctactgtttacatttaaaaaacgttttaaac

SEQ ID NO: 69465 - DNA, 601 bp, Human
tattatgtatttggagtctgcttattctagacatagttaataatcgcactacatcttttcttaaggaaatagttaaaagatttagccaggtgggtggctgattcctgtaatcctaacattttgggaggacaaggtggaaggacggcctcagctcaggagttcgagaccagcctgggcaacgtagggagactcaatctctaaaaaagttaaaaaattagccaggcatggtgatgcatgcctgtggtcccagctacttggaaggctgaggtgcaaggatcacctgggcccagaaggtcaaggytgtagtgagccatgatcatgccactgcaagccagtctgggtgacacagagcaagactctgtctcaaaaaaaaaaaaaagaaagaaagaaaagatttcatataagagctgaactactttgtcgacctccagaagagacttctttttctataatgcttttaattgataataaagatttcaaaagatggatttatatagcatatgttaaacatgaaataaattactaatatgtagacaagtgacaaatgcattatagtgtaggcacacaactgatataacaaatgaagcaattggttcagaac

SEQ ID NO: 69466 - DNA, 601 bp, Human
atataggagatgcctcaaagggagaggctacataaatgtaagatattatatatgtattgaggtgataacaactgtatttagagacatgcctctggaatttaaaaaaaaaaaaaattaaatccggaacgttagcactgccggcatttctcccagggcaaaatacatttagcatcctattaaatcaaaggaagtccactgcacacagtggcaagcttttccagctggtgttaacacagattgatgcacatgttcaatcacgctgaacctgacactgggcttcctgaaatttatactacaaaayggaaacgctttatgtgttgcaacttcccaacccctttaaggcaataactcaccaggcagaaatacaattcacttagcattttaaaaatccatgctgaaaacattttctggggctaaagatttcactgaaatagaatatataaaatggaacttgttaaaaaatatcatgtaggagacttgacgggagtcatttttgattatcagtgaaggccaggggaatcaaaggatatggtatgattttttgtgaagtatggcaaaagaaatattaatgcagaattaaaacgtaggagcatgcaataaa

SEQ ID NO: 69467 - DNA, 601 bp, Human
aaagactctagaggaaacagaaaatctgaagagccttatatcaaaaaactcaattcataattcaaaactttcccacaaagaaaattcaagacccagatggcgtcaataatgaattttttcaaacattcaaaaaagaaaaactatcaaattttactcattttatgagactcgatagtcctgaaacaaaaactatacaaagatactataataccagaagaaaactacaaactaatatccctcatgaacgtggaaaaattttaagtaaaatactaacaaatgaaatccagaaatatataaaaakgaagatacaaaaaataaaagccacatagacatagaaaaggcatttgacacaattcaacatttcatgataaatcattctgcaaacaaaaaatagaagggcatttgtaaaatctgacaagggttacacaaaaaaatcttacagataacataatattctatggtgaatgactggatgctttccccttaagatttaagacaaggatgtctgctcttgccatctatattccacactgtactagaagttgcagccaaagtaattgccaagaaaataaaattaaagacatccagattggaaaggagg

SEQ ID NO: 69468 - DNA, 601 bp, Human
tgggattgctggatcaaatggtatttctggttctagatccttgaggaattgccacactgtcttccagaatggttgaactaatttatactcccaccaagagtgtaaaagtgttcctatttctctacatcctctccagcatctgttgcttcctgactttttaataatcaccattctaactggcgtgagatggtatctcattgtggttttgatttgcaagaaatgtacattttcttccttttttttttttttttttttttgagacagagtctcgctctgtcgcccaggctggagtgcagtggcrcaatctcggctcactgcaagctccggctcccaggttcacgccattctcctgcctcagcctcctgagtagctgggactacacattttctttctttctttcttttgagatggagtttcactcttgttgcccaggccggagtgcaatggtgtgatctcagctcactccacttcctgggttcaagcaattctcctgcctcagcctcccgagtagctgggatcacaggtgtgcaccaccacactcggctaattttgtattttttgttgagatggggtttctccatgttggtcaggctagtcttga

SEQ ID NO: 69469 - DNA, 601 bp, Human
catacatgcacatgtatcttcatagtagaatgaattataatcctttgggtatatacccagtaatgggattgctggatcaaatggtatttctggttctagatccttgaggaattgccacactgtcttccagaatggttgaactaatttatactcccaccaagagtgtaaaagtgttcctatttctctacatcctctccagcatctgttgcttcctgactttttaataatcaccattctaactggcgtgagatggtatctcattgtggttttgatttgcaagaaatgtacattttcttccttttttttttttttttttttttgagacagagtctcgctctgtcgcccaggctggagtgcagtggcgcaatctcggctcactgcaagctccggctcccaggttcacgccattctcctgcctcagcctcctgagtagctgggactacacattttctttctttctttcttttgagatggagtttcactcttgttgcccaggccggagtgcaatggtgtgatctcagctcactccacttcctgggttcaagcaattctcctgcctcagcctcccgagtagctgggatcacaggtgtgcaccaccaca

SEQ ID NO: 69470 - DNA, 601 bp, Human
tgatgggcatttgggttggttctaagtctttgctattgtaaatagtgctgcaataaacatacatgcacatgtatcttcatagtagaatgaattataatcctttgggtatatacccagtaatgggattgctggatcaaatggtatttctggttctagatccttgaggaattgccacactgtcttccagaatggttgaactaatttatactcccaccaagagtgtaaaagtgttcctatttctctacatcctctccagcatctgttgcttcctgactttttaataatcaccattctaactggygtgagatggtatctcattgtggttttgatttgcaagaaatgtacattttcttccttttttttttttttttttttttgagacagagtctcgctctgtcgcccaggctggagtgcagtggcgcaatctcggctcactgcaagctccggctcccaggttcacgccattctcctgcctcagcctcctgagtagctgggactacacattttctttctttctttcttttgagatggagtttcactcttgttgcccaggccggagtgcaatggtgtgatctcagctcactccacttcctgggttcaa

SEQ ID NO: 69471 - DNA, 601 bp, Human
tccctgttgtccctgtgttctcatcattcaactcccacttatgaacgagaacatgtggtgtttggttttctgttcctatgttaggctgctgagaatgatggcttccagcttcatccatgtctctgcaaaggacatgaactcattcttttttatggctgcatagtattccatggtgtatatggaccacattttctttatccagtctatcattgatgggcatttgggttggttctaagtctttgctattgtaaatagtgctgcaataaacatacatgcacatgtatcttcatagtagaatgawttataatcctttgggtatatacccagtaatgggattgctggatcaaatggtatttctggttctagatccttgaggaattgccacactgtcttccagaatggttgaactaatttatactcccaccaagagtgtaaaagtgttcctatttctctacatcctctccagcatctgttgcttcctgactttttaataatcaccattctaactggcgtgagatggtatctcattgtggttttgatttgcaagaaatgtacattttcttccttttttttttttttttttttttgagacagagtctcg

SEQ ID NO: 69472 - DNA, 601 bp, Human
ccgcacatgcattaggtatttgtcctaatgctctccctctccttgccccccaccccccccagcggaccccagggtgtgatgttcccctccctgttgtccctgtgttctcatcattcaactcccacttatgaacgagaacatgtggtgtttggttttctgttcctatgttaggctgctgagaatgatggcttccagcttcatccatgtctctgcaaaggacatgaactcattcttttttatggctgcatagtattccatggtgtatatggaccacattttctttatccagtctatcattgaygggcatttgggttggttctaagtctttgctattgtaaatagtgctgcaataaacatacatgcacatgtatcttcatagtagaatgaattataatcctttgggtatatacccagtaatgggattgctggatcaaatggtatttctggttctagatccttgaggaattgccacactgtcttccagaatggttgaactaatttatactcccaccaagagtgtaaaagtgttcctatttctctacatcctctccagcatctgttgcttcctgactttttaataatcaccattctaactggcgtg

SEQ ID NO: 69473 - DNA, 601 bp, Human
atgaaattacagaatgtgtgagatgctgctaaaacaacggagaaaaacttctaacttgaaatgcttacactaaaaaagaagaggccgggcacggtggctcacgcctgtaatcccagcactttgggaggccaaaacaggcggatcatgatgtcagcagatcgagaccatcctggctaacagagtgaaactccgtctctactaaaaaaaaaatacaaaaaattagctgggcccggtggcagccacctgtagtcccagctactcaggaggctgaggcaggagaatgacgtgaacccaggaggcrgagcatgcagtgagccgagatagcgccactggactctggcctgtgtgaaagagcaagactctgtctcaaaaaaaaagaagaaaaactgaaaatcaatcacgtaagctttcacctaaacaagctagaaaaatcacagccagctgtactcagaagaagaaaagcaaatcattgaaatacaaaacaaagaataaaataactcagtgaaactacaatcagctatttggaccaatcaatcaaaggggggaaaaatggaaaacataaattaacaataaaaatggggacaatacagactaactcaga

SEQ ID NO: 69474 - DNA, 601 bp, Human
aaacaaacaaattctcaatttctaaataacaggccccaggtcttacaaaagaaaatatttgaaactgaatgataatgaaattacagaatgtgtgagatgctgctaaaacaacggagaaaaacttctaacttgaaatgcttacactaaaaaagaagaggccgggcacggtggctcacgcctgtaatcccagcactttgggaggccaaaacaggcggatcatgatgtcagcagatcgagaccatcctggctaacagagtgaaactccgtctctactaaaaaaaaaatacaaaaaattagctgrgcccggtggcagccacctgtagtcccagctactcaggaggctgaggcaggagaatgacgtgaacccaggaggcggagcatgcagtgagccgagatagcgccactggactctggcctgtgtgaaagagcaagactctgtctcaaaaaaaaagaagaaaaactgaaaatcaatcacgtaagctttcacctaaacaagctagaaaaatcacagccagctgtactcagaagaagaaaagcaaatcattgaaatacaaaacaaagaataaaataactcagtgaaactacaatcagctatttggac

SEQ ID NO: 69475 - DNA, 601 bp, Human
aaaggcaaatgataccagatggaagcgcctatctacatcaaggaaagaagagcatcagaaatggtaaatagagaagcggcagtcaatgtgaaaaactttttcctcctctctaaagttatttaagaaaactaacttaaggaaaaaaaaaaacaatattaccgggagttataacatatcaactaatgtaacctaacatttatggaacactgatggggcacataaaacttttaagtgtgcatgtaaaattcaccaactagagaatacgcaggcccataaaacaaatcaacaaattgtgaaggaytagaattatatagactatgaattttgatcaggacataatttaaattagaaatcagtaacaaaatgtttcggatatctccgaatacttgaaaacaaacaaattctcaatttctaaataacaggccccaggtcttacaaaagaaaatatttgaaactgaatgataatgaaattacagaatgtgtgagatgctgctaaaacaacggagaaaaacttctaacttgaaatgcttacactaaaaaagaagaggccgggcacggtggctcacgcctgtaatcccagcactttgggaggccaaaacag

SEQ ID NO: 69476 - DNA, 601 bp, Human
tactacaataaatacaaaagaaaaaattcttcaggataaaggcaaatgataccagatggaagcgcctatctacatcaaggaaagaagagcatcagaaatggtaaatagagaagcggcagtcaatgtgaaaaactttttcctcctctctaaagttatttaagaaaactaacttaaggaaaaaaaaaaacaatattaccgggagttataacatatcaactaatgtaacctaacatttatggaacactgatggggcacataaaacttttaagtgtgcatgtaaaattcaccaactagagaataygcaggcccataaaacaaatcaacaaattgtgaaggactagaattatatagactatgaattttgatcaggacataatttaaattagaaatcagtaacaaaatgtttcggatatctccgaatacttgaaaacaaacaaattctcaatttctaaataacaggccccaggtcttacaaaagaaaatatttgaaactgaatgataatgaaattacagaatgtgtgagatgctgctaaaacaacggagaaaaacttctaacttgaaatgcttacactaaaaaagaagaggccgggcacggtggctc

SEQ ID NO: 69477 - DNA, 601 bp, Human
tcaacctaaaatttcatatcctgaaaaaaaattcctccaaaaactgaaaacaaaataaaaatatttcagataaacaaaagctaattaatgaccaaaaagaactgtactacaataaatacaaaagaaaaaattcttcaggataaaggcaaatgataccagatggaagcgcctatctacatcaaggaaagaagagcatcagaaatggtaaatagagaagcggcagtcaatgtgaaaaactttttcctcctctctaaagttatttaagaaaactaacttaaggaaaaaaaaaaacaatattacygggagttataacatatcaactaatgtaacctaacatttatggaacactgatggggcacataaaacttttaagtgtgcatgtaaaattcaccaactagagaatacgcaggcccataaaacaaatcaacaaattgtgaaggactagaattatatagactatgaattttgatcaggacataatttaaattagaaatcagtaacaaaatgtttcggatatctccgaatacttgaaaacaaacaaattctcaatttctaaataacaggccccaggtcttacaaaagaaaatatttgaaactgaat

SEQ ID NO: 69478 - DNA, 601 bp, Human
tcagccctcttccaacacgactccaattgctaaactgtcggaacacacaaagtgacagatttagtgtttcattggcaatttatataactgactgcaacactgttgtagtgaatcatgatttgtctcacattgcagcacatcaccttttaaatgcaagggggaagaaagccaacacctctttaaagtttaatatgtgaccatctaccactacatcctatgatctgaaagagagcagatcaaatgagtgatgtattgcttttccctttcaatacctataacttcctgcactaggcattcatgmatcctgtgctcacacactcttcttcatctgcatgtgattcagggggaaatctggtagttatacatgaatgacatctataccagtcagtggatggaacctagaataaagggttacaatgatgaatatttggggcgggaattctgcactaaagggcacatgcgtggatatgggggcatcttaaaactctccaaattagatgtaaaatgtcatatgtgaaaatatatattgggggggttatctccataggtttcacttgtttctcaaagatttctgaaaagatgaaaaataatggcttaaggt

SEQ ID NO: 69479 - DNA, 601 bp, Human
actgaggtataaaaagtagctttctgccatttatctccaacgcttttgagagtggttaagataagccgatattgttgggacagggcagagatatttaatcccaggtcccatggtcaagtatatacaatttttcctagacagaatctatggctttcattgacttccttaaggggccaatggacttataaactctgagaaccaactgggctaaatgaggaagtacagtatcagtagcttccaccaaactgatgcctcagtattacccaactagtcacagaagacctaactgaatgaaaagcagttctgatgagtgctcatgggaagtacacaaagggacagagaccatagcctaacaacagtttaaatttatattcaagtcatgaaatgtaatatataccactgctttgcattttctcttaccattgttgattctgctatgtgccagctaaaatctcacctctacttcctgtggactgagtatttatgacccctccaaatccatatgttaaagccctaagtgctaatgtgatggtatttggaagtagggtccttggaagagaattaggtcatgagagtggagcccttataaataggattagtg

SEQ ID NO: 69480 - DNA, 601 bp, Human
aaagcttctactgttaaaagtactgtggcaaatgaaaccccgtctctactaaaaaatacaaaaaattagccgggcgcgggggtgggcgcctgtagtcccagctacttgggagactgaggcaggagaatggcgtgaacccaggaggcggagcttgcagtgagccgagatagcaccactgcactcgagcctgggcgaaagagcgacactccgtctcaaaaaaaaaaaaaaaaatactgtggcaagaaacatatttatactaaccttttctgagttcctgattatttcttgatgatagaattcsaagggagcttactgcaacaaaaggttggaagcttttacggtgcctggcatatactccaaaaatgggtctagaattaacacgctaatttacaatccaacagcaatgcatgaaaatgtctattgcaccaaacctttactatcactttgcattatcatttttaaaatcttcgttaatcgatattctaaaaaatagtaacttgttttaatctgcatttcattgactgctactaaggctgaccagttttttataggcttggtcattgatcttctcttgtgaaatatctgttcttgctcatttttt

SEQ ID NO: 69481 - DNA, 601 bp, Human
ctattcacctccctgtgagtaccatgctattggttttcttctgggtgtggcaggaagtttcagtgaaagagaaagaaaaattaacagataagcccaagtacctggccactcaggctgaaaagggagtggtaggggaactgaaggctagatagtcaaggaaggttaactgtatgctagatggccaaggaaggccaaggaaggtgatcactgatctgcccgcccccgtcttcgctactccttgtaaccacaaaggcatgaaaagatatggagacctctgaagcagtcaaaacataaagatacyatcactctcagaaggctctgcactaggattcagatgggttaggggtttatttttcttttttatggcattgatatcactgtttatgtcaaagattgtttgcaaaaacagctgtgatcatcccgccctctcctctgtaccttccatgcccctggtgtttccttgtacactggctctgggcctaatcaagtgaattgctttggtcaatagagagggcattagcaaatgtgaatgtaacagacttggaaagtgcttgtgtacctgggcttatgtcttagtccatttttgtgttgctataatgga

SEQ ID NO: 69482 - DNA, 601 bp, Human
gcgtatttatctccattagcactttcagctactctgcaacttatttttctaggcctcaaaatactattcataaagcatctatggaagcttttgcctcctgttacacaaagtgagagtagaataatctacttttgtcttggcacagaaaatttgcaatgaaatgcaacacattttaattcttacacaaggctaggaaacattattagtgatattgcaaaaacaaaaatacacttccaattcagacccacaaaatgagcactcttcgattataattctattcacctccctgtgagtaccatgytattggttttcttctgggtgtggcaggaagtttcagtgaaagagaaagaaaaattaacagataagcccaagtacctggccactcaggctgaaaagggagtggtaggggaactgaaggctagatagtcaaggaaggttaactgtatgctagatggccaaggaaggccaaggaaggtgatcactgatctgcccgcccccgtcttcgctactccttgtaaccacaaaggcatgaaaagatatggagacctctgaagcagtcaaaacataaagatactatcactctcagaaggctctgcactag

SEQ ID NO: 69483 - DNA, 601 bp, Human
cataagagaataaatcggtgctgttttcagccactgtttgtgctcattgtttatagcagcaataggaaactaaggcactatgcaaacatatgccgcgtatttatctccattagcactttcagctactctgcaacttatttttctaggcctcaaaatactattcataaagcatctatggaagcttttgcctcctgttacacaaagtgagagtagaataatctacttttgtcttggcacagaaaatttgcaatgaaatgcaacacattttaattcttacacaaggctaggaaacattattagygatattgcaaaaacaaaaatacacttccaattcagacccacaaaatgagcactcttcgattataattctattcacctccctgtgagtaccatgctattggttttcttctgggtgtggcaggaagtttcagtgaaagagaaagaaaaattaacagataagcccaagtacctggccactcaggctgaaaagggagtggtaggggaactgaaggctagatagtcaaggaaggttaactgtatgctagatggccaaggaaggccaaggaaggtgatcactgatctgcccgcccccgtcttcgct

SEQ ID NO: 69484 - DNA, 601 bp, Human
ggagggagaacacacggatgaagatccgaaacaccaccacaaacttaaaaaaattatctacagaaaaactaaaaactggacttcattcaacacccatctggcatctcggagagagaaagaaatcacttagggctccctgtcttcaacaaattgtatctttcaaaactgccagtaaggcagattccaaccctctgaatgagactatttgcaagagatttgggtggttgacattttagtgttatttctggacatgacatctttggttgattacttgggtataaaataatgagcgagtggcccctgtcatttactcctgttacaacagcgaaaagcatgccattgctgctgtcaaaatacgtcataaaagactcatatttcaaaatagtttggtgtcaaaagctattaatcataatatcaatatatagaatgagggaggagagcaaaataaacttcatttctccccaatatgaagaataaaaatcagtcacatatacacctacacccttcatcatacccagacccaaatcccagtggaatcaggatcaggaagtgaggcagaaccctgcagaccagccagctcatccagaagatgacacatagg

SEQ ID NO: 69485 - DNA, 601 bp, Human
cgaactcctgacctcaggtaatttgcctgccttcgcctcccaaagtgctgggattacaggcatgagccaccgggcccagctgagacatgcagttaaacaggaaggaacaaaaacatttctgtatattctccttccctaaaatctactgtgaaagagaaaagaataaaatataataaaatggtttcataaataaatggttattactccaacaccacaaactataatgaacattagctgaatacagggaaactggaccaaaatgagggagggcattagcaatgaacacatggctccttggaaygcaagcatgacacagatttttctccgtcctaaaagaccactgaaatgagccattggctaaagggctaagatctgagtgagaacatactaaaagaaaaggggcagcagtgggtatccccagagaaaccctgctaacagcacgtggcagaagaggagcagaagggggaatcacgaacagtgactttactgtccgagaaggaggtgacaggaacgagggaggggacatagtgctcactcatcaacccactgacagcctctatttcactgccagtcccaaagtggggaatgactcaaaagtgac

SEQ ID NO: 69486 - DNA, 601 bp, Human
ggggtatcaggtgagaggtctagctaggttggggatatggagttagaactcatgagtgaagaaatccaaaattaaagttaaggatattatgggtctacatagcatttacagaagggccaaatagacaatattccagacaatagaggttagagaaaagcaagctatctgtcttaagagcacactttttatataactcaaactacatatgtgtatatctgtatatatgtgtatgtgtgtgtctatatacatatatacacatatatacatgtatacagccacatatatgtatatatacacacayatatacatatatgtatatatacacacatatacatatatgtatatatacacacatatacatatatgtatatatacacacatatacatatatgtatatatacacacatatacatatatgtatatatacacacatatacatatatgcatatagacacaaacatacacacatatatgtatatgtatatagacatacatacacacatatatatcatgtgatatatatatatacacacatatatcatacgatttgctgtattagttggcacataatttgagctgggagagcaaagtccatcgcaat

SEQ ID NO: 69487 - DNA, 601 bp, Human
tcaggcctgttacaatgtgaggtgcctctggaacatgaaagtgaaaatatccaccaagcaataagatttatcatctggggtatcaggtgagaggtctagctaggttggggatatggagttagaactcatgagtgaagaaatccaaaattaaagttaaggatattatgggtctacatagcatttacagaagggccaaatagacaatattccagacaatagaggttagagaaaagcaagctatctgtcttaagagcacactttttatataactcaaactacatatgtgtatatctgtatataygtgtatgtgtgtgtctatatacatatatacacatatatacatgtatacagccacatatatgtatatatacacacatatatacatatatgtatatatacacacatatacatatatgtatatatacacacatatacatatatgtatatatacacacatatacatatatgtatatatacacacatatacatatatgtatatatacacacatatacatatatgcatatagacacaaacatacacacatatatgtatatgtatatagacatacatacacacatatatatcatgtgatatatatat

SEQ ID NO: 69488 - DNA, 601 bp, Human
tttataaattaaactttatcaaaggtatgcatgtatcagaaaaacagagtactgtttttctagggttcagtactatctgcaggttcaggcatccactgggggtcttggaacatatcccacactaatgaggtgggaatattgtttaagaaaacagatgaaaagtaagaacctctgatccaggaaaaggatttgatgaagcatgggagctgacacccaggcttctagctggtggatgtatgaatggtggtgtcatcgacctaagcacagaattcaagaggagtggaggagcccaacctcaggyctgttacaatgtgaggtgcctctggaacatgaaagtgaaaatatccaccaagcaataagatttatcatctggggtatcaggtgagaggtctagctaggttggggatatggagttagaactcatgagtgaagaaatccaaaattaaagttaaggatattatgggtctacatagcatttacagaagggccaaatagacaatattccagacaatagaggttagagaaaagcaagctatctgtcttaagagcacactttttatataactcaaactacatatgtgtatatctgtatatatgtgta

SEQ ID NO: 69489 - DNA, 601 bp, Human
ttcactttcctggttttagtcactcatggtccaaaaatagttgagtccagtatgaagagatattttgagagagagatactacattcacatagcttttattacagtatattgttataactgatctatttgattattattgttaatctcttactgtgcctgatttataaattaaactttatcaaaggtatgcatgtatcagaaaaacagagtactgtttttctagggttcagtactatctgcaggttcaggcatccactgggggtcttggaacatatcccacactaatgaggtgggaatattrtttaagaaaacagatgaaaagtaagaacctctgatccaggaaaaggatttgatgaagcatgggagctgacacccaggcttctagctggtggatgtatgaatggtggtgtcatcgacctaagcacagaattcaagaggagtggaggagcccaacctcaggcctgttacaatgtgaggtgcctctggaacatgaaagtgaaaatatccaccaagcaataagatttatcatctggggtatcaggtgagaggtctagctaggttggggatatggagttagaactcatgagtgaagaaatccaaa

SEQ ID NO: 69490 - DNA, 601 bp, Human
gctcattctcttgcattgcaataggcttttctgagtgggacagacgtgggtggcaaatcacttgataactgcaatggaaaatcgacgccctggtattccttctccatttccatacattgccattagaatcccagatgtactagcaatatgaacttggacaagttcatatttaccctctctgcatctcagttgcctcatctaaaaataaggattataagtgcttaccttactaagggattaaaacatcaatgtaaagctgttagaacaaagccggctacatagcaagtacaagagaaatttktattattaattactaccgtgactattgctactgccactgtactatcatagtagttctctcttatccgtggtttcactttcctggttttagtcactcatggtccaaaaatagttgagtccagtatgaagagatattttgagagagagatactacattcacatagcttttattacagtatattgttataactgatctatttgattattattgttaatctcttactgtgcctgatttataaattaaactttatcaaaggtatgcatgtatcagaaaaacagagtactgtttttctagggttca

SEQ ID NO: 69491 - DNA, 601 bp, Human
gttgagtgacttataaaatgttcttcacaaattagactagatccaagatcaaccctttaatggtatcacgctcattctcttgcattgcaataggcttttctgagtgggacagacgtgggtggcaaatcacttgataactgcaatggaaaatcgacgccctggtattccttctccatttccatacattgccattagaatcccagatgtactagcaatatgaacttggacaagttcatatttaccctctctgcatctcagttgcctcatctaaaaataaggattataagtgcttaccttactragggattaaaacatcaatgtaaagctgttagaacaaagccggctacatagcaagtacaagagaaatttttattattaattactaccgtgactattgctactgccactgtactatcatagtagttctctcttatccgtggtttcactttcctggttttagtcactcatggtccaaaaatagttgagtccagtatgaagagatattttgagagagagatactacattcacatagcttttattacagtatattgttataactgatctatttgattattattgttaatctcttactgtgcctga

SEQ ID NO: 69492 - DNA, 601 bp, Human
aaccagatcatagtgaatacagcagagtctccaatatctctggaggcggaaagcaaaaaccacaatgcaaacagggaagcaggggagatgagtccagagaggcaggcaggggctgcaccatgagctgcctttctggctgggctaaggagctccagctttacctggacacaccaagaaataatacaagggtgacagcatgaaagccacaaggtccaactgcttccaatagaacacttgagccattctgtacagagcaacagtcattgccaaacacaggcttcctggcatgtggctgggaggyctaagccacttccccagcgatttgttactcatgatggttgagtgacttataaaatgttcttcacaaattagactagatccaagatcaaccctttaatggtatcacgctcattctcttgcattgcaataggcttttctgagtgggacagacgtgggtggcaaatcacttgataactgcaatggaaaatcgacgccctggtattccttctccatttccatacattgccattagaatcccagatgtactagcaatatgaacttggacaagttcatatttaccctctctgcatctcagttgcct

SEQ ID NO: 69493 - DNA, 601 bp, Human
caaacccccatccagctatcacatggttcttagcagttatttcatatgccactggattcatctgttagggctgccatgacagcctgggcaccatggcgaaaccccacgtctacaaaaaatacagtcattagctgggcatggtggtgcactcctgtgggcccaactgcttgggaggctgaggtgggaggatcacctgagccctgagagtttgaggctgcagtgagctgagactgcaccactgcactccagcctggacaactgaacaagaccctatctcacataaataaataaataaacaaayaaataaataaataaatagagtatctggttctggttcatcaaagtacattttcattcacaaacattccattagtacagtttgtgtcatgaagataaataacttgtccgtcaggtgctcttggtctagtggttcatatggatactgaagaaagagctcatgagaacaccacaggctcttgacccagtgtagagagaacagtgaagaggctcggaatgactttctggaggagatgcttaaccagatcatagtgaatacagcagagtctccaatatctctggaggcggaaagcaaaaaccacaa

SEQ ID NO: 69494 - DNA, 601 bp, Human
gtcactacatcatgacagatagtggcagaattacttagataatctctgaatattttacagcaaaaaacaacatgtataatattaacaataatatttagggaagaactctaattttatagttaaactcagggtaaacagaaaatcctcttaaattcttgttcaacattttctcatgcgctagagtttctcatataaataagtatcctacacagaatacataaataagtatactactcttaaggaatgcaacaccctctttcacacatgtggatgtcttgtgtgtatgtgcatatgtgcacasacaaacccccatccagctatcacatggttcttagcagttatttcatatgccactggattcatctgttagggctgccatgacagcctgggcaccatggcgaaaccccacgtctacaaaaaatacagtcattagctgggcatggtggtgcactcctgtgggcccaactgcttgggaggctgaggtgggaggatcacctgagccctgagagtttgaggctgcagtgagctgagactgcaccactgcactccagcctggacaactgaacaagaccctatctcacataaataaataaataaacaa

SEQ ID NO: 69495 - DNA, 601 bp, Human
caactggctgattatccctaaaccagtacctaaccatagttatgacagaaaacatagagtttattacataaaatattctggatagcaatgaacatctatatctcagaaataattctacaaatatacatattgaacagaaataaattatcaaatagaaattaaatgtccaacagaaatgcacatagtcactacatcatgacagatagtggcagaattacttagataatctctgaatattttacagcaaaaaacaacatgtataatattaacaataatatttagggaagaactctaattttayagttaaactcagggtaaacagaaaatcctcttaaattcttgttcaacattttctcatgcgctagagtttctcatataaataagtatcctacacagaatacataaataagtatactactcttaaggaatgcaacaccctctttcacacatgtggatgtcttgtgtgtatgtgcatatgtgcacagacaaacccccatccagctatcacatggttcttagcagttatttcatatgccactggattcatctgttagggctgccatgacagcctgggcaccatggcgaaaccccacgtctacaa

SEQ ID NO: 69496 - DNA, 601 bp, Human
tagcccacatgctttatgtatataatctcagccctcaaaggaacctgcaaattgaggtgctttgcagccaaggaaaatgtggtgcaaggattaactcatctcccaaaggtcacagggtcaatacacagtaaggctgggattcaaaccagggtctgttccttcctatgtggcacaatcacatgtctgaagggacatttgctttccttcccgcaactctttccaatctttcctttttccccgtctcttccctttaaagaaacatgacagtggcaatggcaaataaatcttgatgttctttggrgtcaaggcaactggctgattatccctaaaccagtacctaaccatagttatgacagaaaacatagagtttattacataaaatattctggatagcaatgaacatctatatctcagaaataattctacaaatatacatattgaacagaaataaattatcaaatagaaattaaatgtccaacagaaatgcacatagtcactacatcatgacagatagtggcagaattacttagataatctctgaatattttacagcaaaaaacaacatgtataatattaacaataatatttagggaagaactct

SEQ ID NO: 69497 - DNA, 601 bp, Human
gtgggtgccagggccagggcataaatgttcaactgagtgtagcaggactacgatgttctgtgggaggcttggagctcttggagttgaggtgttatattttaatctatctttatttttaagagtagaaacgtctacactattgcagagaaaaagccatgactcacttttcacaatgtacatggctgatcctaagcagttctgagagccctcacatatttctgcaagtttgaaaatgctgctttctctgggaagtcgggtagggaatgagaggcaaaggggatatgccctcctgatccctgcyacctccttccatacatgatatgagcaccaaaagaccacactcatcaggtgagataagaagactccaggggactgcctcttcaggaggcactgataagcgtatttcaacctttgatctataaccacgtatacaaatacactattgataacattacttagaaaaggagtctgaccatgatctagatgcctgtacaactaaagagccctttcagagaagtttggagggtatgaagcgttattaaattttaatttctaaaatatgtaataggaggaaatgacttcttagataccttcataggag

SEQ ID NO: 69498 - DNA, 601 bp, Human
caactctcattggccatattgctctgggttgccttttcattgtgttgatgttgtcttttgatgcacaaaattcttaaattttcatgaagtccaatttgcctattttttcttttgttgtctgtgcctttggtgtcatagccaagaagtcatcttaaagtccaacgtcttgaagattttatcctacaatttcccctaaaatttttatagttgtagttcttacatttaggttttttattcattttgagttaattcttctatatgttattaggcaagggtccaacttcattcttttgcatatgcytatgtagtttttcacttcatcatttcttaacaagactgtcttttccccattgagtggtttgggcacacttgtcaaaaaatcacttgaccatttaggcaaggatttatttctggggtctctattctattccattggtcaatatatctgcctttaggccagtaccacactgttttgactactggaactgtagcaagtttgaaatcaggaattgttaaatccttcagttttgttctttctcaaggttgttttgactacttgaggtctgttgcaattccatatgaactttagggtgggattttc

SEQ ID NO: 69499 - DNA, 601 bp, Human
tttccccataaacagcaccccatgactgccaagtctccactgggggagactgtggcagaggcaggatgcctcgctcacctgtccatggtgctgtcctggccttccatgcaccacaggaagtttgctgctcccctagtgcggtccagcatacttcctcgtcactctagttgaaatatagttgtttacttgttgtttagatccccttttgggggagggatgagcactaggcaactctcattggccatattgctctgggttgccttttcattgtgttgatgttgtcttttgatgcacaaaattyttaaattttcatgaagtccaatttgcctattttttcttttgttgtctgtgcctttggtgtcatagccaagaagtcatcttaaagtccaacgtcttgaagattttatcctacaatttcccctaaaatttttatagttgtagttcttacatttaggttttttattcattttgagttaattcttctatatgttattaggcaagggtccaacttcattcttttgcatatgcctatgtagtttttcacttcatcatttcttaacaagactgtcttttccccattgagtggtttgggcacacttgt

SEQ ID NO: 69500 - DNA, 601 bp, Human
cacattttctctatccaggaaagactttttataactaattgtctcactagttattagtctgttcagatctttaatttctttataattgaatctcagtagtttgtatatgtccaagaacttatctatttcttccatattatcaaatttgttggcatatagcagctcataatattctctataattttctgtatttctgtagtatcagttgtaacatctccttttccatctctgattttacttgagtcttgttttttttagtctagcttaaagtttgttgattttgcttatcttttcaaaaaaaccaactcttcgttttcttgatcttttgaatgttaatttgtctttatttcttctctgagccttattctacctttccttctatcaattttgggttcagtttgttcttgtttttctagttccttgtggtacgtcattaggttgttcattaaaaatctctcttcttttctaatgtagctgtgtattgctataaaattccctgttagaactgctctctcgctgtgtctcacaggttttggtaagatgtgtttgcattcttgtttgtctcaaagcaatttttcatttctctgttaatttaattgac

SEQ ID NO: 69501 - DNA, 601 bp, Human
cttccataactaatttgttgagtttttatgaaagaatgttgaaggatgtcaaatgctttttctgcatctactgaaatgatcatattgtttttgtctctttttgttaatgtgatgtattacacttattgacttgcatacgttaaactacccttgcaacactggtatgagtaatacttgatcacagtgaatgatctttttaatgtgctgctggattcagtttgttaatatcttattaagaatttctgcatctatgttcacattacagatacttacctgtagttttgctgttgttgttgtatcrttgtctggtttcaggatcagggtaatgctggcctcataaaattttacaaatactccccacttatcaattttctggaatagtttgaggagaactgttattagttcttcttcaaatgttttgtagaattcagtagtgaagccatcaggtcctaagcttttctttgatgaaacattttttttaaatttttttattttttattatactttaagttctgggatatatgtgcagaaagtgcaggtttgttacataggtatacatgtgtcatggtggtttgctgaacccatcaacccatcatctaca

SEQ ID NO: 69502 - DNA, 601 bp, Human
gaagacaaagtagcttgccatttatttgtgtcctcttcaatttcttttgttaaagttttagagtttcaatatagagagctttcaatttggttttgtttctattatctttttttttttaagctatcgtaaatggagctgttttcttgatttctttttcagatagttaatgaaccaatattaataatggttaatatatagaaagactactgattcttgtatgctgattttgtatcccataactactgaattcatttattagttctaccagttctttagtagagtcctttggttttttttttttaattatactttaagttttagggtacatgtgcacaatgtgcaggttacatatgtatacatgtgccatgctggtgtgttacacccattaactcgtcatttagcattagatgtatctcctaatgctatccctccccccttcccccaccccacaacaggccccagagtgtgatgttccccttcccgtgtccatgtgttctcattgttcaattcccatctatgagtgagaacatgaggtgtttggttttttgtccttgcgatagtttactgagaatgatgatttccaatttcatccatgtaccta

SEQ ID NO: 69503 - DNA, 601 bp, Human
cccactggccaacatctctgcacccttccatctcttcccgcccctcccagtctctggtaaccactattctacttcctgtttcaaggataccaactctgtttttgttgttgttaagaaaaaaagatctcatatgagtgggatcatgtgttatgtgtctttctgtgtctggattatttcacaaaacatgacttctttcaggttcatccaattgtggcaaatgagaagatttcatactttcatggctgaataatattccattatgtatatatacattttctgtattcattcttgcattaatggrcacttaggttgattacgtatcttagttattgtaaacagtgctgcaataaacatgggagttgaagttttctcttcaacatagtaatttcttttggatatatacctagtaatggaatggctggattgtatggtagtcctatttttaattttttgaaggatctccatactcttttccataatggttaatttacaatcccaccaacaatgtgtttccctttctccacatccttgccaacccttattttctctttttaacaatagccatgctaactggagtgaggtggtattttatcgtggttct

SEQ ID NO: 69504 - DNA, 601 bp, Human
aaaattttaattgacacagtggaattatacatacttatgggggtacaatttgatgttttgatacctatctatgctatataattatccaatctgggtggctagtattcatcacctcatgcacgtatttctttgtggtgggaacatttgaaagcctctcttctagctgtttcctaatatacaatatttcactgttaattacagtcactctactgtgtaacagaacatcaaaatttattcctactgtctaaatgtaactatgtacccactggccaacatctctgcacccttccatctcttccckcccctcccagtctctggtaaccactattctacttcctgtttcaaggataccaactctgtttttgttgttgttaagaaaaaaagatctcatatgagtgggatcatgtgttatgtgtctttctgtgtctggattatttcacaaaacatgacttctttcaggttcatccaattgtggcaaatgagaagatttcatactttcatggctgaataatattccattatgtatatatacattttctgtattcattcttgcattaatgggcacttaggttgattacgtatcttagttattgtaaacagt

SEQ ID NO: 69505 - DNA, 601 bp, Human
agagatgctgtctctgttgcacaggctggtggtggacttcttggctcaagcaatcctcctacctcagtctcctgagtagctgggattataggcacacaccaccacacccagcccaaatgtttttgatctgtggttggttgaatccatgaatgcagactctgtggatacgaagggccaaatgtaaacaccatattttgcttatccattcatctgttgatgtacacgtgtgctgcattcacattttagctactgtgaacaatgctgctataaatatggctgtacacatatctttttgagaccrttttcaattatttcgggaatatactcagaagtgaaactgctgggtcgtatggtagttttaatttttcgagaaactgtcatacaattttccatttccaccaacagtgctcaagggttcccaacctcatctttttaatacttgtaaattttttatagtaaccaccctaatggatatgaaattatatagcattgtagttttcacttgcacttccgtaatgactagagatgttgaacattttttcatgtgcttattggccatttatgtaccttccttgggaaaaagttattcaagtcccttgcc

SEQ ID NO: 69506 - DNA, 601 bp, Human
tacatgacacttaacagattttctccctcctttcaaaaggtattgaatattgttggtataatcaataatgtgagatgatttaggagcactggggagttatacacaaaaacaagtcactcacctccctcacagggcccagaattctgtcatcagaatcattccctttgggctgaaagccctattacctgcagaaattttatttttaaattaaaacaccctagtggggtaatgcattaggtgaatacactttcttttctttttgattagtttttttggttctactttaaattggttatttttwaaaaaataaaatactctgcttttgttagttgactggttaatttttcccccactttttatttgcattaaaatacacataggataaaatttatcattttcatgatttttaagggtatggtttggtgatattaatacatttgtaattttgtgcaaacaccactgtaccatctgcctccatgactttttttcatcttgtaaaaccttaattctaaaaccatgcaacaataactccccatttctcctttcccttatctcttggcaaccaccattccgcttatctctgtgattttgactgttctaa

SEQ ID NO: 69507 - DNA, 601 bp, Human
taataatattggtttttatttgttatacatgtaccatgtaccaggtgtcatttcaggagctttgcatacattattccagggtgtcacaataatcttgcatggaaggcattattatgatctcatcttaaaattaagaagcagcaactaccattttgggggtttaggattcatactcaaggtcatgtgactagtaggcagccaggcaggtatttaaaaaccaatttatctggctctttcagaggccttggtctttccagtacatgacacttaacagattttctccctcctttcaaaaggtatkgaatattgttggtataatcaataatgtgagatgatttaggagcactggggagttatacacaaaaacaagtcactcacctccctcacagggcccagaattctgtcatcagaatcattccctttgggctgaaagccctattacctgcagaaattttatttttaaattaaaacaccctagtggggtaatgcattaggtgaatacactttcttttctttttgattagtttttttggttctactttaaattggttatttttaaaaaaataaaatactctgcttttgttagttgactggttaattt

SEQ ID NO: 69508 - DNA, 601 bp, Human
tttctttctgtacatcatcaacgcaatgtaagctgggatgtctcatgacagctctcaaatttattctgtggggaacgcaaggccacactgtcattccggcaactgtctgcttggcctttccagcaacacatttttaaaagaggcattctgtacatttaatgcatgcattgcattgctgctttaagatacatactaaaataaacggctactcttcggatctagtcggggaagatagtacaacttacacacacacacacacacaaaaagatttaaaaagagaaaaccaccaccctaccaaatrgttccaacacaagcagcacctgatttaagtgtgtgctggtgtgaagaggcccagaagtccttatgccaatgaagaaaaatagcattttacattgcttccatctgatgctcttcttggccatttgatatctgtggtccaggttaagaagggatagaagaagctctcagttgcttataaatataattaaccagcaacagaacagtgccatcctcaacagtcacctccaaggttgccttatgttgcaagttgaaatggctgttaagtaaataatttatgttttaaacctggcattcatttagg

SEQ ID NO: 69509 - DNA, 601 bp, Human
aattaaggtagggcaggaggttgaactggcagagcaaaggataaacattaattaccgatttggagaattccatgttaacagtatggattattctcataattaaaaaagattaaagtacattgaaagggaatggtcaaaaacaaattaaaagcacatggtgcacactaattggtacaaaacagtatcctttaatttaagtatagcctattgcagtgaacatcacgcttgtggcccattctcttctgtctgcgtaatagatgacggtctaaaaacctaagtggaatgagaatctaggtctgargttgcttttctttctgtacatcatcaacgcaatgtaagctgggatgtctcatgacagctctcaaatttattctgtggggaacgcaaggccacactgtcattccggcaactgtctgcttggcctttccagcaacacatttttaaaagaggcattctgtacatttaatgcatgcattgcattgctgctttaagatacatactaaaataaacggctactcttcggatctagtcggggaagatagtacaacttacacacacacacacacacaaaaagatttaaaaagagaaaaccaccacccta

SEQ ID NO: 69510 - DNA, 601 bp, Human
acacagcctcttgttaacttattaacagcatcttactaagtgtgcagtcttttcagtggtaatcctctgaaaataatgtactaaagttctatgctccctgactgccactcatggaaggagaataatgccaagaaaggtcagccatgttctctgggcccttttgtctgaagcctgtaaccccctggagatctgtcaatcccaagtgatgtctctatttaggtgctgtcagtggagacggcagaggcatcacagattgctaatgatggctgctaactggagcacacaggagacgctggatgcragctagacatactcccttaagggaaaaggagtcacacgctgatgtctacaagtcagagttaacagaaaggaccacaggctattcacgatcatcttcacttatatcacttccaacccatctgcatattttagctgggatggggagtggcaaggagggtacagatgactgggttaccctccccaccctcatttacttacttcagtatcaagcaatgctactaaattaaatccccaagtgcttcctaaagctacatgaacttaagagcctaatagaaaagaatgattagggttccctggggaa

SEQ ID NO: 69511 - DNA, 601 bp, Human
ggagttccagaccacaaggcaatttggccaacatggcaaaacccagtctctgctaaaaatacaaaaattagccaggcacagtggtgcgcacctgtagtcccagcctcttgggaggctgaggcaggagaactgcatgaacctgggaggcggaggttgcagtgagccgaaatggcaccactgcactccagcctgggtaacagagcaagactgtcttaaaaaaaaaaaaagaaaaagaaaaaatatgtgtattgcaaagtagatgaaaaaaaagcagcagaagccatgaaaagtataaactacrtatttatggaatagcacagaaatgaattcctaagctaaggggattttctagttagtgagtattttcccctaaatatctttccttcttctgcaaaattggttatcctaatgagaaatatagtcggaacttctagttggtagaattttactctgttgaagaagcgtccaggattttcaatcatttacacaactgctttgcttttaacatctggttcagaggggtgattgcaggaacacaccttttttttttttttttttttttttttttttttactttgggaagagggagaagaggagggaa

SEQ ID NO: 69512 - DNA, 601 bp, Human
cagtgaccacggtgcagcaatgccctcatcagctgggaatggtagtgctgcagctcaatatatctctcttaaaacattcacctgagaaacaacctatgcttacatcttgtcatcttcatgcctctaatctctgcccacagacatcagcatgaatcaactatgaaaaaaataaacttgaggtgtttggaaaaaatatgtgtattcttggccaggagtggtggctgatgcctataatgccagcactttgggaggccaaggcgggtggatcacttgaggtcaggagttccagaccacaaggcartttggccaacatggcaaaacccagtctctgctaaaaatacaaaaattagccaggcacagtggtgcgcacctgtagtcccagcctcttgggaggctgaggcaggagaactgcatgaacctgggaggcggaggttgcagtgagccgaaatggcaccactgcactccagcctgggtaacagagcaagactgtcttaaaaaaaaaaaaagaaaaagaaaaaatatgtgtattgcaaagtagatgaaaaaaaagcagcagaagccatgaaaagtataaactacatatttatggaatagcacagaa

SEQ ID NO: 69513 - DNA, 601 bp, Human
ccacacctggccgacatgcagtttttaataaaacatcttaaaatgctaagtgctaactgccatcaataggatactgtcacataatatttttaaaggcgtaattataaatactataaaatcacagtctactatttcagaaaatcagagtctacttactatttgtatgtctcagaacggatatactcaaaaacatgggacacgccaagctggaactggtctgcaatgggggtcacccagggattgttctctgctttgaatacctgcttctggccagttaaatccaagtttcctggggggggggaaaaaaaaagtgaaggtcacttcatccaatacagatcaggtctaagaagtccttctcagtaatcacagcctaagtaccctaaatcaaaccctaagtgcctcttggatcatttgatgtcttttaaatttcttaacccaagtcatcacaggtacacagtcatgacagtaccttggccccagaaattaagaacaaaggaaggaagaaagaagacagatggaaaaggaaagcagagcagagggaaggaggtatttgctgcagagacaaaaatgacttgttcaaaattaagagaagtgataatat

SEQ ID NO: 69514 - DNA, 601 bp, Human
atgtcctgggctcaagtgatcctcccaactcagcctccagaatagctacaatgacaagcatgcactaccatgcctggataatttctttttctttttcttttgtagagacggggtcttgctatgttgcccaggctggtctcaaactcctgggctcaagcaatcctctagtctcgacttccccaaatgctaggattacagctgtgagccacaccacacctggccgacatgcagtttttaataaaacatcttaaaatgctaagtgctaactgccatcaataggatactgtcacataatatttttaaaggcgtaattataaatactataaaatcacagtctactatttcagaaaatcagagtctacttactatttgtatgtctcagaacggatatactcaaaaacatgggacacgccaagctggaactggtctgcaatgggggtcacccagggattgttctctgctttgaatacctgcttctggccagttaaatccaagtttcctggggggggggaaaaaaaaagtgaaggtcacttcatccaatacagatcaggtctaagaagtccttctcagtaatcacagcctaagtaccctaaatcaaacc

SEQ ID NO: 69515 - DNA, 601 bp, Human
tagactcctttcacctggagtgaggacttgaggtatttggatgctgtgactttaagctggcagattccgcttcctctcctgccttccccttttctctaagagattatcatctcactacagtacaagcttctctataatagaatgacgcattgctagtactctctactgattttataaataaactgcttaacaattttgttcagaacacttgtaattctttgcattcacagaagaaaaaaaatatgttctgatctgaatggtgaatttccttagtgccatgaatattcaactaatttaatamctcaaaaattctctaaagaaaatcagtaaaaatccccttgaaaatatcaataaaaaacaatttacaaatagagacaatgaccacatgctgttttttcttgtttttttcttttgagaaagggtcgtgctctctcatccaggctcgagtgcagggcatgaccacgactctgtgcagcctcaatgtcctgggctcaagtgatcctcccaactcagcctccagaatagctacaatgacaagcatgcactaccatgcctggataatttctttttctttttcttttgtagagacggggtcttgcta

SEQ ID NO: 69516 - DNA, 601 bp, Human
gtagctgggattacaggcacccaccaccacactcggctaatttttgtattttgagtagaaatggggtttcaccatgttggaaaggctggtcttgaactcctggcctcaagtgattcaccctcctcatggtgaatcaccccacaattcaccccaaagtgctgggatcataggcgtgagccaccgcacccagcctactgaaactttttaatgttgacttaactgcataaaaggtaatccaaggctccatgaggaaatgaaacagaaaaagttagcagacacattgcttagactacgccaaccscccaaaataggatgctaataacagacataaaaacagatataccaattatgttatagatacctctcatttatccagaatcctaaccacattcaaatcagttaaaatagtctgtaacagtgcagaatggtgattaattgcctaataattactttgaggtaatacaaaatccagaaactcacaatttaatcttttaaaattaaaagcactttcatatgcaatgtattctcatcctctataaattataaagtgatctatggaaaactaaaaattgttaaccagaataataaacagagaatttcc

SEQ ID NO: 69517 - DNA, 601 bp, Human
aagtagctgggattacaggcacccaccaccacactcggctaatttttgtattttgagtagaaatggggtttcaccatgttggaaaggctggtcttgaactcctggcctcaagtgattcaccctcctcatggtgaatcaccccacaattcaccccaaagtgctgggatcataggcgtgagccaccgcacccagcctactgaaactttttaatgttgacttaactgcataaaaggtaatccaaggctccatgaggaaatgaaacagaaaaagttagcagacacattgcttagactacgccaaycccccaaaataggatgctaataacagacataaaaacagatataccaattatgttatagatacctctcatttatccagaatcctaaccacattcaaatcagttaaaatagtctgtaacagtgcagaatggtgattaattgcctaataattactttgaggtaatacaaaatccagaaactcacaatttaatcttttaaaattaaaagcactttcatatgcaatgtattctcatcctctataaattataaagtgatctatggaaaactaaaaattgttaaccagaataataaacagagaattt

SEQ ID NO: 69518 - DNA, 601 bp, Human
ttttttttttttttttgtttgaaacacagtttcactatgtcacccaggctggagtgcagtggcgccatctatctcaactcactgcaacctccacctctcaggttcaagcgattctcctgcctcagcctcccaagtagctgggattacaggcacccaccaccacactcggctaatttttgtattttgagtagaaatggggtttcaccatgttggaaaggctggtcttgaactcctggcctcaagtgattcaccctcctcatggtgaatcaccccacaattcaccccaaagtgctgggatcayaggcgtgagccaccgcacccagcctactgaaactttttaatgttgacttaactgcataaaaggtaatccaaggctccatgaggaaatgaaacagaaaaagttagcagacacattgcttagactacgccaaccccccaaaataggatgctaataacagacataaaaacagatataccaattatgttatagatacctctcatttatccagaatcctaaccacattcaaatcagttaaaatagtctgtaacagtgcagaatggtgattaattgcctaataattactttgaggtaatacaaaat

SEQ ID NO: 69519 - DNA, 601 bp, Human
ctgtgagtgatgccatgctggaaatgaggctttaggactgccatgcttggcaaattgcagttttcatgatgacgcctgtttgccaaatacctctttcaagggaagcatttccagcctaacatttgtcaaacctcttttgttaacttgttgacaagagttaacttgtcagcttttaaaatggcttgcagttggtatccacgttccttgatggaaatgtgcaaagtgtgagttaccccctttcacaaagaatcttgtcaagggtgctgacttcaacttgactgcctctcctgggggaaaaaaatctaccttctggaaacttaagtgatgagtattccatcataattctgcttcaaagaaataaaagaggtcgaagagacaaccaccatcaaataaagagttaacaggtaattgtataactcagcgacagtttaaaaacacagtggagcatgtaggatgtaagcttcaacgacccaaccaagctcataatttcatgttaaccggcaactcagtgacatcagccaacaagttcccctgtggaaggcacgaaagatgaagagacagcagcttccacctgagacatgatgaaggggccgtgattaat

SEQ ID NO: 69520 - DNA, 601 bp, Human
cagaaattgtttttctgtggcttaatttgagctattttcagatacagcaatgaaaaagaagagtctacattgttctacatactgattgtcactatgttcaatttactaaccactagaaagatcctggaaatttaaccctctcctccatctttgtgaagatatttataaaatcacctgctagctctgtgcacccatttatacttcatcagatgtttattaagtttttcttagagataatttcctacagtgaagggctgttttaaaatgaatgggctcacctattaggtttgaaatgccctakccttgtggtggactggttgtatcagtgaagttatttaaagaatttctaggccactgactcagcagtcactagaggatatagtagttgtttaataaagcccatgtacgtccattacagcttgtaacaggtttgcacagcatgcagaagaaaaataaaacattaattagctttaattccacaagtaaaacaatgtgaaaaacaataaccaacagccaaaagaatgtttccttataaatcaaacaggatgatttatttggctagatttctaataaagaggaattctcagcttttatctcatgg

SEQ ID NO: 69521 - DNA, 601 bp, Human
tacaggcatgtgccaccatgcccggctaattttttttcattttctgtacagacgaagtctcactatgttgcccaggctggtcttgaactccctgggctcaagtgatcctcctgcctcgccttcccaaagtactggaattacaggcatgagccactgcacccagccttcaaaagttagtattacatattggcttacttttattcagtagaataaacattctggagttttttgtgttttaaaatgtgatgctacctaattttatcattgaagttaacatgaaataagagatgtgacacaatayaccccaaatatattatatgggtttcccttttctctgatactttttagcaatactggttaaatgcaacatattttcttgcaaataggtccacagatgccaaaactttgaatcacatattatggataaaatgtgataatgcattttcaactttaaaaaagaaaatataggccagtagtggtggctcaggcctgtaatcccagcactttgggaggccgaggcggacgggtcacgaggtcaggagatcaagaccatcctggccaacaaggcgaaaccctgtctctactaaaaaaaatacaaaaa

SEQ ID NO: 69522 - DNA, 601 bp, Human
cctctgtattcctcctgtcatattaaagagggaggtatcaatttagcagggtaactgatacctcatgatcacatacaggaacagttgagcaattaaacaaaaaatcaaattattattattattattattttgagatagggtctcactctatcactgaagctggagttcagtggtgtgatcttggctcattgcaaccttgaccttctgggctcaaggcatcctcccacctcagccacccaagtagctgagactacaggcatgtgccaccatgcccggctaattttttttcattttctgtacrgacgaagtctcactatgttgcccaggctggtcttgaactccctgggctcaagtgatcctcctgcctcgccttcccaaagtactggaattacaggcatgagccactgcacccagccttcaaaagttagtattacatattggcttacttttattcagtagaataaacattctggagttttttgtgttttaaaatgtgatgctacctaattttatcattgaagttaacatgaaataagagatgtgacacaatataccccaaatatattatatgggtttcccttttctctgatactttttagca

SEQ ID NO: 69523 - DNA, 601 bp, Human
cacaacatttggaagagagtaagaacttacgtattcttccttacatcctctgtattcctcctgtcatattaaagagggaggtatcaatttagcagggtaactgatacctcatgatcacatacaggaacagttgagcaattaaacaaaaaatcaaattattattattattattattttgagatagggtctcactctatcactgaagctggagttcagtggtgtgatcttggctcattgcaaccttgaccttctgggctcaaggcatcctcccacctcagccacccaagtagctgagactacmggcatgtgccaccatgcccggctaattttttttcattttctgtacagacgaagtctcactatgttgcccaggctggtcttgaactccctgggctcaagtgatcctcctgcctcgccttcccaaagtactggaattacaggcatgagccactgcacccagccttcaaaagttagtattacatattggcttacttttattcagtagaataaacattctggagttttttgtgttttaaaatgtgatgctacctaattttatcattgaagttaacatgaaataagagatgtgacacaatatacc

SEQ ID NO: 69524 - DNA, 601 bp, Human
cttgaagagaatgtaacctgacacattatgggttttttggagtatggatggagtctagctgatatttattttccttctgtcaagtgagacaaattatctatattctatttaccttaaattgatactgtaatgtatcatgctccactttaggagctgtataaggcatgccaaatgcaggcttgatagtcaacaatcaagtgagggggatggagaagggaacaggggaaagaggggactggaataggaggagagagacacacacagagagagactgagatagttttactctttaaagtcctayggaaaagccttttgtagtgcaaggttcaggataaatctctcttctccctttgatgttgcagctgtagtttttttcccctatgcccctctaatagttatccacaactcttcaaagataagtacactagtcattgaataaaatgcaaattgcattgagtaaaaaaggcaaggagcatagggttttttctcactggtcaaacctgagcctaccaggtcccagtcagagctcccaggcaagcacagagtgctggaggattaaccacattagaggaccagagggaagtagtgaagaaagcaacgt

SEQ ID NO: 69525 - DNA, 601 bp, Human
atgcctggccaggataagaaaccagagttcaataaaaaaccagcatgtaataaaacaagttattactgtgtagagattagaaaccacaaacagttttgtttgattataaaagcgccacttttaaatttatctctcaaataaaaacagcaaatgcaggcaataattcatctcagctgaatagaaagcatcaagcattgaacttttaagactcctgggagttaataatcaatatgtagaggtgaccaatttcacttcagtgaggtcaatatccaatagttcaatatgattatatcaaatgaayagcatccaaaaaaaaggagctcagaatagctcctcttgaagagaatgtaacctgacacattatgggttttttggagtatggatggagtctagctgatatttattttccttctgtcaagtgagacaaattatctatattctatttaccttaaattgatactgtaatgtatcatgctccactttaggagctgtataaggcatgccaaatgcaggcttgatagtcaacaatcaagtgagggggatggagaagggaacaggggaaagaggggactggaataggaggagagagacacacacagag

SEQ ID NO: 69526 - DNA, 601 bp, Human
atgatatgctaaacaagcggtggattattcattcctctcctttctagaccatatagggtaacttcctgacattgccatggcatttctaagctgtcatggcgctgatgggagggtagcagtgaggacgaccagaggttactctcatcgccatcttggttttgttggatttggccagcttctttactgcaacctgttttatcagcaaggtctttatgacccgtattttgtgctgacttcctatctcaccctgtgacttagaatgctttaaccatctgggaatgcagcccagcaggtctcagcytcattttactcagttaccattgaagatggagtcgctctggttcatgcgtcccagagagaactattaaagtggaaaataatattttattcttgactacattttaaaaaatatcaagagtcttataaacaaataatatgcaaacacagtagaacaaaatatggaaagttatttccttaatgcttgatgaatacattgaggcatggataaatgcctgtgaacataactcacatttaagttttttatctgataaagttgattgaaactcctttcatagcattttgcattttaatctaaaataac

SEQ ID NO: 69527 - DNA, 601 bp, Human
aggaataaaacaatggctactccacagacagaacagccccaagggctgctgtttgcccatttttatggttatttcttgatgatatgctaaacaagcggtggattattcattcctctcctttctagaccatatagggtaacttcctgacattgccatggcatttctaagctgtcatggcgctgatgggagggtagcagtgaggacgaccagaggttactctcatcgccatcttggttttgttggatttggccagcttctttactgcaacctgttttatcagcaaggtctttatgacccgtaytttgtgctgacttcctatctcaccctgtgacttagaatgctttaaccatctgggaatgcagcccagcaggtctcagcctcattttactcagttaccattgaagatggagtcgctctggttcatgcgtcccagagagaactattaaagtggaaaataatattttattcttgactacattttaaaaaatatcaagagtcttataaacaaataatatgcaaacacagtagaacaaaatatggaaagttatttccttaatgcttgatgaatacattgaggcatggataaatgcctgtgaacata

SEQ ID NO: 69528 - DNA, 601 bp, Human
agagatacctagagagatgatgatgtgaagcagcacaggggtaaaagagccaaggagagaggccttagacaaacccttccctaactgccctcagaaaaaaccaatcctgctgacaccttgatctgggacttccggcctctagaacatgagacaatgaatttctgcttttaaaccatgccgtttgtggtacttggttatggcagccaaagcaaacgaatacaaatagtaaagacaaaatcagctgtcaccaggaaaagaaaaagaaacacccaaaagccactgtacttattcattaacctgycacaaaaaaaccccaaaacttcaataatttaatttccaaatagacactacctaattggatagagaatataaagtatgtgcattttgacaatgacagtattgtatatgttccaaatgagattatttaggccgggtatggtggctcatgcttgtaatcccaggactttgggaggctgaggtgagcggatcacctgaggtcacgggtttgggaccagtctggccaacatggcaaaaccccatctctactaaaaacacaaaaaaattagctgggcatggtagtgtgtgcctgtaaccccaggta

SEQ ID NO: 69529 - DNA, 601 bp, Human
acaaatgttccctattcagacctatacaaggtgctagacactcagttcatctcctcaggattgggagggtggtgaaagaaaaagatctagctatgctagcagagattctttacagatgcgcattttcacccacaaaggatggctgtgcagggccatttcaaaatatagcaaagaaacatgttttggggtaaacgatttttattttcttctttgtcacataatgttatgccagagtcagattggaaagtaagtcaggatatgtagggttaaataaaacccatctgataagaatttatggttwgtagggcatgactccccaactctctagatacgaattttggcaagataaaaaaaccagagcttagtcctcaatggtcatatttggagacagcgtttttaaagagataatcaagttaaaatgcagtcattagggtgggccctcaccccggataactgatatccttgtgaaatggggagctttggacacagagacagagatacctagagagatgatgatgtgaagcagcacaggggtaaaagagccaaggagagaggccttagacaaacccttccctaactgccctcagaaaaaaccaatcct

SEQ ID NO: 69530 - DNA, 601 bp, Human
aaggtggttggggcgcagcttggtttcatgcattttagggaggcatgagacatcaatcaaatacatttgagaaatatactggtttggtccaaaggcggttcaacaattcaacttcaattcaattgttcaacttcgaacaattcgaagctgggtcttctaggctttaggtaaatttaaacattttctggttgacaattggttgagtttgtctaagacctgggattaatagaaaggaaatgctcaggttaagataaaagattgtggagaccaagattcttgaagtgtcatactggctgtcctyagagacaacagatgacaaatgttccctattcagacctatacaaggtgctagacactcagttcatctcctcaggattgggagggtggtgaaagaaaaagatctagctatgctagcagagattctttacagatgcgcattttcacccacaaaggatggctgtgcagggccatttcaaaatatagcaaagaaacatgttttggggtaaacgatttttattttcttctttgtcacataatgttatgccagagtcagattggaaagtaagtcaggatatgtagggttaaataaaacccatctgat

SEQ ID NO: 69531 - DNA, 601 bp, Human
ggaaatactgttttccactataatggttaatttgtaaatcatctcattgggaagacagacaattctatcacctttgacacgcacatacttttgattgatgttgtttatatggagactgagtaaattatcattgaagttttagttattttatatggcaaatttaccaaatacttttttgttgaagtcctaacctcctaacaaaaagaggagaaactctgtaaaatatttggagagatttattctgagctaaatatgagtgaccacggtcgtgacacagcccccaggaggtcctgagaacatrtgtccaaggtggttggggcgcagcttggtttcatgcattttagggaggcatgagacatcaatcaaatacatttgagaaatatactggtttggtccaaaggcggttcaacaattcaacttcaattcaattgttcaacttcgaacaattcgaagctgggtcttctaggctttaggtaaatttaaacattttctggttgacaattggttgagtttgtctaagacctgggattaatagaaaggaaatgctcaggttaagataaaagattgtggagaccaagattcttgaagtgtcatactggct

SEQ ID NO: 69532 - DNA, 601 bp, Human
actttcttaataaacttacttttactttgccctgcagactcaccctggatctttcttgtgcaaaatccaagaaccctctcttggggtctggatcgggacccctttcctgtaacaaaactccaagagccattacacaggaccacacaggtcccaggatccacacctactggagggggtcccatcacatgacacagaccctccacaccgcacatgccctccttatgagtgaaggacacaataggggttggtgctctgtggaaccctcccttcatgaattctctaccaaataggacaaagaggyggtttgttaggtacctttcattcctaacgcatcttcgaattcaaagcagcttttgttttaacagggtccattcttaaaagattaacaataacagacccctctgccattccttacaatgaaacagtggtaaatgtgcatttctggagaataacatgatgttgaaacccaagccttaagagaggaatgggtgtgtggtgtgtgtgtgtgtgtgtgtgtgttgtggtaggggtgtggatcaagacttggagagccatttaaacacactggctcataaacagaacgtgtctccctgtgaaggtg

SEQ ID NO: 69533 - DNA, 601 bp, Human
acacacacacacacacacacacacacacacacatgcatgcatgttacctagggtggacatgcgttcctcctcttactttcgggaacacctactctgtctctggagtagctgttctttcaccactttactttcttaataaacttacttttactttgccctgcagactcaccctggatctttcttgtgcaaaatccaagaaccctctcttggggtctggatcgggacccctttcctgtaacaaaactccaagagccattacacaggaccacacaggtcccaggatccacacctactggagggsgtcccatcacatgacacagaccctccacaccgcacatgccctccttatgagtgaaggacacaataggggttggtgctctgtggaaccctcccttcatgaattctctaccaaataggacaaagaggtggtttgttaggtacctttcattcctaacgcatcttcgaattcaaagcagcttttgttttaacagggtccattcttaaaagattaacaataacagacccctctgccattccttacaatgaaacagtggtaaatgtgcatttctggagaataacatgatgttgaaacccaagcctt

SEQ ID NO: 69534 - DNA, 601 bp, Human
ctccatcttgagtgagggctaggaaaatgaggctgggacctgctgggctgcactcccaggcagctaggcattcctagcctctaaatgcttatagttacgggaacagactgataatgttgactaaacagacccagacttgggagtgtcctgatatcccgatatctggaaaacaaaggcattcctaattttgctttaaagataatattgattcttgcaaaatatagtaattaagaaaattaatcctttatcagaaacccttgtagcagaacacatctctccatggtcttttaaaatcattcaaacacacacacacacacacacacacacacacacacacacatgcatgcatgttacctagggtggacatgcgttcctcctcttactttcgggaacacctactctgtctctggagtagctgttctttcaccactttactttcttaataaacttacttttactttgccctgcagactcaccctggatctttcttgtgcaaaatccaagaaccctctcttggggtctggatcgggacccctttcctgtaacaaaactccaagagccattacacaggaccacacaggtcccaggatccacacctact

SEQ ID NO: 69535 - DNA, 601 bp, Human
aaatagtaagaagaagaaaaataaaaaacaaggactgtgttagttcattcttgcgttgctataaatacctgaggctaggcaatttatacagaaaagaagtttaatttgctcatggttcttcaggctgtacaagaagcatagtgctggcatctgcttgcttctagggaggcctcaggaagtttacaaacatggcagaagatgaagggggtgcaggcatgtcacgtggcaaaagcaggagcaagaggaaagggaaggggagggagggaggtggcacacacttttaaacaaccagatcttgtgygaactcagagcaagagctcactcatcaccaagaggacggcaaaagccattcatgagggatctcccttctgatccaaacacctcccaccaggcctcacctccaatgctggggattgcatttcaacatgagatttgggtgcggacagatatccaaactatgtcaggaaaaaatgaaacaacaaaacaaaacaaagagctcaagtttagcaccttgttcccaagggaaagggctgagctcagtaactcttaattttggatgacaactctaataaaatccagaagaaaatggagatactgcatt

SEQ ID NO: 69536 - DNA, 601 bp, Human
atctgcctgccctcgcctcccaaagtgctgggattacaggtgtgagacatcgcacaaagccaaaaaccggatttttaagaaatctggtctcttattacacctttaacggggtatcaaaaacagtgccgagaatacagcagacacaggcctgtgtctcaggacagaatgtacacgtgaagcctggacataagaaaggcaatctgaataccattttcccatgacattccaaagagctcaagtttaaaaaaatagtaagaagaagaaaaataaaaaacaaggactgtgttagttcattcttgcrttgctataaatacctgaggctaggcaatttatacagaaaagaagtttaatttgctcatggttcttcaggctgtacaagaagcatagtgctggcatctgcttgcttctagggaggcctcaggaagtttacaaacatggcagaagatgaagggggtgcaggcatgtcacgtggcaaaagcaggagcaagaggaaagggaaggggagggagggaggtggcacacacttttaaacaaccagatcttgtgtgaactcagagcaagagctcactcatcaccaagaggacggcaaaagccattcatg

SEQ ID NO: 69537 - DNA, 601 bp, Human
atttttgtattttcagtagagatggggtttcaccatgttggccagtctggtttcaaactcctaacctcaagtgatctgcctgccctcgcctcccaaagtgctgggattacaggtgtgagacatcgcacaaagccaaaaaccggatttttaagaaatctggtctcttattacacctttaacggggtatcaaaaacagtgccgagaatacagcagacacaggcctgtgtctcaggacagaatgtacacgtgaagcctggacataagaaaggcaatctgaataccattttcccatgacattccmaagagctcaagtttaaaaaaatagtaagaagaagaaaaataaaaaacaaggactgtgttagttcattcttgcgttgctataaatacctgaggctaggcaatttatacagaaaagaagtttaatttgctcatggttcttcaggctgtacaagaagcatagtgctggcatctgcttgcttctagggaggcctcaggaagtttacaaacatggcagaagatgaagggggtgcaggcatgtcacgtggcaaaagcaggagcaagaggaaagggaaggggagggagggaggtggcacacactttt

SEQ ID NO: 69538 - DNA, 601 bp, Human
gaaaagccaggagtccatcctcaagtccaaaagagacaaatactagtaagtattctagagaaaggtcataccctttaatatgcattaacagactgaagcccgactacaaaataacacaggttgatccctgtattagtccattttcatactgctatgaagaaatacccacgactgagtagtttataaattaaacttcttatgaagaaaaagaggcttaatggactcacagttctgcatggctggggaggcttcacaatcatggcagcagatgaaggatgagcaaaggcacatcttacatggyggcaggcaagagactgtgtgcaggggaactgccctttataaaaccatcagatctcatgagacttattcactatcacaagaacaacatgagaaaaacccacccctatgattcaattatctcccactgggtccctcccacaacatgtggggattatggaagctacaattcaagatgagatttgggtggggacacagccaaaccatatcaatcctttatccagaattcttgggaccagaagtattttggatttcagattttttggactgacatatttgtactctatttaccagtgcattatct

SEQ ID NO: 69539 - DNA, 601 bp, Human
ggataagagctccctggagaagggctcattcttggatgggcaacagaattagagcctgagtctagagctaataaaacaaagacaaagaagggatcacgcagaaagcttggtaaagactgtcctggccaatctgattacagtcagttggtacatgatgagccaagaaaagccaggagtccatcctcaagtccaaaagagacaaatactagtaagtattctagagaaaggtcataccctttaatatgcattaacagactgaagcccgactacaaaataacacaggttgatccctgtattagtscattttcatactgctatgaagaaatacccacgactgagtagtttataaattaaacttcttatgaagaaaaagaggcttaatggactcacagttctgcatggctggggaggcttcacaatcatggcagcagatgaaggatgagcaaaggcacatcttacatggtggcaggcaagagactgtgtgcaggggaactgccctttataaaaccatcagatctcatgagacttattcactatcacaagaacaacatgagaaaaacccacccctatgattcaattatctcccactgggtccctccca

SEQ ID NO: 69540 - DNA, 601 bp, Human
aggagactccattctaagcataagagagacgataaaattggaggcaggagtgggtggtgggcgatggggtccactttagatacagtgataatggaaaaaactttgttgagatggcatttgaactgaaacttgaatgagataagacagcaagcctaaggtcatttagaaattgaatataagtgtaaagccggccagaagctgtaatcccagcactgtgggaggccgaggtgggcagatcacttgagactcaggagttcgagaccagcctggctaacacagcgaaactccatctctactaaawatacaaagattagccaggcgtggtggcacacgcctgtaatcccagctactcgggaggctgaggcaggagcatcttttgaacctgggaggcggaggttgcagtgagccaagactgtgccactacactccagcctgggcgacagagtgagaccctgtatcaaaaataaataaataaaaataaaaattagctaggcatggtggtacatactgtaaccccagctgtttgggaggctgaggcatgagaatcgcttgaatccaggaggcggaggttgcggtgagattgcacccctgcactccagcc

SEQ ID NO: 69541 - DNA, 601 bp, Human
aactacgtctcccgctcttgcaggagactccattctaagcataagagagacgataaaattggaggcaggagtgggtggtgggcgatggggtccactttagatacagtgataatggaaaaaactttgttgagatggcatttgaactgaaacttgaatgagataagacagcaagcctaaggtcatttagaaattgaatataagtgtaaagccggccagaagctgtaatcccagcactgtgggaggccgaggtgggcagatcacttgagactcaggagttcgagaccagcctggctaacacagygaaactccatctctactaaaaatacaaagattagccaggcgtggtggcacacgcctgtaatcccagctactcgggaggctgaggcaggagcatcttttgaacctgggaggcggaggttgcagtgagccaagactgtgccactacactccagcctgggcgacagagtgagaccctgtatcaaaaataaataaataaaaataaaaattagctaggcatggtggtacatactgtaaccccagctgtttgggaggctgaggcatgagaatcgcttgaatccaggaggcggaggttgcggtgaga

SEQ ID NO: 69542 - DNA, 601 bp, Human
gtctgaagctcctgaggacagagcagtgtacaaaactacgtctcccgctcttgcaggagactccattctaagcataagagagacgataaaattggaggcaggagtgggtggtgggcgatggggtccactttagatacagtgataatggaaaaaactttgttgagatggcatttgaactgaaacttgaatgagataagacagcaagcctaaggtcatttagaaattgaatataagtgtaaagccggccagaagctgtaatcccagcactgtgggaggccgaggtgggcagatcacttgagastcaggagttcgagaccagcctggctaacacagcgaaactccatctctactaaaaatacaaagattagccaggcgtggtggcacacgcctgtaatcccagctactcgggaggctgaggcaggagcatcttttgaacctgggaggcggaggttgcagtgagccaagactgtgccactacactccagcctgggcgacagagtgagaccctgtatcaaaaataaataaataaaaataaaaattagctaggcatggtggtacatactgtaaccccagctgtttgggaggctgaggcatgagaatc

SEQ ID NO: 69543 - DNA, 601 bp, Human
ggctgatcaggagacctctggcacccaaagactgcgtgatgactgagggactctttatgctcgcttctgcctaggtccttaggttcagagatcaggctctaagtactttttctgacttgccaacgtaacccgcacatattttaagggctgggaagaagagctgcctcccctcccctctcctctgctgtttattttcaagcaattactatagttcaaagcctgccaatttaccttttataggctctttcacaccatcgtgatggaacacaaaagcaacacctgcatcctgaggctctcagcrgccaatatctaggtcctacacacagaggtgtctgttaggggatgggaggcctggctgactcaaaaacaaaacaaaatataaggcaagtgggctgagtccaggtcaaacaaagcgtctgtttttgttttgttcccctccccctggcccccgatattgccctttaaaattctgtgtgcaggagtttctttcaaagcctagctaaaaagagcgactagatttgatgggaaatagctggttgggaaaggctgcagccttggaaacatcagagcaacatttatggtgatggaagtggcagtaata

SEQ ID NO: 69544 - DNA, 601 bp, Human
tccggtacctggtaggactcagagaccagaagcgctgtgatactgtggttctgacaattgctgtggagtccctgtttctcttttgtatagcatgcagccacacttattctcaaaagcaggacatttgctccaacatgaacagagcagctacaaatttttctttttactggtgccatacataattaaaatgaaaccatgttatttccacattttaggagaaagaaacaaaataccaattttctcctcaacacttaattaacaatgggaatttgactgggagaatttttcttagcaatatagraaattaattccatctgtgagaaaatttaagctcaaatggagaagccctgtcttgacaggattcttctgtgtggagaaaagccaaatgtttcttgaagcacgtgatcatgcctgactggcgctggatgtccctgtgttcaacaggtcaggctccatctcaaatgacgcaggtggaaggatgagcaacggcacagcctcctgcagcacacagatgcttctcaatggggctgatcaggagacctctggcacccaaagactgcgtgatgactgagggactctttatgctcgcttctgcctaggt

SEQ ID NO: 69545 - DNA, 601 bp, Human
aaataaagatgttaaaagaaaaacaaatctatctggcccaatgtcacaaagctagcaaaaggtaagggtagggcttgaacccaggcagcctgtttccagggccaggcttacacccactggtctacaggtggaagagaacctagcatgtctcctagggcaagcttattctccaaggctacacctgctcctcattaaaaggcacttcatagtttttgtacatttccttagagggtattcagaagtcctttgaccccattgaaatgcttcttcagggtccataagtcccgctgggagaagcgtkcatctccggtacctggtaggactcagagaccagaagcgctgtgatactgtggttctgacaattgctgtggagtccctgtttctcttttgtatagcatgcagccacacttattctcaaaagcaggacatttgctccaacatgaacagagcagctacaaatttttctttttactggtgccatacataattaaaatgaaaccatgttatttccacattttaggagaaagaaacaaaataccaattttctcctcaacacttaattaacaatgggaatttgactgggagaatttttcttagcaat

SEQ ID NO: 69546 - DNA, 601 bp, Human
attgttgtcaaataaagatgttaaaagaaaaacaaatctatctggcccaatgtcacaaagctagcaaaaggtaagggtagggcttgaacccaggcagcctgtttccagggccaggcttacacccactggtctacaggtggaagagaacctagcatgtctcctagggcaagcttattctccaaggctacacctgctcctcattaaaaggcacttcatagtttttgtacatttccttagagggtattcagaagtcctttgaccccattgaaatgcttcttcagggtccataagtcccgctggsagaagcgttcatctccggtacctggtaggactcagagaccagaagcgctgtgatactgtggttctgacaattgctgtggagtccctgtttctcttttgtatagcatgcagccacacttattctcaaaagcaggacatttgctccaacatgaacagagcagctacaaatttttctttttactggtgccatacataattaaaatgaaaccatgttatttccacattttaggagaaagaaacaaaataccaattttctcctcaacacttaattaacaatgggaatttgactgggagaattttt

SEQ ID NO: 69547 - DNA, 601 bp, Human
aactgtacaccctaattgtagtctgttgtatgccaattgttgtcaaataaagatgttaaaagaaaaacaaatctatctggcccaatgtcacaaagctagcaaaaggtaagggtagggcttgaacccaggcagcctgtttccagggccaggcttacacccactggtctacaggtggaagagaacctagcatgtctcctagggcaagcttattctccaaggctacacctgctcctcattaaaaggcacttcatagtttttgtacatttccttagagggtattcagaagtcctttgaccccatwgaaatgcttcttcagggtccataagtcccgctgggagaagcgttcatctccggtacctggtaggactcagagaccagaagcgctgtgatactgtggttctgacaattgctgtggagtccctgtttctcttttgtatagcatgcagccacacttattctcaaaagcaggacatttgctccaacatgaacagagcagctacaaatttttctttttactggtgccatacataattaaaatgaaaccatgttatttccacattttaggagaaagaaacaaaataccaattttctcctcaacact

SEQ ID NO: 69548 - DNA, 601 bp, Human
aatccatacctgccatatgacccacgcattccactcctaggtgtttacccaagagaaacaatagcacatgttcaacaaaagacttttacacaaaagctcacagcagctttatttctaatagcccctaactggaaataagcctaacgtccaccagcaggcaaaaggataaacaaactgaggtatatccacacaatggactacaaatcagcaatgaaaagatatcaactactgatgcatggaacaagaatgaatgactctcaaaatacttatgctgaatgaaaggagccagttgtttttttttaaatagagtacacattatatgtctatatttatcgaacactctacaaaatgcaaacatacagtcagaaagtaggtcagtggttgcctggggatgggggaaatgaagggagaggcacaaatgagaaatatggtttatacatgggcataaaaaaacccttggggatgaggaatttgttcactgtcttaagttgattgttttacagatgtatatatttatcaaatgcatcaaactgtacaccctaattgtagtctgttgtatgccaattgttgtcaaataaagatgttaaaagaaaaacaaatc

SEQ ID NO: 69549 - DNA, 601 bp, Human
aggcgtggtggcgggtgcctgtagtcccagctactcaggaggctgaggcaggagaatggcgtgaacccgggaggcagagcttgcagtgagctgagatcacgccactgcactccagcctgggcgacagggcaagactctgtctcaaaaaaaaaggtaaatccatacctgccatatgacccacgcattccactcctaggtgtttacccaagagaaacaatagcacatgttcaacaaaagacttttacacaaaagctcacagcagctttatttctaatagcccctaactggaaataagcctaaygtccaccagcaggcaaaaggataaacaaactgaggtatatccacacaatggactacaaatcagcaatgaaaagatatcaactactgatgcatggaacaagaatgaatgactctcaaaatacttatgctgaatgaaaggagccagttgtttttttttaaatagagtacacattatatgtctatatttatcgaacactctacaaaatgcaaacatacagtcagaaagtaggtcagtggttgcctggggatgggggaaatgaagggagaggcacaaatgagaaatatggtttatacatgggca

SEQ ID NO: 69550 - DNA, 601 bp, Human
ccaaaacctcaaatttagtgcacataagaccaaactcatctttcatgctccctgctttgcctctttttcttctggtgttcccttggtcagtactggtcagcaccatggatagcgccacagaacctctttttttaagcctgagtcttgctcttgtcacccaggctggagtccaacggcacaatcttgactcactacaacctccacctcccaggttcaagtgattctcctgctccagcctccccagtagctgggattacaggggcccaccaccacgcccggctaattttttgtatttttagtwgagaaggggtttcaccatgttggtaaggctggtcttgaactcctgacctcaggtgatccacctgcctcggcttcccaaaatactgggattacaggcatgagccaccacacccagccagaaccctgttaaagctcctgaaatgactgaaatgaaagaaccttgtggtagaacaatttacacctactcctatgttcatcacagcactactcacaattgcaaagacatggaatcaacctaggtgcccatcaatggtgggctggattaagaaaatgtggtagaaacagggtcacactatgttgt

SEQ ID NO: 69551 - DNA, 601 bp, Human
actcctcaaagcagctagcaatgcatacccacagacatgaattgataaactgagaacctacctcttcaaagcaaaaggccctgaagctagaatattctgttgctgcagtattctgggctgcaccataatgaggggttgccaggctggtgactaatcaaagcagggtttctgggaggacttggccacaggaaggtaagttctacctccagcctaaacttgcttcctgaattccaagcccataagacattctcaattagatatctctccacttaagggtctcccaaaacctcaaatttagtgyacataagaccaaactcatctttcatgctccctgctttgcctctttttcttctggtgttcccttggtcagtactggtcagcaccatggatagcgccacagaacctctttttttaagcctgagtcttgctcttgtcacccaggctggagtccaacggcacaatcttgactcactacaacctccacctcccaggttcaagtgattctcctgctccagcctccccagtagctgggattacaggggcccaccaccacgcccggctaattttttgtatttttagtagagaaggggtttcaccatgt

SEQ ID NO: 69552 - DNA, 601 bp, Human
gacccctttttattccatggtaagatccaagatatggccactcaatctgataaacaaaactcctcaaagcagctagcaatgcatacccacagacatgaattgataaactgagaacctacctcttcaaagcaaaaggccctgaagctagaatattctgttgctgcagtattctgggctgcaccataatgaggggttgccaggctggtgactaatcaaagcagggtttctgggaggacttggccacaggaaggtaagttctacctccagcctaaacttgcttcctgaattccaagcccataaracattctcaattagatatctctccacttaagggtctcccaaaacctcaaatttagtgcacataagaccaaactcatctttcatgctccctgctttgcctctttttcttctggtgttcccttggtcagtactggtcagcaccatggatagcgccacagaacctctttttttaagcctgagtcttgctcttgtcacccaggctggagtccaacggcacaatcttgactcactacaacctccacctcccaggttcaagtgattctcctgctccagcctccccagtagctgggattacaggggc

SEQ ID NO: 69553 - DNA, 601 bp, Human
tgtaagtttctgttaagaggaacatttatacaaatgttagaattctgctatcagatcttatttttcccaaaacaaatgctagaccagagctgtgcacagtgtgacctacaaacgtgcaactcctaatatgttacagaagaaaaaaaattcagggcattaaaataatgcgctcacgatcatgtgaccacccagaatgtagaactgtcattcaaacccaggcctgcctcactctaaaaggcccatgtgatttctgttgtattgtcttcttgaaattaacattttctgttttttttccccccccaaagcaccatactgctttttaaccatttttcattaattccccttttggaatttctaccagctgctgatctttcaccgtgtttggctacttacccaccccagggaaagccaagccaatgtcttctttccacatcatcaaagagaaacctccctcttcctaacagtgacactcatctacaaaagctgccatttcttcatcttcttttttttgtttgttttatgtgtgtgtgttgttcccctccctgtgtctatgtattctcattgttcggctcccacttacaaatgagaacatgtggtgttt

SEQ ID NO: 69554 - DNA, 601 bp, Human
agagtctttgtaagtttctgttaagaggaacatttatacaaatgttagaattctgctatcagatcttatttttcccaaaacaaatgctagaccagagctgtgcacagtgtgacctacaaacgtgcaactcctaatatgttacagaagaaaaaaaattcagggcattaaaataatgcgctcacgatcatgtgaccacccagaatgtagaactgtcattcaaacccaggcctgcctcactctaaaaggcccatgtgatttctgttgtattgtcttcttgaaattaacattttctgtttttttyccccccccaaagcaccatactgctttttaaccatttttcattaattccccttttggaatttctaccagctgctgatctttcaccgtgtttggctacttacccaccccagggaaagccaagccaatgtcttctttccacatcatcaaagagaaacctccctcttcctaacagtgacactcatctacaaaagctgccatttcttcatcttcttttttttgtttgttttatgtgtgtgtgttgttcccctccctgtgtctatgtattctcattgttcggctcccacttacaaatgagaacatg

SEQ ID NO: 69555 - DNA, 601 bp, Human
gtcacagaagggactagggttaaatatgactccacgaacactgtttatggtaccaacactgacctttcctttattgcaaattttatagaacctactaaaatatactgcacagaagcatctaatgcatctcctttaacacatgactctattttataaggaagaaaggctttatgttaattttagaagtttatgaggtcttgagggaaattacagatcactccacggatattccattttctgtacccataccaaaacgaccactatcgtcccaatgaggaattcagggagagctgctcacacrcactgatgatggctctagctctgcgacagtcaatcactttctgtgtgactcttaggtatgtggaaagatatttctggaggcttaaaagtcactaggacaccaaacccagagaagcaaggaagtgttacatactgcctaaaatttcatgtactgcttatttcccaaaataattgctgcatctaagacaacattgatgaatgcttcttgctaataaatgagtgtttcaaaacaggccgagtactaggctttgaaccaggagacctgggttagagtctgcagtcccagatgggtgatcctgca

SEQ ID NO: 69556 - DNA, 601 bp, Human
atatgtatattttgcccatgcacccaagaattgggcatttttccctttttgcaagtgccttttagagatggttaaaattagttgaccatacaagtgggcaggagagactgcaattatagcttttctgtaagttacaaaattgagaccaaaattcattctgtaacacccacacagctggtataacacaatacattgatcagattggcactcctatttttacaagacaaagaattttcacagattattttacttcatgtgcccatggtgtctacagacagcacttctctttgagaaatactgrtaaattttttgaatggatttctgattaatcaaaaaatcataaatccttgtgaactaacatgtgtttctttgagatacacactacacacctaaaagagaagttaccatatatttttggtaaataactcagcttgttcctgactgcccatagacttctctttttcactttcctaataaaattacactgacaccttttgcctgtccttataaacatattgtagcctactttaaccctgatggactcttgggtgtcttaattgtggcaaatttagtcacagcattagaagtatatttttggtga

SEQ ID NO: 69557 - DNA, 601 bp, Human
tttttttagttctttgaaagttctactgttttcctttcctttaaaacctttctgttggtgatttaaaaatacaaatattcaatatacctggaaccgattttttgtgtacttcaggatctggtttcattttgtttctccacatgtatgatcttgtaactgcatgatttattgattagttcagtctctccccactgatctgcaatactccttccattgtaagtcaagtgtgcatatatgcatgagattatttatgggctttttatcctgttccattggtctctttgtctgtaactacactggyaccctaataccaggctgtcttcgttattatagctttataacagaccttaatgtctctaaggcaagacagcccatctctactactttggttcttcctcaggagggtttttgttatttctgacccttcactcttccaaataactgcagaattagcttgtcaatttgaactcttttcttactggttgtttttaatgtctcctcttttgtttttggtgtccaccatgataggtctaactatatatgtattagtgctgcttggtatacaaagtgtaaactgtatcagaggattccaatgttctag

SEQ ID NO: 69558 - DNA, 601 bp, Human
tcccagctactcgggaggctgaggcacaagaattgcttgaaactgggaggcggaggttgcagtgagccaagatcacacgactgcactccagcctggggaacagagcgagaatctgtctcaaaaaaaaataataaaaaattctgtaatcctgtctcattggttcatgacaagatgcaacttgatgccccgggggattcttctaggggataacagggctcagttgcttgatttctctctcaaacatggagaattttagcagtttgtgccttttcctttattccaatcactacatattttgtgytttaatttttcattttgtatgtcaatttgtcaatttccatttgcaatagaaataaaagcagaatatatctaagagggctattccttaaggttctcttttgaattatctaaccttggaaattgggatgaagataaacaaaactggtatccatctgggatgcagtggatttttctctgcaggtatttatttccccttgaaaatataaagcacatctatctcaatattcaaggtttgaccagagaacaatttggcttgaaaatattttggtgtggacgggcacaggggctcatgcctgtaatc

SEQ ID NO: 69559 - DNA, 601 bp, Human
aaggaacttttagaactaggcatttctcatcactgacaaacacagttgtagagcgctttgtaaaattacacacatgtaattatctcatttattttgacaataattctctctttccctcaggctcaatctgtaagaatggaatcacgctaacagaaagctaaattaaaagatgcaggcatgtccattctgtaaaagctgagactatctctagctcactgagaggttatttttaaaattctgtatatttgcagacacgtcaaaaggttgacaggaggaggcaggttcatggggtctcattaaycacctttctattataacagaagtttaagtgaagattatacagtagcatagttaagcacacttccaacaacatttttcttcctcctcaaaatagcgctgacctattgttacatttatcaaacctgccacacagtaggtcctccataaatgttcactgttattcataaagacaatgataaaggcatcttttgagaagagacttacaagtagacaggcaaagaaaagaaagaggcagaagaacaagaagcagatctaactaaaactggaagtcagcactaataaggagtcctgaaaagctttt

SEQ ID NO: 69560 - DNA, 601 bp, Human
tcaaccatcttcacaaatcactaatgtgtgttaatgtccaaattttaccagaaatgactcctgtaatcttgtttgaaatgagatttcataagagacataaggagatttaatttttgggggaaaaaaccccaccattcatacagcaataaagtcccaatttatcactgtgaaaaaccaggccctaacactacactaggacttttgtttaaaaccaaaagtaaacacatcttgccatctaaaactcttcaaattccactccttcccaaggaacttttagaactaggcatttctcatcactgasaaacacagttgtagagcgctttgtaaaattacacacatgtaattatctcatttattttgacaataattctctctttccctcaggctcaatctgtaagaatggaatcacgctaacagaaagctaaattaaaagatgcaggcatgtccattctgtaaaagctgagactatctctagctcactgagaggttatttttaaaattctgtatatttgcagacacgtcaaaaggttgacaggaggaggcaggttcatggggtctcattaatcacctttctattataacagaagtttaagtgaagatt

SEQ ID NO: 69561 - DNA, 601 bp, Human
agggggcacacggcacaacagaactatttactgaatttagtataaaaattctccgtacaaaaaattcaaccatcttcacaaatcactaatgtgtgttaatgtccaaattttaccagaaatgactcctgtaatcttgtttgaaatgagatttcataagagacataaggagatttaatttttgggggaaaaaaccccaccattcatacagcaataaagtcccaatttatcactgtgaaaaaccaggccctaacactacactaggacttttgtttaaaaccaaaagtaaacacatcttgccatytaaaactcttcaaattccactccttcccaaggaacttttagaactaggcatttctcatcactgacaaacacagttgtagagcgctttgtaaaattacacacatgtaattatctcatttattttgacaataattctctctttccctcaggctcaatctgtaagaatggaatcacgctaacagaaagctaaattaaaagatgcaggcatgtccattctgtaaaagctgagactatctctagctcactgagaggttatttttaaaattctgtatatttgcagacacgtcaaaaggttgacagg

SEQ ID NO: 69562 - DNA, 601 bp, Human
aatcacttttgtcttccatctcacaaagaatgatcattttggggaaactaaggcagttcaaaggcagctcaatcaaccaaagtcagataacctgatttctcaaatgctaatgtgctgactctgggcagagagcttattgcttttctccttcacattgcctacgaagataggtcaaagtttgctacgagcctccacatttgagagagaggaggagaagctgtagtctacagttagccaagtctatggcttgtttgaaagggcaggaaggggacaacagtgaagaagggagatgaacagatgsctaaagtaaacaatgggaattcattttttttctaaaatcaaatgggaaattcaattattcactattctacttgaaagcactgctttccagaaaattaaatgtacctggactatattcagaagatttagaacaaagagctgccagctttcacagtttattgttgaaaaccaagatactttaaataaataaataaataaataaataaataaatagctttgctttactattaagaacaggaaaccgtgggctgtaaaatgttaaacagtttacccaagtcacaactataaaagcattagtata

SEQ ID NO: 69563 - DNA, 601 bp, Human
ctcaataaagctatttaaaaaaaactccaccaccacatgagctctttggcatctgactattctttgactggcacataggcaggaattgggatgactgctaaactgtgtgctttcttctttttcttgtttttctttgagacaaggttttgctctgtcacccaggctggagtgtggtggcctgctcagggctcactgcagccttgacctgctgggtttaagcaatcctcctacctcagcctcccaagtagctgagactacagtcatgagccattgtgcctggctaatttaaaaaaaaaaaaaatttttttttttttttaagagactaggtctcactatgttgcctaggctggtcttgaactcctgggctcaagccatcctcctgcctccacttcctaaagtgctgggattacaggcactagcctccacacctagcgttacgtgctttcttctgaatgaagtgtctttgaatcacttttgtcttccatctcacaaagaatgatcattttggggaaactaaggcagttcaaaggcagctcaatcaaccaaagtcagataacctgatttctcaaatgctaatgtgctgactctgggcagagagctt

SEQ ID NO: 69564 - DNA, 601 bp, Human
tcacgccactgcactccagcctggacgacagagcgagatctgtcacaaaaaaaacaacaaaaaccagtcacattttgtctagaaggtttttaaaaatatatacgtatatatagcatagtagtgtgtatatacatatatgtatatacacatatatgtatatatatgtgtatatacacatatgtgtatatatatgtgtatatacatatatgtgtatatatatgtgtatatacatatatgtgtatatatatgtgtatatacatatatgtgtatatatatgtgtatatacatatatgtgtatatctatatacacacacacacacacacacacacacacacatacatatataaatgtgcattcaaaacagaaaccacaactacaacaaaagcaacagcaagaaagcagtttctggaaccactgggcacagctctcattctggtgttttgtgatatcccaccccttctgagtgataggagaaagcccgttccccatttgggagggtttcagtaaaggagaaagacaccaggtcaggaacgctgtgttcaactgtggcctcaaacatcttaactgtcaagaatcaagactcaaaacagcccctgctca

SEQ ID NO: 69565 - DNA, 601 bp, Human
ctgtactgaacaagtgaagatttttttttttaaaaaaacttgtcattattctctaaccaatacagtgtaacaactatttacataacgttgacatcatattgggtattacaagtaatccagagatgatttcaagtataggggaggatgtgcataggttacatgcaaatacaccattttatttcagggacttaagcatctgcagattttggtattgtaaggtgggcagagggtggtgggggggggtcctagaaccaatcccctatggttactgaagagtgattatatagtccctagagctgtrtttggcacctgcaaagctgtcaataactataagctgaggcaattcctatctacaactcactactatgctccccaatgaaaatgacttacaaattatataggaagttcatgttttcaaagtgagtcatctccacaacaaacatgtttctcgatagtctgagggatctgaatttaaacactcccctttcctaccctaaggagacataaccacaaatacggtgattacacattacgtgagtggcatttcccacgtgccagatacctggctgtgtgtgtttttctgcactatcttattattctt

SEQ ID NO: 69566 - DNA, 601 bp, Human
ctgacaagctggctgctccaagtgtgaaaagtgtcccacaggattccttttagcgctgacaatctaagattcagctaactttcataaacttggtattacaggtttataaaaacatcctgctgctcttgatttttttaggatatggaaacagagatggaattgataacaggcagcagtctgatttcagtctgattctgattttctctgtcacctgacgcatcacctgatagagaggaatactgaaatccactttctctgtaataacgttactgaaaaaaacagtgagatgagctaaggcagkcaggtagggaggaggaaaagaggcaagggacatggtaataaatgtatgcaaaaccaaacaggataatccagagaagctgtagaaaaacaacgtgctgctctgcggagacccacagagggcatcttgcaggcagaaactgcaccaatgccagcttctcaccttggactctggttagcaataggaatctattaccagtgatagatttttgagtctctaacctttcctatcagtgatttttcatagactgtctgctgcatgctgggggaagagccactttcgtcttaagttttttggccatta

SEQ ID NO: 69567 - DNA, 601 bp, Human
ggcttgggtgggcccattaatgaacctggctctctgaaactctcaggccagatttccattgccaacaacagcccctgccttcccagaatgtgacttggagcctgaaagcctgggtaattcttcaacttctgctactacccagggatattcatcccaggttcacatccagtagcagtcgtgcccactttcacagcagaccgacttcccatccaggcaggagagcaggaaggcacgggctgggttgtacagtttggctctgagcagggtaaggcatcagaaacctgatccatgtagcagagcrggcagcagggcctggaacctggcccaggaccctctgacaagctggctgctccaagtgtgaaaagtgtcccacaggattccttttagcgctgacaatctaagattcagctaactttcataaacttggtattacaggtttataaaaacatcctgctgctcttgatttttttaggatatggaaacagagatggaattgataacaggcagcagtctgatttcagtctgattctgattttctctgtcacctgacgcatcacctgatagagaggaatactgaaatccactttctctgtaataacgt

SEQ ID NO: 69568 - DNA, 601 bp, Human
gtcaatttctcaaatgggccttaccccctgctgccacagggccttcgcatgtgtgcttttctctgctgggaatgccttccaggctcacacccggatggtacctgccttctcattccttcacctggttagctcctgcccctcttcaggggttcagctggctgttgggtcccctgttacaagctctcatagcacagcctgattcaccatgctttgagcttacatctatttatgaagctccctgtcttcaggcaccactgaatcccttagccaagggcctgtcataaacatgaaacaggttctraggcaatgctgcgactgaaagaatggaattgaacaatgggtcctcccacagcattattattagggaagaaggcttgtagtatcattgttcccaccatggccaccattaaagtcaggctctacgtcaggaaaactagctaatgcatgttgtgcttaatactcaggtgatgggttgacaggtgcagcagaccaccatggcacacgtttacctatgtaacaaacctgcacttcctgcccatgtaccctggaacttaaaatgaaataaaataaacactcaggctctaggatcacaaatggaatc

SEQ ID NO: 69569 - DNA, 601 bp, Human
agggccgcgctagacgagaaaattctacaacagagcattaactcaaacaccttatggttttcacaacttaaagaatggatgtagacttcagtggataattcatgcttattaaatatgtgtgaaattattgtgattcatcttcctcctgtgttttaaatgactttgtaaaacccagacttggcatcaacagaaataacataatgcagtgtaaaatgatctcattattaaaagtatcctttaatgcaaaacaatctcggacagttatttcgttgtgatcctgaaggacttctttcctgttgaygagtggtaatgtatggggtaaattatttcttggatatcatgtaaatggaacttctgaactcattatgtataaattattaagttataaaacaccactgctaataaaactgtggctacagtgagaagtgtgatcaaaatcacacgtgactccggcctattaaacaataacgtattaatccataaagctgaaagcagcttatccagttactataattaaaatatgcttcactactaattgccttaccaatccttaaatttccctcaaaccattttcaaacgatggcaaaacagcagcccttac

SEQ ID NO: 69570 - DNA, 601 bp, Human
taagaaacaggcactataaatattggctgaataaatgaatgaataataaaaaaacggctatgcttgtattgagtggaacatgttcctttatttcctgcaaccaaagcattacagataaaccacattattaacaaattagctagctgaggccactgctctccaagccaccataagcagtttcaactgcaccaaatcaaaccatgaagaaattcaatcttgcccccacatgaaataaaaagagcacttttatgatatccacagttatctgttaattcagtaaacattcatgaacatgccactrtgagtgtaaactagttagacaggagggatcaggaggttggaccaaaatggggtttacgcaggggcctgccatctaccaacctgtgcagcggggaatctgcagtgaactttgctcccccatcctgactcccttaagagtggacgccgtgctagtttatacttgtcattttcctaaggattttttttttttttttaactcataaacccactggagtttcagttctgcgaagtcttttcaggccatgatgtgtgatactggagaatccttaggcggggatgatctgtgtaagacacaagactc

SEQ ID NO: 69571 - DNA, 601 bp, Human
aggtcactgggggtattcaagcaggggccagacgacaaccagctcagggaggccgtgaaaaggactccacccaggtcaagagtttggcctaagtgacctccactgtcttaactccacgattccatgggcttctgtgtacttttcaatgctcacactcctcagagtcccttccaaaaaggcagtgacaagcagagggcatttgtcctgccctgggtgggtcaggatctcacaacccctggaccccgaagggtgaccgagaccgattggacatctacctccaccactgatcaccacctggttyggagctatctccaactggttttcccctcccaattcctaattctcattaacctgaaagacagattacggcagtgcacgatctcacactgacgttcaatctgtcttttccagcatcctctatttatcagacagcttccaccaagtgaaccatgactcctcagtctttggcgaagtacaccttcaccaggcagtgctgaagtttgggaacagctagaagattaacagagaaagatttatagcaaggcttatttagatacatttacagaccagagctagcgcaaagatggccctggggctaccg

SEQ ID NO: 69572 - DNA, 601 bp, Human
gaatgttctggaatgcctgagtcctatacagtgactatgttgaggtggtgagtcccaggtcactgggggtattcaagcaggggccagacgacaaccagctcagggaggccgtgaaaaggactccacccaggtcaagagtttggcctaagtgacctccactgtcttaactccacgattccatgggcttctgtgtacttttcaatgctcacactcctcagagtcccttccaaaaaggcagtgacaagcagagggcatttgtcctgccctgggtgggtcaggatctcacaacccctggaccccraagggtgaccgagaccgattggacatctacctccaccactgatcaccacctggttcggagctatctccaactggttttcccctcccaattcctaattctcattaacctgaaagacagattacggcagtgcacgatctcacactgacgttcaatctgtcttttccagcatcctctatttatcagacagcttccaccaagtgaaccatgactcctcagtctttggcgaagtacaccttcaccaggcagtgctgaagtttgggaacagctagaagattaacagagaaagatttatagcaaggc

SEQ ID NO: 69573 - DNA, 601 bp, Human
acccaacactgggtaatttatcaggaaaaagaggtttaatgaactcacagttccacatgattggggaagcctcacaatcacggtggaaggtggagtaggagcaaaggcacatcttacatggcggcaggcaagaaagcttgtgctggggaacccctctttataaaaccatcagatctcatgagacttattcactatcacaagaacagcatgggaaaaacctgccacccatgattcagttacctcccactgggtccctcccacgacacatggggattatgggagctacaattcaagatgagayttgggtggggacacagccaaaccatatcaatgactatgtatgtaattttattgatagcaaattaaacctagttttcatttagaatactgctatagttttttagaaataaatttgagaactgaacttattaaaggaaaaacattataacaatacaggtgccttgcttgagggaatggatactccattctccatgctctgattattttgtactgcatgcctgtatcaaaacaactcatgtaccccataaatatacatacctactaaatgcccacaaaaattaaaattttaaaaccccaatac

SEQ ID NO: 69574 - DNA, 601 bp, Human
aaaagctagcagaagacaagaaataagatcagaccagaactgaaggagtcagagacaggaaaaaccctttaaaaaaaccagtaaacccaggagttggttttttgagaagattagcaaaatagaccactagctagactaacaaagaaaaagagaagaatcaaatagacaaaataaaaaggggatatcacccctgatcccacagaaatacaaactaccatcagaatactataaacacctctactaaaactagaaaatctagaagaaacggataaattcctggacacacaccccctcccaagamtaaagcaggaagaagccaaatctctgaagagaccaataacaaattctgaaattgaggcagtaattaatagcctaccaaccaaaaaaaaaaaaaaaaaaaaaaaaccccaggaccagatggattcacagccaaattctaccagagacaaaaagagctaatatcattccttctgaaatgattccaaataatagaaaaagagggactcctcctcaactcattttatgaggccagcatcatgctaataccaaaaactgtcagagagacaacaaaaaaagaaaatttcaggccaatattcctgat

SEQ ID NO: 69575 - DNA, 601 bp, Human
aacgttacaaggaaaagaactagagaagcaagagcatacaaattcaaaagctagcagaagacaagaaataagatcagaccagaactgaaggagtcagagacaggaaaaaccctttaaaaaaaccagtaaacccaggagttggttttttgagaagattagcaaaatagaccactagctagactaacaaagaaaaagagaagaatcaaatagacaaaataaaaaggggatatcacccctgatcccacagaaatacaaactaccatcagaatactataaacacctctactaaaactagaaaatytagaagaaacggataaattcctggacacacaccccctcccaagactaaagcaggaagaagccaaatctctgaagagaccaataacaaattctgaaattgaggcagtaattaatagcctaccaaccaaaaaaaaaaaaaaaaaaaaaaaaccccaggaccagatggattcacagccaaattctaccagagacaaaaagagctaatatcattccttctgaaatgattccaaataatagaaaaagagggactcctcctcaactcattttatgaggccagcatcatgctaataccaaaaactgt

SEQ ID NO: 69576 - DNA, 601 bp, Human
gttcaaaacatgggtaaggaataatgttagtgctgagatgagctatataaccctaacatttaggaacaagaagtacaaagtaggtaagcaaagctcccccgtacttaatggaaataatcatgcttagcagttaattcaccaatatctaaatttcaaattaggtataacatataaaaactgtaaacaagcaaaaataatctgaaaatgttgtagatgttaaatcaagaaccaggtagtccatgttcttactaacttgtgggatctaaaaatcaaagcaattgaactcatggagatagagagkagaaggatggtgaccggaggctggaaggggtagtagggggctgggaggaaaagtagcaatggttaatggttaaaaaaaaaaatagaatgaacaataattaaatgaggcactatagtccccccaccacaagagaattgtaatcaataatttacacttaaaaataagagtatcaatggattgtttgtaacaaagacaaatgctcaaaaggatagatacccaatataccaagatgtgattattacacattgcatgcctgagccacagtatctcatattccccataaatacatacacctactgt

SEQ ID NO: 69577 - DNA, 601 bp, Human
cagagaacataaggaggaggccttggatatgaaactaccaacaagtttagtcactttctgagcctggttttcactgaatattacacatgaccatgccagtcattgccaaagacaatcaccaagattctgcctggaggaaggtgcaaactctttttgctctgtccatggtcctgaacaggcagctcccaaggactaactgaaaacatgaataaggggactgagtatatcttcagtcctctgcagctctcccattcacaggctaagctgttctcgaatctgttcagatgggaaccatattacrtaagagtcaataatcttacggtaactctgcagtgaaaatgtcatttgttgtaatgaacactgatcataagttaagcctccagctactctctctgttatttttcattatactgttccttgctctgttatatttcaggagtacttggggaattcatccaactatgttcgctagtcagctcttcgttacccagattagattctgctaagatgcaatggagcaatttgcaaacacactgattcttaaggaaatgcatcagacactggttatatattctcctctcctgatgccagcaggcaacct

SEQ ID NO: 69578 - DNA, 601 bp, Human
aactggggttgtccattcaaatgtggttgaagccatagagttgcaatatgccttatggttgtgtgcccaacgttttagacaaaacactgtttctttccaaagagatatatattttttaaatgttgcaatatgtatgcttgaggaaaatagcaaatggcagagaacataaggaggaggccttggatatgaaactaccaacaagtttagtcactttctgagcctggttttcactgaatattacacatgaccatgccagtcattgccaaagacaatcaccaagattctgcctggaggaaggtgyaaactctttttgctctgtccatggtcctgaacaggcagctcccaaggactaactgaaaacatgaataaggggactgagtatatcttcagtcctctgcagctctcccattcacaggctaagctgttctcgaatctgttcagatgggaaccatattacgtaagagtcaataatcttacggtaactctgcagtgaaaatgtcatttgttgtaatgaacactgatcataagttaagcctccagctactctctctgttatttttcattatactgttccttgctctgttatatttcaggagtactt

SEQ ID NO: 69579 - DNA, 601 bp, Human
agttatttatttgatgtctgtttcctgcctcccctgatagaaggttcattcctagagcaccagaaccttatctgtcttgttcagtgtccctgggacacactagaaatgtttgttgattgacttaatgaaagtgtgtatagctgtacttactaggaagtattacaaatatccaaatacatggatcccaactggatcattagtgcctctgagacagggactaggccaacatcacttttgtttctccagtgcctggtgcctcatacacaactgtcaccccaaaaatatggagtgactgaacatmtgagccaagcatcacttcctgatgtcctcaattccacgctcatcaggtgactaccatcagcttcccacctggagctgtctactgaagggatctgtgctgtgcagaccgaggcaagtgttcccgtctttgggggcagttatcctctgtggtggaactccggttcctccaacaacttcttatgttttttcctcagttggctgcagggtttcatttttcttgcctttttgagacagggtctcactctgttgcccaggctggagtgcagtggtgcgatcatggctcaccgtagcctccacctct

SEQ ID NO: 69580 - DNA, 601 bp, Human
cagtcagtgccattgaaagacaacctattccttgcagttcctgagaggaaagagtgtggcataccatgcagggccatgcggggaagtgccaggattggcaaaaaacttttgtcctgacctcttgtaacttgtacttttcccccagggccttggtgaacaaagcttctccatctccttcacctgggaaacgccaaccatccctcaaacccgggcaccactgtcccctcctagacagcatgtgccctcagggccactgcagctctctgctcatgtggtacctgtctggccctacaggagcccmccacatcctgcaccagggattcctggagaacagtctctgggactcacagccacctctgccttcgacaccctactcagccctgaacgatgtgtgccctggggaacctccctcacctcccacagtctgatgtctccatatgcaagaggaagatgaagattcccagctaccatggagagcttgggagaagattaaattagggaaacgctcttgtcccttgggcacacagtaggcatttcagaatgacagctgccgcttctaacctcttaggaagcttctctgacgcaggctaccagggccaac

SEQ ID NO: 69581 - DNA, 601 bp, Human
ggtctcagggttgtgggagataacggtggcatagttccctgatgcccgggccagcttgccacggtctccaggcttctcctccaggcagcacacgattgtaccctcaggcatggtgcccacagggagcacattgccaatgttgagctgggctgcaaggggaagcagcatcaggccgtcagcacagtaagaaacaatgcgaaccccctcgctctaggcaacccgcgaagttgcgagcacagcattcaacatccagcctcccggtacaactctctcggcacccaccggtggccactggtctggycacgcggatgtccccacctgaagcttctgcctgcgaggttcccatatcggcttaggacgttaactcctcaggcaacacccagacccctccccaccccgaccttccttccccgccgcgatgctaacccttcttgccgcaatacacaaactggcccgtgtgaatgccctcggcggcaatgaacagctccgtccgcttcttaaaccgatacggatcccggaagaccaccttggcgaggggcgcgccgcggcccgggtcgtggatgatgtcctgtgggcagaggcggcgtgagtgcggcgttcc

SEQ ID NO: 69582 - DNA, 601 bp, Human
gcaccttcccaatactgcatccaactacccagcaaaaagcccactcgcctccaccctagggagccccttgcaccctgtgagctgacatccagtttcttcaatccacaatgggcaggcaagccaaggccctcacctccatcacctagaatgctggctgagctccaagcgcagggaagcacccccctcaccatgtgtgagacgtcaggccggccactcaacctgacgtaagacacttgattcagcctgccccatctcagctttacttattccaggaacacaacctcagagcctcccctgtgcraggctgagttcatcacaaggattccaagatgttcccaaacagcacagtgagttaacctagactcaaatcctttttcactcactcagtaggcgtctttgagaaagccacaatctctccctgccttctctaaaaaggctgttaaccaactgcatgcaagtgcagcaatcaggaagcccacggtagaatccaagaccctggtgacttcgtcccaatctcatttaacgcctcaacagcagtaaagcaggtactgttgtgcctgttgtacagtgatgacaactgagactacaggatgagctcaaa

SEQ ID NO: 69583 - DNA, 601 bp, Human; identical to SEQ ID NO: 29103

SEQ ID NO: 69584 - DNA, 601 bp, Human
atcccagctactcgggaggttgaggcaggagaactgcttgaacccgggaggcagaggttgcagtgagctgagatcgcactgttgcactcgatcctgggtgacagagggagactctctctcaaaaaagaaaaaaaaaagacagctgtatgaaaggtggctgtctccctccctctccaggtgaatctgggctggaggctgcctttagggcagactgtggtggcagggacggtgccctcctggtctagcccttaaagtgactggcagcttctgccttagcctcctagggctctgagttcctgcmagaagctcaactacaccaacaccaccatgctgccaggaaaaccaagctagccatgctggggacaggggagagtggagggacggtgtgggggtaggggaagacacatctagcctgtccccagctcttcaagtcatccctgtcaaggcttgccctggtggaggagagccaagggctccccacactctgatgaatccctgaaaacctggcttccaggtctgcgattatgataaaagacctcgtttgcatattccagggcagttagttacagagccacgactagactgaccccaggaggatggc

SEQ ID NO: 69585 - DNA, 601 bp, Human
ttcctgtcaaaaatacaaatgtctcatctaaacacctgggaatgtcttggccgggctccgtggctcacacctgtaatcccagcactttggaaggccaaggagggtggatcacttgaggtcaggagttcgagaccagcctggccaacatggtgaaaccccatctctaccaaaaatacaaaaaattagctgggtgtggtggcaggcgcctgtaatcccagctactcgggaggttgaggcaggagaactgcttgaacccgggaggcagaggttgcagtgagctgagatcgcactgttgcactckatcctgggtgacagagggagactctctctcaaaaaagaaaaaaaaaagacagctgtatgaaaggtggctgtctccctccctctccaggtgaatctgggctggaggctgcctttagggcagactgtggtggcagggacggtgccctcctggtctagcccttaaagtgactggcagcttctgccttagcctcctagggctctgagttcctgccagaagctcaactacaccaacaccaccatgctgccaggaaaaccaagctagccatgctggggacaggggagagtggagggacggtgtggg

SEQ ID NO: 69586 - DNA, 601 bp, Human
agaaaaatcatgtcattttagtggatacaaaaaaagcatctgataaaggcattcgtgataaaaactcctagtaaagcaaaaataggaggaaaattttttttttttttgagatggagtctcactttgttgcccaggctggagtgcaatggtgtgattttggctcactgcaacctctgccttccaggttcaagcgattctcctgtctcagcctcctcagtagctgggattataggcgcccaccaccacgtccagctaatttttgtatttttagtacagacagggttttgccatggccaggctkgtcttcaacccctgacctcaagcgatacactcacctcggcctctcaaagcgctgggattacaggcatgagccaccacgccaggcctttgttttttgacatagggcctcactgtctcccaggttggagtgcagaggagcaatcatgtttcactgcagcctcgacctcctgggcttaggtgatcctcccacctcagcctcctgagtagctgggaccacatgtgagtcaccacacctgactaatttatttatttttttaaattttgagacagagtctcactctgtcacccaggctggagggca

SEQ ID NO: 69587 - DNA, 601 bp, Human
ctgttagagaagaggaagccctgcgctatcctgacgcctcgggctcccccaggctgcctctcttatctcctcccttttcactgccctcccagaatgataagaggctgtgtgttctttgctactaggtagctagtttaactagctagcagatttatatgccattgcctcaaggcaagggaaaagtggtttttgttttgtttttttttgttttttgttttttgtttttgagacggagtctcactctgtcacccaggctgaagtgcagtggcgtgatcttggctcactgcaacctctgcctccygggttcaagtgattctgcctcagcctcccaagtagctgggattacaggtgcgtgccaccatgtccggctaatttttgtatttttagtagagacagggtttcaccatgttggccaggctggtctcgaactcctgacctcaggtgatccgcccaccttagcctcccaaagtgctgggattacaggcgtgagccacctcaaggtcatttttcacgatggacttgtgctatggggagggcatcttggaagctggttaagagatacagaagaagcatccacaaaccaatacccatctcacagcga

SEQ ID NO: 69588 - DNA, 601 bp, Human
catccatgatcaagatctggagggcatgggtatggctgtgggatggctgtggggatggcagaggggctgccagttcccgcccccgctcactggccccttacccgccctcggcacgtgacctcctccccctgcatgaggcaggtcccggcggccacgtagcctttgaggcccgacacggtctcctcactgcgcagagacactgtcttcatgcaggtcacatgctcccactcctgcagctcgatcctgtgggggccaggggcctcaggatgctgcctggaggccttgggcagaccccaccccsgccggcccagcctcacctggcattgggaatagcctcccagctgaccggggagatgagctggatggagaaggcctcctgctgggggtggatgtaccgctcatctgtggggaccaagggtgacagtcagagtagggcttccccaagatgcggctgaggatgggagtatggtgtgggcgtcaccacctctctcgatggtctcaaactccttctcctcgccagtcatgcgtgggatgcgggcacacggcgtgttggtgctggtggccacagcatacacctgtgggttagtgagggtcacacacc

SEQ ID NO: 69589 - DNA, 601 bp, Human
ccgcccagggccagcagggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaatgtttttccttgtgttttgtacaaaaagggggtgggaggtagttccgtgtgctggtggtgacggcatccacggggctagaagtgggcggtgacgcggtccgtctccagcaagtcgtccaggatctgcaggggatggaagrgtgggtgggtgggtgggtggggatgcacacggaggggcggggcgcgcggggggcggggcgcgcactcactatgtctggtgtggtgccgatcttcttggctagctcgctgcgctccatggtgctcaggtacaggtagcggttgagcagctccccatccagcacgttgcgcacggcattctggagggtgcggcggtccacgtgcagcatcctggggcgtacaggcacaggtgtcagggcaggctggggtggagggggtgctgcacgcgggcggggccggggctcaccggaaggcgcgggggt

SEQ ID NO: 69590 - DNA, 601 bp, Human
cccaggcatgggctctgagggggcagggcagggtctgaccatggccaagccccgcagcagcctcctggagcagtggccgctcttcaggggttctggtcccgccctgaggcagagctgcccccttccctgttatgtgcagatggcttccggaaagtggtccacatcgagcagggcggcctggtcaagccagagagagacgacacggagttccagcacccatgcttcctgcgtggccaggagcagctccttgagaacatcaagaggaaagtgaccagtgtgagtgccggccctgcacccttgmccggtctcacctgccacagctctccccgcccgcccctccctgagggctcccaccccagcctgccccttcctgagggacctggctgcagtggacgagcctgagcctgccaagctcctaggctgctccagtgactcctgtccctctcgggaatccaggtgtccaccctgaagagtgaagacataaagatccgccaggacagcgtcaccaagctgctgacggacgtgcagctgatgaaggggaagcaggagtgcatggactccaagctcctggccatgaagcagtaggtcccacaccagcatt

SEQ ID NO: 69591 - DNA, 601 bp, Human
ccacgggccctggcaggtcgtgctgcccagacacatggcaggagatggtgagcagggccggcctccacacccccagcccctgcctgcaatgggggctcttgtttttgtatcttgcagtttggctcgcactccacagatgtctagggtcgcccgcctcttcccctgcccctcttcctctccgcatggccaagtccagccagggttagcgctgaccccactggggagggaggagggctctgccagcgctcgggccctcccacacagccgtggaccagacccagcctggccgggcatgagcgtygggcctgggcggcagcagccgagacccctctgtggcgggggctcagtgtcgtcatggctcccctggccacgggcctgtggtcattgcctgtgacagggatgacagggacaggcctccctgctctggcacggcctctggtgttggcaggatccagactgcggtgctgactgcacttcctgtcaggcagggtctccagggcacctctgggacccagcctggctgtccgtcccatagcccaggtgtgccctgtggcctagggctttcttggtcacagccaccagaccgtgggtctcatcccca

SEQ ID NO: 69592 - DNA, 601 bp, Human
tccactgccttccaggccgtcctcgaatgcgctgccccctccagcctgtgcaggcgtacacgggggtgcagcctggggggtacagtcaaggggagcccttctcccacaggagggcattggggtgtggggcctggggcactggttcaggtaccgccttatcccgggccaggaatgagctcagtgaccacttggatgctatggactccaacctggataacctgcagaccatgctgagcagccacggcttcagcgtggacaccagtgccctgctggacgtgagtggagccccgccgccccgcckccccgccccgcctccccgcgcctccccgcctccccgcctcgcctcgccgcctccccgcttccccgcgccgcctccccgcctccccgcgccgcctccccgcctccccgcgccgcctccccgcctccccgcttccccgccccgcccccgggtgctgttctgacttccctccctcctccgcagctgttcagcccctcggtgaccgtgcccgacatgagcctgcctgaccttgacagcagcctggccagtgtgcgtaggcgggcggggggtgagggggaacgagaccagcgggagtgctcacaa

SEQ ID NO: 69593 - DNA, 601 bp, Human
tgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgctatggcctccatgtgtttcctctgtcccagggtggtgcggtgggtggtgctgcaatgaggaggggcccagggcacagaagggccrggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtg

SEQ ID NO: 69594 - DNA, 601 bp, Human
gggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcytgcgctgggcagtggagcaggctttgctgctttatctggcagcaacagtttgttctcgagctccactggccaactgatagggagaggcacaggagcccatgtgggatggaggagtcggccccacacccatccccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgca

SEQ ID NO: 69595 - DNA, 601 bp, Human; identical to SEQ ID NO: 29810

SEQ ID NO: 69596 - DNA, 601 bp, Human; identical to SEQ ID NO: 29811

SEQ ID NO: 69597 - DNA, 601 bp, Human; identical to SEQ ID NO: 29064

SEQ ID NO: 69598 - DNA, 601 bp, Human; identical to SEQ ID NO: 29065

SEQ ID NO: 69599 - DNA, 601 bp, Human; identical to SEQ ID NO: 29066

SEQ ID NO: 69600 - DNA, 601 bp, Human; identical to SEQ ID NO: 29067

SEQ ID NO: 69601 - DNA, 601 bp, Human; identical to SEQ ID NO: 29068

SEQ ID NO: 69602 - DNA, 601 bp, Human; identical to SEQ ID NO: 29069

SEQ ID NO: 69603 - DNA, 601 bp, Human; identical to SEQ ID NO: 29070

SEQ ID NO: 69604 - DNA, 601 bp, Human; identical to SEQ ID NO: 29071

SEQ ID NO: 69605 - DNA, 601 bp, Human; identical to SEQ ID NO: 29072

SEQ ID NO: 69606 - DNA, 601 bp, Human; identical to SEQ ID NO: 29073

SEQ ID NO: 69607 - DNA, 601 bp, Human; identical to SEQ ID NO: 29074

SEQ ID NO: 69608 - DNA, 601 bp, Human; identical to SEQ ID NO: 29075

SEQ ID NO: 69609 - DNA, 601 bp, Human; identical to SEQ ID NO: 29076

SEQ ID NO: 69610 - DNA, 601 bp, Human; identical to SEQ ID NO: 29077

SEQ ID NO: 69611 - DNA, 601 bp, Human; identical to SEQ ID NO: 29078

SEQ ID NO: 69612 - DNA, 601 bp, Human; identical to SEQ ID NO: 22289

SEQ ID NO: 69613 - DNA, 601 bp, Human; identical to SEQ ID NO: 22288

SEQ ID NO: 69614 - DNA, 601 bp, Human; identical to SEQ ID NO: 22287

SEQ ID NO: 69615 - DNA, 601 bp, Human; identical to SEQ ID NO: 22286

SEQ ID NO: 69616 - DNA, 601 bp, Human
tttatatatctgaaaaaatcagagaaaataaaactgccaaacgataatttctattagatgaaggaggtaactgaagctttaatataagtaagagctccaagaaagaaaatgtaaaagaaagaacccacgacctttgtccaaaaaaaaaaaaaaaaaaaattctatttcttatttttatctaaaaaaaattttgagacagggtccccctctgtcacccaggttggagcgcagtgatgcaatcacagctcactgcagctttgatttcctggactcaagcgatcctcctgcctcagcctccacaatacctgggactacagtaatgtaccaccacatctggctaattttcttattttttgaagagacagggtcctgctatgttgcccaggctggtcttcaactcctggcctaaatcaatcctcctaccacggcttcccaaagcaatgggatcacaagcgtgagccaccacaccacaccactgttaaaaaggattctattcaaactcaaactcctacttctatgaagatactttatttggattaaattttcatagtcatttaaaagatttaaaataatttcgaacccatgattacactactaacta

SEQ ID NO: 69617 - DNA, 601 bp, Human
attttacttgattttttttttttcctttttgagatgagatctctgtcacccagactagagtgcagtggcgcaaccacagctcactgcagccaccaacttcctgggctcaagcaatcttcctgcatcagcctcctgagtagctgggactacagggtattcagctaatttttcttctatttcttgtagatacaggggtcttactatgttgcccaggctgatctcgaactctcgggctcaagtgatccacccacctcaacctcccaaagtgctaggattacagccatgagccacagtagccggmcaaatgattttttttttaagagatagggtcttgctatataaggatatatcgtccaggctagaggtgcagtgactattcccaggtgtgaacatagcacagtacagcctcaaatgcctgggttcaagcaatcctcctgccttggcctaccaagtggctaggattacaggtgcacagcaacatgcccagcagatttgtgacaatttgaaaaaacttgcagatgaaccgcatagcctagaaataccaaaaaaattagaaaaaagttatgtatgtcatgaatgctaaaatatatgtagatattat

SEQ ID NO: 69618 - DNA, 601 bp, Human
gcaccattgtactccagcctgggcaacaagagtgagactccgtctcaaaaaaaaaaaagaaacatgaggctattaatgacaactgactacatttaattttttaaaattaagatttacaattcagccttttaaatggacagaatgtacacacagtaaaggcataaggctgaatagaaatatcctattaccacatcagcactatacttaagacacaagtgtagttgtaagagctgggtataagacaggcaaaaggaaacatgaatcactatttcaatgcacttaaaacttaggtatcatattycggtcggcacagcctgtcagaacttaaagctattactaacagttattttggagtatctcccaacttttgtttatttaatagaaacctgagttgctgttaccaacttttgttttaatcaaaataaaaatctatcatgtttccttctctttcctctcctttattttcctccattacctgatccttacccagagagggatagaaatcagtgccactcctgttttacacagcacagtagagacgtcctggctgtttttccatcccttaattccatgttgctatgcatggcgccaaatagtgatc

SEQ ID NO: 69619 - DNA, 601 bp, Human; identical to SEQ ID NO: 22285

SEQ ID NO: 69620 - DNA, 601 bp, Human; identical to SEQ ID NO: 22284

SEQ ID NO: 69621 - DNA, 601 bp, Human; identical to SEQ ID NO: 22283

SEQ ID NO: 69622 - DNA, 601 bp, Human
cacttactctggtggaggtaacaggggtgtgaagtagattctgtgaaggtccttggttgtatttttgttaagtgcgctggttttgtattggctggcctccagccaggagttggcacttacaagagcacatcagctacagttgtataaaactggattttttttaactgaagatccgtgcatatcattatatgttaattttatttcaataaaaataaaaagcatcttattactcatagactgatctcatctcattatttaaactatatctcatatacacattatgttgaagatgaggttttgratcactgaggttttaaacacaggctcttaccttgcaaatccttggggcagttctccaaggccatagagtggataaaggtatgggcttttgccatatcttgccaaagattcactgtaaagtttaattctattaatggtttcataacacggttgatctaagtaactggaagaaaggaaatgagtattaggaaagggctttagttttcattcatggtgttcaatttataattttttttgaagcgatttcaatccgctatcttcttttttgtttttttgttttttgagacagggtctcactctg

SEQ ID NO: 69623 - DNA, 601 bp, Human
taatcaggctctaagctggtactggagagtgtctgcaaagagtcctgtgatgtgatctgtctccaggtctctcaggcgtggataccagcacttactctggtggaggtaacaggggtgtgaagtagattctgtgaaggtccttggttgtatttttgttaagtgcgctggttttgtattggctggcctccagccaggagttggcacttacaagagcacatcagctacagttgtataaaactggattttttttaactgaagatccgtgcatatcattatatgttaattttatttcaataaaaayaaaaagcatcttattactcatagactgatctcatctcattatttaaactatatctcatatacacattatgttgaagatgaggttttgaatcactgaggttttaaacacaggctcttaccttgcaaatccttggggcagttctccaaggccatagagtggataaaggtatgggcttttgccatatcttgccaaagattcactgtaaagtttaattctattaatggtttcataacacggttgatctaagtaactggaagaaaggaaatgagtattaggaaagggctttagttttcattcatg

SEQ ID NO: 69624 - DNA, 601 bp, Human
accttgtgaattctttttctggcaattcagagatttttgtcttggtttagatccattgctggtaagctagtgtgaccttttcagagtgtcaaagaaccctgttttgtcatattaccccagttgtttttccagttccttctcatctggatagactatgtcagagggaagatctggaactcaagggctgctgttcagattcttttgtcccacagggatgctcccttgatgtggtgctctcccctttcccctagggatggggcttcctgagagccaaactgcagtgattgttatttctcttctygatctagccgcccagtggagataatcaggctctaagctggtactggagagtgtctgcaaagagtcctgtgatgtgatctgtctccaggtctctcaggcgtggataccagcacttactctggtggaggtaacaggggtgtgaagtagattctgtgaaggtccttggttgtatttttgttaagtgcgctggttttgtattggctggcctccagccaggagttggcacttacaagagcacatcagctacagttgtataaaactggattttttttaactgaagatccgtgcatatcattatatg

SEQ ID NO: 69625 - DNA, 601 bp, Human
tatatccccacagaaagtgttttacataaaaatttcacagtgccttcattcataatagccaaaaactgaaaactaactagatgtccaccaaaaggagaattatatgctcatataattcatacaaaggaattctactcaacaattaaaaaaaaagaattggccaggcacaatggctcacacctgtaatcccagcacattgggaggccaaggtgggtggatcacttgaggtcaggagttcaagaccagactgaccaacatggtgaaaccccatcactactaaatataaaaaattagccggatrtggtggtgcatgcctgtaatcccagctccttgggaggctgaggcaggagaatcactggaacccagggggtggaggttgcagtgagctgagactgcaccacagcactccagcctgggcaacaagagtggaactccatctccaaaaaaaagaattactgacacatgcatcaatatggatgaatctcaaaaaatgaaaaagacacaaatgagaacatattgtattattccttttacatgaactttgaaaacaagcaaaagtaatctatagtgacagaaatcacagaggtggttgctggggatg

SEQ ID NO: 69626 - DNA, 601 bp, Human
gtcaggggatgggggctagggagggatagcactagaagtacctaatgtagatgatgggttgatgagcacagcaaaacaccatggcacatgtatacctatgtaacaaacctgcacgttctgcacatgtaccccagaacttaaagtataatttaaaaaaaagtataaaagtatgttatgcataattaatctataatgccataaatgatcatgcaaaacttaaataatatggtggcccgaggggctgccttgtaattgaaacatgctttctttcatgcattgactatatgcattttgttaatgygcattttgtttaaataagttgtgtaagagacacacctttctagatgaaactatacgtgtgtgccacactttgcactactaatgatcacctcaagactatcaggagaaatatttaaatttccattttatgaagaaaggaaccaaattattagttatgcttttttaaacaaattaccagtttacataattaataagggtgcattttaagttctaactttgtttattgtataatgtaccatttaaaaataccaaggaggaaatatcctttgcttttaatgatgcatgagtggaagtaatgcta

SEQ ID NO: 69627 - DNA, 601 bp, Human
cacacaccggggcctgtcaggggatgggggctagggagggatagcactagaagtacctaatgtagatgatgggttgatgagcacagcaaaacaccatggcacatgtatacctatgtaacaaacctgcacgttctgcacatgtaccccagaacttaaagtataatttaaaaaaaagtataaaagtatgttatgcataattaatctataatgccataaatgatcatgcaaaacttaaataatatggtggcccgaggggctgccttgtaattgaaacatgctttctttcatgcattgactataygcattttgttaatgtgcattttgtttaaataagttgtgtaagagacacacctttctagatgaaactatacgtgtgtgccacactttgcactactaatgatcacctcaagactatcaggagaaatatttaaatttccattttatgaagaaaggaaccaaattattagttatgcttttttaaacaaattaccagtttacataattaataagggtgcattttaagttctaactttgtttattgtataatgtaccatttaaaaataccaaggaggaaatatcctttgcttttaatgatgcatga

SEQ ID NO: 69628 - DNA, 601 bp, Human
gtgtctgaagtttaaaattgccatgttcaaaggagcttgcttactccagaggagtaacgtttaagaataagcagaggccacttgcgcgtgtgacgtcatggcaccgtgcgtggcagcagcagcagcgcaggtggcaggcccgtggagcagtgctggaggaggaagtggtgaggttgttgctccctctgcgccccgctgctggctcttgaacgcagagaggggccacagtccctgcggctgcatcgcgcttccctgcagtcccctccatgttcccctgcgccactgctccccttcctaaggytgccacttaccccggagtctatgaaaataatggatccctcaacctggctcatcaacagagcagatgaacagaccatttatcagcaactacaaagaagctatttcttgtcacaaaaaggctgcggcatatccttcagaagccgtgaagctgacagtctgagcaggctcatttttcactggaattgcaaaggaataggaaacagcgcctcctcatccaagacaggtggaaaagggcccagcgtgaaaagactgaaagcccagcagaacacaggatgtagctgcccatctcacaaaccctctg

SEQ ID NO: 69629 - DNA, 601 bp, Human
ttcaaatccttaactacctccagaagtgctcacacaggagggaaaagcgaaggaatccaccagaaataaacagctgaaaggctcaaagaggttagcagagattatagaggaaggacagaagaaaaaatgtgtctgaagtttaaaattgccatgttcaaaggagcttgcttactccagaggagtaacgtttaagaataagcagaggccacttgcgcgtgtgacgtcatggcaccgtgcgtggcagcagcagcagcgcaggtggcaggcccgtggagcagtgctggaggaggaagtggtgagkttgttgctccctctgcgccccgctgctggctcttgaacgcagagaggggccacagtccctgcggctgcatcgcgcttccctgcagtcccctccatgttcccctgcgccactgctccccttcctaaggctgccacttaccccggagtctatgaaaataatggatccctcaacctggctcatcaacagagcagatgaacagaccatttatcagcaactacaaagaagctatttcttgtcacaaaaaggctgcggcatatccttcagaagccgtgaagctgacagtctgagcaggctcatttt

SEQ ID NO: 69630 - DNA, 601 bp, Human
ttttcccctcaggcagcaacttccctagtccttgcaacatggtacagctacaacagaagcacaatgcctgcagtcctattgatttgagatgtgacagaatttggggcggccagaggagatgaaaattgtaggggaaagtttcacaaaagagggagcctcaaaagaaggagccaacaaatctatgataaaatatcttcaaatccttaactacctccagaagtgctcacacaggagggaaaagcgaaggaatccaccagaaataaacagctgaaaggctcaaagaggttagcagagattatasaggaaggacagaagaaaaaatgtgtctgaagtttaaaattgccatgttcaaaggagcttgcttactccagaggagtaacgtttaagaataagcagaggccacttgcgcgtgtgacgtcatggcaccgtgcgtggcagcagcagcagcgcaggtggcaggcccgtggagcagtgctggaggaggaagtggtgaggttgttgctccctctgcgccccgctgctggctcttgaacgcagagaggggccacagtccctgcggctgcatcgcgcttccctgcagtcccctccatgttcccctgcg

SEQ ID NO: 69631 - DNA, 601 bp, Human
cccgggtaacaaagcaaaatgctgtctcaaaaaaagatagtaataaagtggggggaaaggcagcactggagaatgacttaaagcagcaaaaaccagagactgaagaaactcttgaaaggaaccaagtgggtgagagctttatgtagtttatatggttttcccctcaggcagcaacttccctagtccttgcaacatggtacagctacaacagaagcacaatgcctgcagtcctattgatttgagatgtgacagaatttggggcggccagaggagatgaaaattgtaggggaaagtttcacaraagagggagcctcaaaagaaggagccaacaaatctatgataaaatatcttcaaatccttaactacctccagaagtgctcacacaggagggaaaagcgaaggaatccaccagaaataaacagctgaaaggctcaaagaggttagcagagattatagaggaaggacagaagaaaaaatgtgtctgaagtttaaaattgccatgttcaaaggagcttgcttactccagaggagtaacgtttaagaataagcagaggccacttgcgcgtgtgacgtcatggcaccgtgcgtggcagcagcagca

SEQ ID NO: 69632 - DNA, 601 bp, Human
tggcatataaataaaactatggacttaaaacactatcagaaggaactgaaggcagtggttcacgcctaatgccaccactttgggaagccgaggccagcagatggcttgaacgcaggagtttaagaccagccttggcaacatgctgaaaccctgtttctacaacaaatagaaaaattaaccaggcatggtggcactcatctgtagtcccagctacccggaatgctgaagtggcagcatcacttgagcctgagaggtcgaggctgcagtaagtcgtgatcacaccactgcactccagcccgggtaacaaagcaaaatgctgtctcaaaaaaagatagtaataaagtggggggaaaggcagcactggagaatgacttaaagcagcaaaaaccagagactgaagaaactcttgaaaggaaccaagtgggtgagagctttatgtagtttatatggttttcccctcaggcagcaacttccctagtccttgcaacatggtacagctacaacagaagcacaatgcctgcagtcctattgatttgagatgtgacagaatttggggcggccagaggagatgaaaattgtaggggaaagtttcacaaaagag

SEQ ID NO: 69633 - DNA, 601 bp, Human
ggcgttcaacccccatacacggttttcttctcccctttccactctcccgcttgctaaccaatcaccggaacagttcctctcggccgcagcggctctgcatccatagcttatccctcctcgctcaccctgatggatggctcttcggggtccacactgagcagacctgagacactaatggccctcctggacaggaggctcgtgagtgtggtgaggctaaagcctaaagccatgcgatgtctgggttttactctgcttcttcaactaaaatcggctctttcccaaaaccccacactgtctattmtcctgtttttccttgtgtgtgtgttctaaaatggccttgtgcagtcgcgggactatccacatcagaggcaaatctgccatttctctggattcacacccaggggaaggggaagggcaagggcaagggcaaggccaagggaagggttgaccagtaatagctatattagtctaatcctctggcatataaataaaactatggacttaaaacactatcagaaggaactgaaggcagtggttcacgcctaatgccaccactttgggaagccgaggccagcagatggcttgaacgcaggagtttaag

SEQ ID NO: 69634 - DNA, 601 bp, Human
ggtgctgtgtgactcggatacattccctagtagtaagagacctctacacctcattttctttggctggaggcgttcaacccccatacacggttttcttctcccctttccactctcccgcttgctaaccaatcaccggaacagttcctctcggccgcagcggctctgcatccatagcttatccctcctcgctcaccctgatggatggctcttcggggtccacactgagcagacctgagacactaatggccctcctggacaggaggctcgtgagtgtggtgaggctaaagcctaaagccatgcsatgtctgggttttactctgcttcttcaactaaaatcggctctttcccaaaaccccacactgtctattctcctgtttttccttgtgtgtgtgttctaaaatggccttgtgcagtcgcgggactatccacatcagaggcaaatctgccatttctctggattcacacccaggggaaggggaagggcaagggcaagggcaaggccaagggaagggttgaccagtaatagctatattagtctaatcctctggcatataaataaaactatggacttaaaacactatcagaaggaactgaaggcagt

SEQ ID NO: 69635 - DNA, 601 bp, Human
tctccttcagattttacaccaattacttttccattctgtacaatgatttcttcaatgggtttattcagcatataggtacctccataaatagcacttagcctggaaaatttttaaaatcccaattaataatatatagttgtttcaactcctaaagtcccctttcttagatcttaatgagttacagacaatatacatttgttcaatttccttctagaaagatgtcagcttagaagtgattaaagcaagaaaacagagtcaaaaacacaaacataatcagttataaatacgaagtcaaaaaaaatcactaaccaggcacttgtctttcgagctgcccactcggccctcctccaagtgtactttctttccttcctttcattcctgccctaaagcttttcaataaacgtccactcctgctctaaaacttgcctcagtctctccttctaccttatgccccttggtcattctttcttctgaggagaaaagaactgaggttgctgcagacccgtacggattcatctcagcacggtaacatattttggtgcctgtgactcggctaccttccaccagcaacacatttggtgctgtgtgactcggatacatt

SEQ ID NO: 69636 - DNA, 601 bp, Human; identical to SEQ ID NO: 22282

SEQ ID NO: 69637 - DNA, 601 bp, Human; identical to SEQ ID NO: 22281

SEQ ID NO: 69638 - DNA, 601 bp, Human; identical to SEQ ID NO: 22280

SEQ ID NO: 69639 - DNA, 601 bp, Human; identical to SEQ ID NO: 22279

SEQ ID NO: 69640 - DNA, 601 bp, Human; identical to SEQ ID NO: 22278

SEQ ID NO: 69641 - DNA, 601 bp, Human
agaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgwcagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgc

SEQ ID NO: 69642 - DNA, 601 bp, Human
cccaacatgggagggatcagccccgcctgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttcccsaaaggggtggcaggataagcctccactgttgtggaaggtaattactgattcattaagcctcccctcacaccttgctcttgctccgggagctgccggaggccgtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcac

SEQ ID NO: 69643 - DNA, 601 bp, Human; identical to SEQ ID NO: 69641

SEQ ID NO: 69644 - DNA, 601 bp, Human; identical to SEQ ID NO: 69642

SEQ ID NO: 69645 - DNA, 601 bp, Human; identical to SEQ ID NO: 30356

SEQ ID NO: 69646 - DNA, 601 bp, Human; identical to SEQ ID NO: 30357

SEQ ID NO: 69647 - DNA, 601 bp, Human; identical to SEQ ID NO: 30358

SEQ ID NO: 69648 - DNA, 601 bp, Human; identical to SEQ ID NO: 30359

SEQ ID NO: 69649 - DNA, 601 bp, Human; identical to SEQ ID NO: 30360

SEQ ID NO: 69650 - DNA, 601 bp, Human; identical to SEQ ID NO: 30361

SEQ ID NO: 69651 - DNA, 601 bp, Human; identical to SEQ ID NO: 30362

SEQ ID NO: 69652 - DNA, 601 bp, Human; identical to SEQ ID NO: 30363

SEQ ID NO: 69653 - DNA, 601 bp, Human; identical to SEQ ID NO: 30364

SEQ ID NO: 69654 - DNA, 601 bp, Human; identical to SEQ ID NO: 30365

SEQ ID NO: 69655 - DNA, 601 bp, Human; identical to SEQ ID NO: 30366

SEQ ID NO: 69656 - DNA, 601 bp, Human; identical to SEQ ID NO: 30367

SEQ ID NO: 69657 - DNA, 601 bp, Human; identical to SEQ ID NO: 30368

SEQ ID NO: 69658 - DNA, 601 bp, Human; identical to SEQ ID NO: 30369

SEQ ID NO: 69659 - DNA, 601 bp, Human; identical to SEQ ID NO: 30370

SEQ ID NO: 69660 - DNA, 601 bp, Human; identical to SEQ ID NO: 30371

SEQ ID NO: 69661 - DNA, 601 bp, Human; identical to SEQ ID NO: 30372

SEQ ID NO: 69662 - DNA, 601 bp, Human; identical to SEQ ID NO: 30373

SEQ ID NO: 69663 - DNA, 601 bp, Human; identical to SEQ ID NO: 30374

SEQ ID NO: 69664 - DNA, 601 bp, Human
taccaacccaccactactccaggttcttggattccagcctggactgaccttggaagaagaggacgccttcagcttgacattctccacggtgacattccacagctgcatccagtggggatgggattccaggaaattcatcttggagcaactttgggtatcctttctccttcttttcaggagggtatacccagactttgtccccctgcattcaaaagtactctctttttgactgtgcatccccagatactgccactctgcatttacacacattttttatctactgtgcttatacgatatcctyctgtggccctacacattctcagtccatctgtggacaacaatgtgctgtccttttgcacattacacactctcagtttgtgcaaatccagtcactattactataacacacatgcctctagctctgtacccagacactcctgtggcacatttatctgcaacactatcagtgttgacaaacatatccacaactgttcatcctgcaatcacccatacgttatttcttcattcatttcttcatttatttattcattcattcattcatccaagaaacagtcactgaataactactatatgccaggca

SEQ ID NO: 69665 - DNA, 601 bp, Human
gtagatgggactataggaacgcactaccacacccgactaatttttatattttttgtagagatgaggttttgccatgttgcccaggctggtctcaaactcctaggctcaagccgctcaagcaatccacctgcctcagcctcccaaagtgctaggattacaggcgtgactcaccacgcccggcctgggtatttttaatataaggtgttctctccatgctgtgggctctctcaacagctatggaacatacatgacatttttcatttaggagttcagtagcattctcattatggccacatggccwtgaagttctgtgatctctagatggcttggtgtctctctctatttctgtgtgtttcctgtggccctgttttcacaatctctcactcactctctctctctttctgcatttcactttgtctgtgtgtcctcccaatgggctcccaccatggctgtgtgttctcttgatacttatgtgttcttactatggcgtatgttctcagtttaatgttgtattttcactacaggtgtgtgtttcatcttagctgtatgttcttattatagtgtgcaatcctgctgtggagatttgctctccatgtggtga

SEQ ID NO: 69666 - DNA, 601 bp, Human
acaaaggatggtaataaatacagagttggatatgcttgtcccagtctctacctcaagcctctcccccaatacacacctggaccagatagagtttttcttcccaggaaaaggcagcatccactgctgaaggaccctggggccactgatgagcaatgggccagctatgccagccatcccggctggtgtccagacgccagtagtgggtccctgtggaataccataggttgctctagggccgctggcagaagcccaggcagagaagaggctagtgatgaatgcagaaatgagtcatgagagggasagaatgcatccagaggccaagatggaagaggccaggtgagaaggagaaatagagcaagacttggtcagcaatgttgggcactgtgccctggctgaaactggaatcagcaggtgcctgaaagaaaggcaagtgtggaaaacagtggctaagtttccaggtaaggccaacatcatggggttggcgggcactccctaaggatttcaggtgtccatgtacagagatgcggttatagataatgaaatacagtgtccagaacttaaaaaggaagcaccacttctactgaatgttctcactctggct

SEQ ID NO: 69667 - DNA, 601 bp, Human
ccctggaggacaaaggatggtaataaatacagagttggatatgcttgtcccagtctctacctcaagcctctcccccaatacacacctggaccagatagagtttttcttcccaggaaaaggcagcatccactgctgaaggaccctggggccactgatgagcaatgggccagctatgccagccatcccggctggtgtccagacgccagtagtgggtccctgtggaataccataggttgctctagggccgctggcagaagcccaggcagagaagaggctagtgatgaatgcagaaatgagtcaygagagggagagaatgcatccagaggccaagatggaagaggccaggtgagaaggagaaatagagcaagacttggtcagcaatgttgggcactgtgccctggctgaaactggaatcagcaggtgcctgaaagaaaggcaagtgtggaaaacagtggctaagtttccaggtaaggccaacatcatggggttggcgggcactccctaaggatttcaggtgtccatgtacagagatgcggttatagataatgaaatacagtgtccagaacttaaaaaggaagcaccacttctactgaatgttctc

SEQ ID NO: 69668 - DNA, 601 bp, Human
agcccacaccatgccatgcctgagaacatggggggcgggggtgtcccagggacactagccctgctctctgagcctgccccctcctcaccacaaagcagaggtagatacaagaggaaggggtggctgcagaaagagaccccaaaacgaagatggagacctagagaaacaggagagagaccaagatagaccaagagaggtgggcacatggggcaacagaccaaattagagagcccagaaatacttgaagagaaaccagaggagaagcccagagaataaagtgggaccactgtacctggagagsaacaagaggaggggccccccacgaggaaagactcggagatctccaacacaggagggagggaagggatcggggagtgggtcccacagagaaagccagtgaagccctgatggaaggagagatttggactctggggtaggttccaggctgaggactgaagtccagatgtttgggtgggaatctgagcgggtgtccagttgaggcttggaatggaggtttggggctttgggtgaggccggctctgaggtggagtcctggatgacagctgggggttcaggtgctccaggtgtgccgggagcccca

SEQ ID NO: 69669 - DNA, 601 bp, Human
acatacagccacatacacacaagttctctacacacacaacagccacacacccagctaccactccacagccacaacactgcctccccagccacacatagcacacaatgccatagacccataattcccataatctccccacaaataatcccactctcgatgacacattcatacacggcacaacacacatgattacacacaagacacacccaacacatgcaacccagcccgtgctacacacagacaggaacactcacacaaacacatacactatagacccacccagcctggacacatcccaccrcaggttgacaccagattgcagtttactcttccctatctcaagccctagccgcccccgtcaagaccagggcagctgggatgaggggctttataagttacaaaagccagtgcccaccacatcatccccccaccacctcagatccctgggcatcgcctgagggcagcacactccacatttaggcccttccacctgagcccacaccatgccatgcctgagaacatggggggcgggggtgtcccagggacactagccctgctctctgagcctgccccctcctcaccacaaagcagaggtagatac

SEQ ID NO: 69670 - DNA, 601 bp, Human
cacccccaacacacacaccgccagctcactggccatcctccactcactcctcaccacaggcacacacagctcatggggagaaaagatcacataattcacacgtcacaccaaaaagtcacccagctcacacaccctcacttcacaccacactcacaccgtctcccaccacgcacctcacacacctctcacctccccagccacaggtgtatgcatccaattaaattcaatacgcacgccacctagacacagagacacatgcagacacaacctgcatagataatgtgcacacctaatgtcacaygtttgtgggcacacacagcccctcagcatagacagcgctgctggcccactgcctcctcccaccccaccccattcccatatgcacgtgtacatgcacgcacacacacacactcacacactcacacacttgtcaactggctcctcacctcagacccctcagccctggctgcaaccctttcctgtccagaatcgcgggagcagccaccacacagacacatgacattcaaacaccagcactcaggtcctaatagatatattacccaagcaatcccaggatgtgccatagtgactctaagccagc

SEQ ID NO: 69671 - DNA, 601 bp, Human
aggatggggactctttctcctccatctgacctggagtgaacacaaatagaactaaatcgaggtcttcctggttgtctccaggggctgcagccacacagagaaggggcgagggcaggtgaacttggagaagtgagtgcttggctgctcggctgctcagccccgctgacatgagccaggaagggcgctgggccactatggactaagactgcatggctggcaaactccaagcccagcctaagctgttcttacaccaacaggcgccaccaaagacaccacccaggcctcactgcctgcgccgtaygcctcccctctgcggagcacgaagtggtgtagtaaacacagtgaccttgctgccacgtgcatcctctccacaccctcctccaaaccaaggccccaaacaccagtcaaactaagagaacaaaggttctcagaccacgacattgcctgccgcccgcctgtccagcgcctgctccgccggaaacccaaaacaaagggcttggtcaaggcaaggaggatgaagggcaaagggtaggggcagctggggttgggggggcatggagaacattccagggcatctctagggacctgatcaggaggggag

SEQ ID NO: 69672 - DNA, 601 bp, Human
gttgcctggggaatggccagcaagatcccttttgccagtcaggccagaaccttcctcagccccaggctgcatttctctgcccaccccaacacccccttcaaggtccagttcaagcctattcatttcagagaaccttctggtatgtgacactgcggcatcgaccccagccccttccctgactgactcagacttctctaagccttccaatctcaaggaaccttggatgtttcttctctcaagcacctgctgggaggcagcccagtagggttttcccacagctctctctggaaggtatgacctygatccccctacagactgcgtcagtctagagggtccccaaaggtgtgaccagctctctcctttcagataagtgtctctgtgaggatggggactctttctcctccatctgacctggagtgaacacaaatagaactaaatcgaggtcttcctggttgtctccaggggctgcagccacacagagaaggggcgagggcaggtgaacttggagaagtgagtgcttggctgctcggctgctcagccccgctgacatgagccaggaagggcgctgggccactatggactaagactgcatggctggcaa

SEQ ID NO: 69673 - DNA, 601 bp, Human
ctcaggacacacacggtgggtagaggagagacccgggcccagcctctgcagagctcacattctggtaggagccagaccccagcaccagagggtgcacatgcggagccccacagaaccaggcgccccagactgggggaaacacagaagggtgggcaactgacagcatggctggacacagaaggtaggagctccatgaggccagtttggccaccaccatgaccccggcacttaaaactgtgcctgcctggtacacagcagtgttccataaagacttttggacaattgcatgagttaacctgccaaatgagacatttgtgaaaggaccctggaatttggaaataactgcctaaaagatgatgaagatgacaatgtcaacgacaatgaagataattccagccagagacaatgggataaaaaaggtaccgtgaaagcttgagaaggctggaggcccagggatggctacccaaagccagacagtgttgcctggggaatggccagcaagatcccttttgccagtcaggccagaaccttcctcagccccaggctgcatttctctgcccaccccaacacccccttcaaggtccagttcaagcctattcat

SEQ ID NO: 69674 - DNA, 601 bp, Human
gcctcatcacccccgcttacctggaccacaccagcctccccttcagtctccacaccatggtccagggagctattgaacatgcagatctgatctgtcatatccgttctctcaactcttccccagggtcaatttccctccagaataagtccgcagtccttaacatggcttacaagtcctgcaccatctggctgggccagctttaccagtccccatccccccggacccagccggctggcacccaggggcctgctccatggagtggtgctgccacaggctctcctccctctgtctgccaccagcraaccttcacagtaaccattctctcccctctgtccagaactttctcctggcttgaccttagctctcagttcagatttgtttcctcctggaagctccccaacatgcccctccctcccactctgggctgaaataggggtccctgctttatatcaccatggcccctgagtttatctccctcgttgccctccccacacactctaccaacatcactccctgtttctccgcctcccctcccccagccctagtacctaggtctgtgccacctgccaaggggctgatgcaacattgctcaggcttggag

SEQ ID NO: 69675 - DNA, 601 bp, Human
agctccctccaccagccctggccactccgtcccctcccctccattcttcagccatttccctgtccaggcctcatcacccccgcttacctggaccacaccagcctccccttcagtctccacaccatggtccagggagctattgaacatgcagatctgatctgtcatatccgttctctcaactcttccccagggtcaatttccctccagaataagtccgcagtccttaacatggcttacaagtcctgcaccatctggctgggccagctttaccagtccccatccccccggacccagccggctrgcacccaggggcctgctccatggagtggtgctgccacaggctctcctccctctgtctgccaccagcgaaccttcacagtaaccattctctcccctctgtccagaactttctcctggcttgaccttagctctcagttcagatttgtttcctcctggaagctccccaacatgcccctccctcccactctgggctgaaataggggtccctgctttatatcaccatggcccctgagtttatctccctcgttgccctccccacacactctaccaacatcactccctgtttctccgcctcccctcc

SEQ ID NO: 69676 - DNA, 601 bp, Human
ctcagaatgtcggaatcacacaaccacgcatccacacagccctggctgggagctgagagtcaaggaatgctagaattgtcccagttagaaccccacagactaacaattccagattctcaaaatcctatactcctagagctagagctcatatatcgcttggagatattgacccccaacttcctccttttacaagtgagaaaatgcagcccagaaaaatggtcttgtgcaagaatacccgagagtgggggccaaggaatgcccagctcagagactgcaagatcggacctcagcattctgatawttcgggaaatggaacagctttcccattctgaaataccagtattgatgttggggcgatactgctcttcagctctgcctgtctccctttgctctcactcccggccctctccattctttcggccacccgaccttcccgctccccctccacaccacgagatctcagcccctcttaccctgagctcccgaaactcccatgcccttcctgtctcccagtggcagcccccagtagaggcaaccgtggatgggaggcatgcaaggccaactcccttagggtgggagacaggaaaggcagaatgcctgc

SEQ ID NO: 69677 - DNA, 601 bp, Human
tctcagaatgtcggaatcacacaaccacgcatccacacagccctggctgggagctgagagtcaaggaatgctagaattgtcccagttagaaccccacagactaacaattccagattctcaaaatcctatactcctagagctagagctcatatatcgcttggagatattgacccccaacttcctccttttacaagtgagaaaatgcagcccagaaaaatggtcttgtgcaagaatacccgagagtgggggccaaggaatgcccagctcagagactgcaagatcggacctcagcattctgatrtttcgggaaatggaacagctttcccattctgaaataccagtattgatgttggggcgatactgctcttcagctctgcctgtctccctttgctctcactcccggccctctccattctttcggccacccgaccttcccgctccccctccacaccacgagatctcagcccctcttaccctgagctcccgaaactcccatgcccttcctgtctcccagtggcagcccccagtagaggcaaccgtggatgggaggcatgcaaggccaactcccttagggtgggagacaggaaaggcagaatgcctg

SEQ ID NO: 69678 - DNA, 601 bp, Human
gaacattgacattaacaaggcaggtggttgcagctcttcccagcagccccatttagaatcattgaatcatcaaaccatcaaatcctagaatcctagattcacagaatgtccgtatctctagctcctagagcctcagcatcttaaagtctcagaatgtcggaatcacacaaccacgcatccacacagccctggctgggagctgagagtcaaggaatgctagaattgtcccagttagaaccccacagactaacaattccagattctcaaaatcctatactcctagagctagagctcatatatygcttggagatattgacccccaacttcctccttttacaagtgagaaaatgcagcccagaaaaatggtcttgtgcaagaatacccgagagtgggggccaaggaatgcccagctcagagactgcaagatcggacctcagcattctgatatttcgggaaatggaacagctttcccattctgaaataccagtattgatgttggggcgatactgctcttcagctctgcctgtctccctttgctctcactcccggccctctccattctttcggccacccgaccttcccgctccccctccacaccacg

SEQ ID NO: 69679 - DNA, 601 bp, Human
aggaagtattcatgtcctgttttccccctcaggctgtcagggaaggggcgggggtgagcagacctctccttcctccactgctgccatttctgcccagagacttcgagggctgggaggaaagggtagttacccctctctctgcccagtctgaaatggttaaggaatagaggccagtgctgaaggaaatgagccccttaccctgcaagctttgggagtggaagctctctcgaatgtacacacaccagttctgttgtgacaggagaaacaacctgtgtgacccaggttgaaaaggtctctattmtctaaggccagcccagcctcttctgtcctccctcactgggagtggagggagcgcccaccattctgagctatctgtctccattgcttcttgttatgtttttaataactgaacattgacattaacaaggcaggtggttgcagctcttcccagcagccccatttagaatcattgaatcatcaaaccatcaaatcctagaatcctagattcacagaatgtccgtatctctagctcctagagcctcagcatcttaaagtctcagaatgtcggaatcacacaaccacgcatccacacagccctggc

SEQ ID NO: 69680 - DNA, 601 bp, Human
cccctgcagcctggacccctccccaactctggcctgggtgccaaggcataagaaggactcaggaggcagtgaaacactggacaattgggctggccttctgccaggctggactgtggccttgcacacaggggaggacctgtcagcacttccagtccctgacctgggactcctttccttgaccccttctcactgtcacccttggggcaagaacagggtcttccctcctcagcctatactgagagggtgctgatgggaccccactggctgtcctggcctctgcccttgtctgagcctttggacrcggggccctcgaaggcaggggttcatgcatttccatgtctgtgtccaggaagtattcatgtcctgttttccccctcaggctgtcagggaaggggcgggggtgagcagacctctccttcctccactgctgccatttctgcccagagacttcgagggctgggaggaaagggtagttacccctctctctgcccagtctgaaatggttaaggaatagaggccagtgctgaaggaaatgagccccttaccctgcaagctttgggagtggaagctctctcgaatgtacacacaccagttctgttgt

SEQ ID NO: 69681 - DNA, 601 bp, Human
gcttctaaggatccatcagggatgggcactctggaaggaaaccctcccctgcagcctggacccctccccaactctggcctgggtgccaaggcataagaaggactcaggaggcagtgaaacactggacaattgggctggccttctgccaggctggactgtggccttgcacacaggggaggacctgtcagcacttccagtccctgacctgggactcctttccttgaccccttctcactgtcacccttggggcaagaacagggtcttccctcctcagcctatactgagagggtgctgatgggaycccactggctgtcctggcctctgcccttgtctgagcctttggacgcggggccctcgaaggcaggggttcatgcatttccatgtctgtgtccaggaagtattcatgtcctgttttccccctcaggctgtcagggaaggggcgggggtgagcagacctctccttcctccactgctgccatttctgcccagagacttcgagggctgggaggaaagggtagttacccctctctctgcccagtctgaaatggttaaggaatagaggccagtgctgaaggaaatgagccccttaccctgcaagctt

SEQ ID NO: 69682 - DNA, 601 bp, Human
tggacagaggctctgctccctaacctgagccccacctccactcctgcccctcaggtgtcccaggggaagtgggggaggctgtgggcaaaaaggaacacccaggactgggaatcaggaagcctgatttcaggccccgttgtgctgtgtgaccagggccagctttggtctgtgaacctaccaggcagcggaagcccttggaactgtgcagctgtactgggcttctaaggatccatcagggatgggcactctggaaggaaaccctcccctgcagcctggacccctccccaactctggcctgggygccaaggcataagaaggactcaggaggcagtgaaacactggacaattgggctggccttctgccaggctggactgtggccttgcacacaggggaggacctgtcagcacttccagtccctgacctgggactcctttccttgaccccttctcactgtcacccttggggcaagaacagggtcttccctcctcagcctatactgagagggtgctgatgggaccccactggctgtcctggcctctgcccttgtctgagcctttggacgcggggccctcgaaggcaggggttcatgcatttccatgt

SEQ ID NO: 69683 - DNA, 601 bp, Human
ggcctccttatccgaagaataaaagggttggacttggtgatctcccagggcccttccaaatctaactttcactggagagaggcttaaacccagagagcgccagagacgagacctcacggggatggggagggcctgagggcaagcggagatgagaagagggaaggggcagcaggaggaagcgggtggcagagtcacgacaggagggcccggggaggcacacttctggcctgcagctggggaggggctccctgccggggacaatggagccttgtggaggactgggggcagctgtcaccaccayacctgcttctggcctgtgggaagaggaagacggagggatgatggacagaggctctgctccctaacctgagccccacctccactcctgcccctcaggtgtcccaggggaagtgggggaggctgtgggcaaaaaggaacacccaggactgggaatcaggaagcctgatttcaggccccgttgtgctgtgtgaccagggccagctttggtctgtgaacctaccaggcagcggaagcccttggaactgtgcagctgtactgggcttctaaggatccatcagggatgggcactctggaaggaaac

SEQ ID NO: 69684 - DNA, 601 bp, Human
cctcagcctactgtgcagctttggacaggaccttcccctctctgacctggcctccttatccgaagaataaaagggttggacttggtgatctcccagggcccttccaaatctaactttcactggagagaggcttaaacccagagagcgccagagacgagacctcacggggatggggagggcctgagggcaagcggagatgagaagagggaaggggcagcaggaggaagcgggtggcagagtcacgacaggagggcccggggaggcacacttctggcctgcagctggggaggggctccctgcyggggacaatggagccttgtggaggactgggggcagctgtcaccaccacacctgcttctggcctgtgggaagaggaagacggagggatgatggacagaggctctgctccctaacctgagccccacctccactcctgcccctcaggtgtcccaggggaagtgggggaggctgtgggcaaaaaggaacacccaggactgggaatcaggaagcctgatttcaggccccgttgtgctgtgtgaccagggccagctttggtctgtgaacctaccaggcagcggaagcccttggaactgtgcagctg

SEQ ID NO: 69685 - DNA, 601 bp, Human
gggatttatggaccccgtgacacgcttgcacatgtttatgtgtctgtgtctgggtgcatgggtgtgcatcccagtcctggaggcctgagctctagtctgtgtcccaaggacagtgtctgccagaggcaggagtcagcagacagcagggatagtgaaggagagaggagctgggcaaagaagaggaagggagggcagctcagggctgtgaagaagggctgaggagagaagccccctaccgcatttctgtaggtgcctgtgtgcttagcgctgatcatcacagtcagttctcaaaccctggacrcctgatgccaagggcagtgtgcacccatgacccagcgctgaagggagcacagcactgggctctgcctcagcctactgtgcagctttggacaggaccttcccctctctgacctggcctccttatccgaagaataaaagggttggacttggtgatctcccagggcccttccaaatctaactttcactggagagaggcttaaacccagagagcgccagagacgagacctcacggggatggggagggcctgagggcaagcggagatgagaagagggaaggggcagcaggaggaagcgggtggca

SEQ ID NO: 69686 - DNA, 601 bp, Human
cagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtcctaaggsgcttcctggaggaggtgtgtgaggcctgacaggaagaggaggacactgggttccagggtggcctcctgatggtctgaccagttttcagctgggatttatggaccccgtgacacgcttgcacatgtttatgtgtctgtgtctgggtgcatgggtgtgcatcccagtcctggaggcctgagctctagtctgtgtcccaaggacagtgtctgccagaggcaggagtcagcagacagcagggatagtgaaggagagaggagctgggcaaagaagaggaagggagggcagctcagggctgtgaag

SEQ ID NO: 69687 - DNA, 601 bp, Human
ccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccgccaataacctaccagtgccctggaggcctggactccatagccgccagttagagaactgctgctggagaaccagggcttctgattcccagacctctgcattgtggggtcagaccaggaccctagtccaggccagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtcctaaggggctt

SEQ ID NO: 69688 - DNA, 601 bp, Human
gccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccgccaataacctaccagtgccctggaggcctggactccatagccgccagttagagaactgctgctggagaaccagggcttctgattcccagacctctgcattgtggggtcagaccaggaccctagtccaggccagcgctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtcctaaggggct

SEQ ID NO: 69689 - DNA, 601 bp, Human
cagccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccgccaataacctaccagtgccctggaggcctggactccatagccgccagttagagaactgctgctggagaaccagggcttctgattcccagacctctgcattgtggggtcagaccaggaccctagtccaggccagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtcctaagggg

SEQ ID NO: 69690 - DNA, 601 bp, Human
ccctccagccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccgccaataacctaccagtgccctggaggcctggactccatagccgccagttagagaactgctgctggagaaccagggcttctgattcccagacctctgcattgtggggtcagaccaggaccctagtccaggccagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtccta

SEQ ID NO: 69691 - DNA, 601 bp, Human
cccctccagccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccgccaataacctaccagtgccctggaggcctggactccatagccgccagttagagaactgctgctggagaaccagggcttctgattcccagacctctgcattgtggggtcagaccaggaccctagtctaggccagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactgaaggagtggccccaggactgaaggggggactcagccttgcccttcgagtcacaggaggaacctaggctcacagagttcagttgtcacaaaggggctagttggatgaagatggtcttcaggggtcct

SEQ ID NO: 69692 - DNA, 601 bp, Human
cagctcccccctcacacctcccaccacccccaggacaggttccctccccccagcagaggcactgcccggaggtggaggcagggtgctggctcctgtccctccccaaccccacctaacttctggttccccctccagccaatttcaagtgtggggaaagtgcctaggatgaggggattcttagctaggtattcccagctccctgtaatcccacctagcctgtgtttatcaccctcctatctcctgtacataggccccccaggccagctcacccctcctggacactggaatctgcaccaacccrccaataacctaccagtgccctggaggcctggactccatagccgccagttagagaactgctgctggagaaccagggcttctgattcccagacctctgcattgtggggtcagaccaggaccctagtccaggccagggctgtgtccaagccaccagccagggaggtcaggggagggtggagtctgctttagggaagactcagcctctcatctgtcaccgcctccccattgtcccacgtcctgtggggacctcagggctctccccacccagcaacaggaagctgagcccctcctgaagacactg

SEQ ID NO: 69693 - DNA, 601 bp, Human
agctgctggccgccatgccagcctggcgcgggtgcaggggctgatttgatttggcagcttcagaatcgtgtggtggggactgggagggggagggggatgagacacccatccctgctagtccctgctaggaaataaacagcctgaggcactccttctgtgagctggggggagggcacagtctggcatggaggaggttctgggttccctgctggtgtccccctcttctcgcctgggcactggatacctgcccacgactactggaatctctggctctccttgggttgaccgtaggggtgacagragctgcacctggtgtgtggaggcttgtggtgtggccgaagcagggcgtctggttgtcccacgtgtccctgtgccctgcagggtcttccctcttagctgcgcctgcagctgggcctgagtgtcacctggagagactgggtctgtgtgtggtgtgatggtctaggtgtggccatctccggcagtgactgtggtgtgtgtctgggcctctatgaggggctgactgcagcccagggtgtggcagggtcacccatgtgcctgactctcctgtagggcctggtatgcactggccctggcctgttcc

SEQ ID NO: 69694 - DNA, 601 bp, Human
tgtgactccagcctccccgtcctcccaagggggagggcaccactcagactgatcttcagtctgcgccccaccccctcaagcccacccacttctccctccactgagctctcacctccagtcggtcgtctctactccctgggggtcctggctcctttgcaagggggtccaggctggctgcagagacaagaaggtcaggggctgaggccggccaggccttctccccttctccccagactgtcctcccattagcccccagcaagcccacggatggccccctcctccagggagccttgcctgcttkcaccctgctctctcccaagactccctccttgttctctgcttcccatgggcacctctggctctgccatattctctgttccttgactctgagaacagagccatattccttctttccacctagggctcctaaggagtggaaatgaccacctctttactctttctgaggcctcctccacttctgcttctctccagggagctctactagccctctctaagcctcagtttctctgtctgtaaaatgggatccgtaatgtccacctcacacagtcactgggcctccacagtgagttgggcctttact

SEQ ID NO: 69695 - DNA, 601 bp, Human
tttcctggcgggtggccgaggctgctgagacactgcaggctcccaggaacaccatctgtcccagctctggggggagccccgccccatggggaatgccatggcagtaaataaattaataatgtggctttccaggccctcccctcccagctccctttgccagctcccagcagcagggcccagccccacttggaggcacattctcaggtcttggccctgtgtcccagcagggaacctgtgctgagcccctcctgtgcaccaggccctgtgtgggcaccttctttcccatcttactcaggggccrggaaagagtgagcctcgagcctgagacacatctaggctccaatcttagctctgtcccaactcacttgctgaatgatccctctgggcctcagcttccccaaatgtgaaataggaataatagcagcccctacctcatgggggtgctgtaataattaaacaaggtgggtgtcaaaggctcctggcacacaggagggctgatacaagcatcatcttcctctccctctcagccaggcctgggcagactctgttctggctgtgggtccagttctctctctctctctcacacacacacacaccctcc

SEQ ID NO: 69696 - DNA, 601 bp, Human
cagatgctaaggccaacttgttggcagccactcccttggggccatggggcattgtagaggccactggctcctgatgtgcagaatccaggaggaagtagcacatctggcagctaggagcactcacttgagaatgttagataagggcctgaaaagtgctgcctacagcgcggcccctccagcctcaccccaggacttgctggtaagctatgctcgtatactcggagccttctcccctcccactcctgcccacactctcgcacaagctgctccttccccagcgaagccctactccacctgcagyggcaatggcaataccccctccaacctggctcccgcccctgcctagtgctacccccgcagctgggcccacatattcactggtggcctcagcctcaccctgactctggcaccaagccttcctcagcccagcactcatgggcagagtgttttggagccgggttctgagcatgagccaacctcctgcagcctcctctggggctgagtccttgctccagcctcctctatctgctttttcccagtcctgttctggtcctggttgtccttagctgctgctgtcagaagctgacctcatggacctctc

SEQ ID NO: 69697 - DNA, 601 bp, Human
gggcctgtgcagcccaacaggggcacagacagatggcagggcctcaggacccccatggatgccagatgctaaggccaacttgttggcagccactcccttggggccatggggcattgtagaggccactggctcctgatgtgcagaatccaggaggaagtagcacatctggcagctaggagcactcacttgagaatgttagataagggcctgaaaagtgctgcctacagcgcggcccctccagcctcaccccaggacttgctggtaagctatgctcgtatactcggagccttctcccctcccmctcctgcccacactctcgcacaagctgctccttccccagcgaagccctactccacctgcagcggcaatggcaataccccctccaacctggctcccgcccctgcctagtgctacccccgcagctgggcccacatattcactggtggcctcagcctcaccctgactctggcaccaagccttcctcagcccagcactcatgggcagagtgttttggagccgggttctgagcatgagccaacctcctgcagcctcctctggggctgagtccttgctccagcctcctctatctgctttttcccag

SEQ ID NO: 69698 - DNA, 601 bp, Human
gccaggggtgtggacagtggatgggcaggcagagagacaggctagagtggcagctgagaccgcctccctggtcccaggtccctgcacgccccgggcctgtgcagcccaacaggggcacagacagatggcagggcctcaggacccccatggatgccagatgctaaggccaacttgttggcagccactcccttggggccatggggcattgtagaggccactggctcctgatgtgcagaatccaggaggaagtagcacatctggcagctaggagcactcacttgagaatgttagataagggccygaaaagtgctgcctacagcgcggcccctccagcctcaccccaggacttgctggtaagctatgctcgtatactcggagccttctcccctcccactcctgcccacactctcgcacaagctgctccttccccagcgaagccctactccacctgcagcggcaatggcaataccccctccaacctggctcccgcccctgcctagtgctacccccgcagctgggcccacatattcactggtggcctcagcctcaccctgactctggcaccaagccttcctcagcccagcactcatgggcagagtgt

SEQ ID NO: 69699 - DNA, 601 bp, Human
tcccagaacagggctccagggcagcctgcacaagctgttacagcaactgaacaactgtggacaggaccagcccaatgctccacgtgaagctgctgaaagcctgaggagtgggagatggagggcagaggacaagggttcgagggtttaaagttgaggaagacttcccagatggagcggctaagagccaggaaacagggaggaggaggaggaaaaggcagcctgaggaggggacaccaggctggaggccggaacctggaggagacaggatggaccaggaagaagaaaggaacatgagagaggyggagggcatttgtggggtttggagaaaacaggcttctctcccatctgctcccacctctccctcagccagcactcaaattcaggctctaggcaggggcctctggcacacccttccctcctagccccacagactccccccagcaagggcgctgccaagctccctctcctcctgccccagccggtctgcaggaaggacacacggaggccagtgcacacgctcttcacacagcctgagataaatatttcccgggaaacggaacttgttctctcagtgtttacagccaaaggccaggcaggacgg

SEQ ID NO: 69700 - DNA, 601 bp, Human
ctttccatcctcccctggtccaccaacctggatcccccatgtgtctgcactggtgctggctctactgggatggacagaggagatcagctccgggcctcgccccagccccagggtgcccagacctgtgcttcccagaacagggctccagggcagcctgcacaagctgttacagcaactgaacaactgtggacaggaccagcccaatgctccacgtgaagctgctgaaagcctgaggagtgggagatggagggcagaggacaagggttcgagggtttaaagttgaggaagacttcccagatgragcggctaagagccaggaaacagggaggaggaggaggaaaaggcagcctgaggaggggacaccaggctggaggccggaacctggaggagacaggatggaccaggaagaagaaaggaacatgagagaggtggagggcatttgtggggtttggagaaaacaggcttctctcccatctgctcccacctctccctcagccagcactcaaattcaggctctaggcaggggcctctggcacacccttccctcctagccccacagactccccccagcaagggcgctgccaagctccctctcctcctg

SEQ ID NO: 69701 - DNA, 601 bp, Human
tgtcacacacgtggtagcatgcaatgtgcaatgtcacacactcggtgtcagcatcacacaatcaatatcacacagtgttacacacttggtggcacagccactgtacacatctgctatcatggagtgcctcacagccagtgtcacatactcagtgactcacccacactccacacagtaccctatgatcatggtcacgtacttgatattacacgtcataagctccgtgtcacatgtgcagaacgccccctgtcccacagtgtctcagtgtccctcttggcatcaccctgggtcccacaagctyggcccctcgtccccaccccaactgggcacagtcgccagggctgttgccccatgtcacggctgtttcctgttgttgtgctcagagtcctcagcctctgcttgttccttcaaggatttcctgttgtcagggcccctggcaggcctggcctgtctgggatacacacccctaagcccagaggctggccagcaggaaccctgggccctctgcctccccactccaacattccggctggatccatgggactttccatcctcccctggtccaccaacctggatcccccatgtgtctgcactggtgctg

SEQ ID NO: 69702 - DNA, 601 bp, Human
atgcctttgtttacacactcagcctcactagatcatatgcttgggacacactcaatgtcacaattcagtgtcagacactcgagccacagactcaggaccatacctgctactgcagcgtcatttgctcacgtttctgtatttgattctcatggagacacaccctccatgtgctcactgtcactttcagtgtcacacacgtggtagcatgcaatgtgcaatgtcacacactcggtgtcagcatcacacaatcaatatcacacagtgttacacacttggtggcacagccactgtacacatctgytatcatggagtgcctcacagccagtgtcacatactcagtgactcacccacactccacacagtaccctatgatcatggtcacgtacttgatattacacgtcataagctccgtgtcacatgtgcagaacgccccctgtcccacagtgtctcagtgtccctcttggcatcaccctgggtcccacaagcttggcccctcgtccccaccccaactgggcacagtcgccagggctgttgccccatgtcacggctgtttcctgttgttgtgctcagagtcctcagcctctgcttgttccttcaagga

SEQ ID NO: 69703 - DNA, 601 bp, Human
taatttttgtatttttagtagagatggggtttcaccagactggtcttgaactcctgacctcaggtgatccacccagctcagcctcccaaagtgctgggattataggtgtgagccactgcatccggccagagcaatcttttaaaaccatcctttggacggtgttactttcccgcctgaacccatcggtgccttcccatgacagtgtcctacacagcactgtatgtgcacattgcatactgttacaaccattacagagcatcacacatgtaatgtcaggcccaagatcacacagcatcacacrcccacttccacacacttgctatcactccatgtcatgcctttgtttacacactcagcctcactagatcatatgcttgggacacactcaatgtcacaattcagtgtcagacactcgagccacagactcaggaccatacctgctactgcagcgtcatttgctcacgtttctgtatttgattctcatggagacacaccctccatgtgctcactgtcactttcagtgtcacacacgtggtagcatgcaatgtgcaatgtcacacactcggtgtcagcatcacacaatcaatatcacacagtgtta

SEQ ID NO: 69704 - DNA, 601 bp, Human
ctctaactcttctgccattccattaacacaggcaccaccatctcctgcctgggcagctgcaggagcctccagttgctctacccaccttctctctgcctccccctaacttatctcccctcccctgccacgcaccatgcacactcgcacacatacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccragcagctgagattacaggcgcctgtcaccatgcctggctaatttttgtatttttagtagagatggggtttcaccagactggtcttgaactcctgacctcaggtgatccacccagctcagcctcccaaagtgctgggattataggtgtgagccactgcatccggccagagcaatcttttaaaaccatcctttggacggtgttactttcccgcctgaacccatcggtgccttcccatgacagtgtcctacacagcactgtatgtgcacattgcatactgttacaaccattacagagcatcac

SEQ ID NO: 69705 - DNA, 601 bp, Human
gccagaaccctggaaattgttctctggttttccctcttgctcatcttctcatttatcagcaagttctgtcatttctgttttcaaatatctccaaagttgctccatatctctaactcttctgccattccattaacacaggcaccaccatctcctgcctgggcagctgcaggagcctccagttgctctacccaccttctctctgcctccccctaacttatctcccctcccctgccacgcaccatgcacactcgcacacatacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccgagcagctgagattacaggcgcctgtcaccatgcctggctaatttttgtatttttagtagagatggggtttcaccagactggtcttgaactcctgacctcaggtgatccacccagctcagcctcccaaagtgctgggattataggtgtgagccactgcatccggccagagcaatcttttaaaaccatcctttgg

SEQ ID NO: 69706 - DNA, 601 bp, Human
ccatctcagaaacatcttcaccatccatcgcttggttcttcaagccagaaccctggaaattgttctctggttttccctcttgctcatcttctcatttatcagcaagttctgtcatttctgttttcaaatatctccaaagttgctccatatctctaactcttctgccattccattaacacaggcaccaccatctcctgcctgggcagctgcaggagcctccagttgctctacccaccttctctctgcctccccctaacttatctcccctcccctgccacgcaccatgcacactcgcacacayacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccgagcagctgagattacaggcgcctgtcaccatgcctggctaatttttgtatttttagtagagatggggtttcaccagactggtcttgaactcctgacctcaggtgatccacccagctcagcctcccaaagtgctgggattataggtgtgag

SEQ ID NO: 69707 - DNA, 601 bp, Human
ctcccccttgcctttgcccatctcagaaacatcttcaccatccatcgcttggttcttcaagccagaaccctggaaattgttctctggttttccctcttgctcatcttctcatttatcagcaagttctgtcatttctgttttcaaatatctccaaagttgctccatatctctaactcttctgccattccattaacacaggcaccaccatctcctgcctgggcagctgcaggagcctccagttgctctacccaccttctctctgcctccccctaacttatctcccctcccctgccacgcaccrtgcacactcgcacacatacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccgagcagctgagattacaggcgcctgtcaccatgcctggctaatttttgtatttttagtagagatggggtttcaccagactggtcttgaactcctgacctcaggtgatccacccagctcagcctcccaaagtgct

SEQ ID NO: 69708 - DNA, 601 bp, Human
cactcggtttctgcctccttgtcctcccaccccactagtgctgaccctcccccttgcctttgcccatctcagaaacatcttcaccatccatcgcttggttcttcaagccagaaccctggaaattgttctctggttttccctcttgctcatcttctcatttatcagcaagttctgtcatttctgttttcaaatatctccaaagttgctccatatctctaactcttctgccattccattaacacaggcaccaccatctcctgcctgggcagctgcaggagcctccagttgctctacccacctyctctctgcctccccctaacttatctcccctcccctgccacgcaccatgcacactcgcacacatacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccgagcagctgagattacaggcgcctgtcaccatgcctggctaatttttgtatttttagtagagatggggtttcaccagactggtcttga

SEQ ID NO: 69709 - DNA, 601 bp, Human
tgtatccctagcctggccccgctgcccactgcacaccttcacctggatgcttcccttaacacatccaaaacagctcactcggtttctgcctccttgtcctcccaccccactagtgctgaccctcccccttgcctttgcccatctcagaaacatcttcaccatccatcgcttggttcttcaagccagaaccctggaaattgttctctggttttccctcttgctcatcttctcatttatcagcaagttctgtcatttctgttttcaaatatctccaaagttgctccatatctctaactcttcygccattccattaacacaggcaccaccatctcctgcctgggcagctgcaggagcctccagttgctctacccaccttctctctgcctccccctaacttatctcccctcccctgccacgcaccatgcacactcgcacacatacatattctgcaacctgagcaatctttttctttttttttttttgagatggtatttcactcgtcacccaggctggagtgcaatggctcaatcttggctcactgcaacctctgccccctgggttcaagtgattctcctgtctcaacctcccgagcagctgagat

SEQ ID NO: 69710 - DNA, 601 bp, Human
cagatactacattattccaattacttgaggtatctagagtagtccaagtcatagagacagaaagtagaatggtgggtgccaggagctggagacagaggaggatgggggctgtcgtttaataggtgcagagtttcagtttgagaagatgaaagagttccagagattggttgcaaaacagtgtgaatgtacctaccacaactgaactgtacacttagaaatggttatgatggtaaagtttaagttatgtatattttaccacaatttaaaaaattttaagcttaagcaaaggaaaatgaaagawcagatagggggcaagagaggaagaaatgaggccaaatcccagcaactgttgaactggggtgatgagtatatggcagtttcttatatgcttctctctggtattgtgtctgcttagaatcacccataataaaaaaatgtaatctccctttccagcgatcatgtccttctctgcagccctcacagcccaacgtctccaaagggctctccaggctaacgtcttcacctccctcaccatcctacacaggccagtctgacttctggctccagcccatcactgaaatggctcccattagcctgactc

SEQ ID NO: 69711 - DNA, 601 bp, Human
caccaagcaggggacagaagttgggggagagggagagaggagggctgtgggtgtaagaggacacctcactcagcgcaccttcactgtgctcctactggtgctcctgttatttggggacctggggtgcaggtgttgaggttgctgctccccaagagaccatagagtatttaccaagtgccagagactgcatgcattggagcactgcttcatgcaatcctcctaagagctcccattttatacttgaggaaattgaggctcaagagataaaatgacctgctgaatgtcagagcctagacagggstgtctgacaccacaggccctgctcttaatcagcacctacaacatcctgctgaagtgcccacatcctgcctccaggaagccttcctgggtattcagagaagggaggagctcgcatctgggcacagacaccatttctgttcccattcagtgtttctcctcatctaccctacaatgtccatgctccctcccatactcagcagctgaagctggggctgagcccacttgaatcacatgcagcccggtcacctatagcacagcttcagtccctcttactcccatgcagagtcctgcactgtgtcac

SEQ ID NO: 69712 - DNA, 601 bp, Human
tatgtaggtctgtgtctctgtaggaatctgtaacccacatgggtcgtgagagtgtaaacatgtgtgagtaccctgtgtctatgtgtgtgcactggccatctgcacgtgggagtgaccatgtgggcctgcatctatgcatatgtgattcaggtcattgatgtccatgtgacagtggtatagtcagtatgtggctgtctggggggctgtgaatgcgctggtggttagtcttgtctccaaatgagtgagtgaacgtgtggctgagagtggtggaatctgagagggtctaattctcctcctctgygcacccctgtcacttctcccatcgcctccctcagatgcgggctcatctgcctgccctgccacacaccacatgtactggacaagtctttggaccttcctgggctcagttcctcatccgtaaaatggtctcttcccccagagctgctgagaagattaagctgagccatcaaaccttgcctaagctgactcccagcagggggctggggccacctgtgtgcacattagaaaggagggaccccaattctctgggcagatgcgggcctgaggggaaaggcttggtgagggagagtgggctcagttt

SEQ ID NO: 69713 - DNA, 601 bp, Human
ctgcccattaatggtccatagtggcgagcccctacggaccatcacatcatcatggcagactatgttccctgggtcactgggagaatttccttgtgaaagtatgtaggtctgtgtctctgtaggaatctgtaacccacatgggtcgtgagagtgtaaacatgtgtgagtaccctgtgtctatgtgtgtgcactggccatctgcacgtgggagtgaccatgtgggcctgcatctatgcatatgtgattcaggtcattgatgtccatgtgacagtggtatagtcagtatgtggctgtctggggkgctgtgaatgcgctggtggttagtcttgtctccaaatgagtgagtgaacgtgtggctgagagtggtggaatctgagagggtctaattctcctcctctgcgcacccctgtcacttctcccatcgcctccctcagatgcgggctcatctgcctgccctgccacacaccacatgtactggacaagtctttggaccttcctgggctcagttcctcatccgtaaaatggtctcttcccccagagctgctgagaagattaagctgagccatcaaaccttgcctaagctgactcccagcagggggct

SEQ ID NO: 69714 - DNA, 601 bp, Human
ttgtgaatctgtgggtgccttagaaccccaaagccttgaaaagatgatgatgccctcccaccagaccctcggaccctctatacaattcaaactaaattttatcttggaaatgaaaattaaaatagtttttgtgtggtttttctgattgcaaaattctggatacactcatcagaactgacctctcctctcactctgtgcagaactcccgctttgctggggacctaagcatgtgtgcagcctgcccattaatggtccatagtggcgagcccctacggaccatcacatcatcatggcagactaygttccctgggtcactgggagaatttccttgtgaaagtatgtaggtctgtgtctctgtaggaatctgtaacccacatgggtcgtgagagtgtaaacatgtgtgagtaccctgtgtctatgtgtgtgcactggccatctgcacgtgggagtgaccatgtgggcctgcatctatgcatatgtgattcaggtcattgatgtccatgtgacagtggtatagtcagtatgtggctgtctggggggctgtgaatgcgctggtggttagtcttgtctccaaatgagtgagtgaacgtgtggctgagag

SEQ ID NO: 69715 - DNA, 601 bp, Human
ctgggatatcttgtgggactgttgtgaatctgtgggtgccttagaaccccaaagccttgaaaagatgatgatgccctcccaccagaccctcggaccctctatacaattcaaactaaattttatcttggaaatgaaaattaaaatagtttttgtgtggtttttctgattgcaaaattctggatacactcatcagaactgacctctcctctcactctgtgcagaactcccgctttgctggggacctaagcatgtgtgcagcctgcccattaatggtccatagtggcgagcccctacggaccaycacatcatcatggcagactatgttccctgggtcactgggagaatttccttgtgaaagtatgtaggtctgtgtctctgtaggaatctgtaacccacatgggtcgtgagagtgtaaacatgtgtgagtaccctgtgtctatgtgtgtgcactggccatctgcacgtgggagtgaccatgtgggcctgcatctatgcatatgtgattcaggtcattgatgtccatgtgacagtggtatagtcagtatgtggctgtctggggggctgtgaatgcgctggtggttagtcttgtctccaaatgagt

SEQ ID NO: 69716 - DNA, 601 bp, Human
cccactcccagcctttgctcctccgtttcctgcactgtggtgtcctctcttctctcctgctcttcctgctctggccctccagaaacccccagccctctcccctggtcttgtcctccccctatcactgggactctcatccttctcccgtccccctcacagagcaagcaaggggctgagccacagggccctgggcaggtggggcaccaaggcacagagccctcctccagtgagggagagagttggcggagacatggcaggctctggggccccacgcactcccctgaacccagaccttctttgycccccttcatgtgccctccccagctttggttgtcttttctggaccccgggcctgagtctctgtctctctaatcagtctccaggagaaagcccatccagtctcatctccttcccacctccatttttcagatgagagagccaagccccagagaggggaggcgatgggcctacgagcccatgggacgctggccatgggccttggtcactctgcctcattacacagggtcccggtcagtggggccacaggggctgaggcaggctgtcatacagcccacctcccaaaacagcccacctctccacc

SEQ ID NO: 69717 - DNA, 601 bp, Human
gaggaggcagggaaggattcacccaggctctcatctggagccaggagacccatgcttcagcccagccctttgggccacactaggacaccttgtcccagagtcctgcttgtctttggggcccctctaatacctgccttggccaggggatgggctgagccctctcagatgtcgggtaaggctgagtatctgcctccaggccagagactgggtctcttatgtcctcactgtgcccattgtgtgtgggaggtaaatgctgaaggaggcggcctggcctagggttagtgtgggcctgcagagggcrgggaggaagggccagcctggggtagggctggtggggtggatggcgggaggcaagcccagccatgctggtcttcttagggacaagatagagagcagggcacagaggctggctgcccggtgatgcctgccctggggctctccctgactgtcccagcgtgttttctccctgcctctcagcctccctgggcgctctctctgtgcctggccacctctctctgtctgtgctctgcggcatgtgtgtatcccacagcctcccgctgctttgtcctatgactgtatttggctctctcaacagagcttg

SEQ ID NO: 69718 - DNA, 601 bp, Human
gtccaatcccaagcttgatggggtagactaaggccagaggaggcagggaaggattcacccaggctctcatctggagccaggagacccatgcttcagcccagccctttgggccacactaggacaccttgtcccagagtcctgcttgtctttggggcccctctaatacctgccttggccaggggatgggctgagccctctcagatgtcgggtaaggctgagtatctgcctccaggccagagactgggtctcttatgtcctcactgtgcccattgtgtgtgggaggtaaatgctgaaggaggcrgcctggcctagggttagtgtgggcctgcagagggcggggaggaagggccagcctggggtagggctggtggggtggatggcgggaggcaagcccagccatgctggtcttcttagggacaagatagagagcagggcacagaggctggctgcccggtgatgcctgccctggggctctccctgactgtcccagcgtgttttctccctgcctctcagcctccctgggcgctctctctgtgcctggccacctctctctgtctgtgctctgcggcatgtgtgtatcccacagcctcccgctgctttg

SEQ ID NO: 69719 - DNA, 601 bp, Human
ggaataattgaatgggtggatggatgaatgacgaatgaatgaatgaagtgatctcccttctctggatcccctccagggagagtctgttgttgttctctctccaggcaagtctgaccctcccacctggggctcccactgcccccctttcccccaccatggcatgcactgtgtgcatcaatgcagtgccaccctttcccgtctggctcccacaacagactgggagcttttggagggcagagattgtgtcctgcccctctccaggtctccagcattacccagcccctcataggtgttggtaggygtttgctgagctgtaaatgactgggtaaactcctgtgtgcccaggactactgtactgtgagggctacatgccatcagggagaagaggggtgtggaggaaggatctaggcaggggagatagctgagacctctcaaagcctccccagtctggcacagttacagtctcagagaaggagcctgaggaatggggtgtctcctactgagagcctttggcaacctctcccaggcacctctgcaggccgggaggccctttgtgcttcaggatcatctccacgtgcagaccgggtgggggcagcaggtc

SEQ ID NO: 69720 - DNA, 601 bp, Human
gtctcctcccaccccctcccaccttcagctgcttcatctacagggaagaaccgagagtggtcccatttctgctgcccacattctcctggacaccacaaacttcctcccaaacacatcacagcatccccctctccatgccatcacagtcatcctggtcacctggcattctagctatccttgtcctctggcctggggcccacgaggcagctcgcggcagtcacaaggaggcagatttgggcacactgtgaatcagagtcgcgccacaaaagagagcctgagcaggatggatgagggggctccyagtccccaagggtgtgcaagcaagggccaaggccctgccaccagggagcctgtgccctgagaaaggcccctggtgaggtggcaggcctccagctctgagtttggtgaccctgaatgtctgtacaccctcctcagcctcaccccctcagggtgggttgggagctgagcaaagcaagtccaggagcctccaagaggcaggcatggtggctcaagcaggagaggaggaggacgctgagtgtcccgctgggtcagtgtcagaagagagtttacatccctcaggaaatgatggccaaaggaataa

SEQ ID NO: 69721 - DNA, 601 bp, Human
agttttgtcattactaaaaaatggatctttctagctctgcagcatatagttctatggtttaattcaatgaggctggatggatgagtgggtaggtggatagatgaatgggtgcaggatgggttgggggagggatggtggatggatgggtgggtggatggtgggtggataggtagatgggtggctgggtgggtgggtagatggatagatggagcctttctgctctctccagctccacctgcagctctgtagtccaaggtaaggccagtcagcaccacagacagcaccattaccacggacttakctttcattcaccccaggtaccaagaaaggggagcctgttctgagtcaggcctcctctgaagccagggttggggctcagccgtgggctagatctgcatttctgcacttatctggggagaggagagggtctggactaaattacttctaactcgttcttaaagcctaagattctatgaaaccagagaccttggtcttatcccctttggagccacaagcacaagaccaacgcccttcctgagggttggggtcgctgccataagatctttcctgtttcatcttcatgagtctctatgcctttccc

SEQ ID NO: 69722 - DNA, 601 bp, Human
gagcctcagttttgtcattactaaaaaatggatctttctagctctgcagcatatagttctatggtttaattcaatgaggctggatggatgagtgggtaggtggatagatgaatgggtgcaggatgggttgggggagggatggtggatggatgggtgggtggatggtgggtggataggtagatgggtggctgggtgggtgggtagatggatagatggagcctttctgctctctccagctccacctgcagctctgtagtccaaggtaaggccagtcagcaccacagacagcaccattaccacrgacttagctttcattcaccccaggtaccaagaaaggggagcctgttctgagtcaggcctcctctgaagccagggttggggctcagccgtgggctagatctgcatttctgcacttatctggggagaggagagggtctggactaaattacttctaactcgttcttaaagcctaagattctatgaaaccagagaccttggtcttatcccctttggagccacaagcacaagaccaacgcccttcctgagggttggggtcgctgccataagatctttcctgtttcatcttcatgagtctctatgc

SEQ ID NO: 69723 - DNA, 601 bp, Human
gactaaaaaggggaggaagagctgatgcccccagtactcccaagataaagtcttccagatgcacgctccccagacgggggctctaaagacagcacagaaggtggtgttggtttgtgtctattccttcttggaggcagaggagcccacaagctgactcctgagaggccctgcccttggtggagtctgatgtatgtgatgtggacttggggaagagagacccaggtgacggagtgagcctgatacagggggagaaattcttcaaagccacagccttcagagagctaagtctccccatttgacygatgaggaagctgaggttcaatgagaagcaatgatcaacctgtggtcagacagccagtcagagcagagccaggtccagaacccaaacctctggatctctagccctgtctggttcctgctcagcacccgatccccagctcccaccctagggtgctcagaaagaacagtctgtcctttattctgattggtggactcctcaacctgccctttgcttcaattggggaatgccctcaactgtcctttactggaattggtgggtgcctgcctgacctttgctctgattgttcagttttctgtgact

SEQ ID NO: 69724 - DNA, 601 bp, Human
cagctgggccacccctggcaactataggaggagaaggagacgtcagccttgactgtctcacagccttcccatcccaggaacagaactcgtccttgcagagccggaacggagacaaaagtccctgcttctcgctctattaacttggccagagccatggggatcaaagagaaaggtaacagaacaaaggaaacgagggccaaggcaagatcgtgactcataccagccaccagccatgccctcccgcaagcccttggaagtcctttcagatgtcttcccagtggaaggttgggtctgtgttcaraaagcaaagtgattaactgcaagatgaaggagacatggctgggtccccattcatgtgaacatgatatgaggttgagggtcttaaaagaccacagttcagcatgagcccacagtgtaagcatgactggcaagaaataaaaatgctcaaactgcaggccatattaatagaggtctgttaacccaattgggaagatgacagttcccccacttttatagtctagttagaccatcccctgttcattgtgtcccaggggctgacaagatgacactcatccagaggaggcgacctatgaaacgaggg

SEQ ID NO: 69725 - DNA, 601 bp, Human
ctcgggggagcacagctgacagggcctccttgacagcacgttgcaggcctgaaatgtcgatgacagagcccagactcagcaaggcgtcctggaagagaggagagggcagtgagaggctttgccaggcaggccagggcagccccatctgcccaaaggactgtgagcaaaaccccccagcttagtccagagcccgagtctttcaggcacaggaatcccaggatcttaggatctcaaaatcaaacagtcttaaggccacagaatgtccaagtaccctcatcttacaggtggggaaactgaggcrcagagaagggccagggacttagcaaaggcctcatagtgagtcaacaggtcaagcctggcctagaccccaggtctcttgttctctagtcgaggacaattctggcacagtagggaaaccacaaggctccaaattaaaacaaaacaagcaaacaaaaaaacacccaaatttgaatcctagctccgctgtgtatgagcagtgagtgtcttggttcagtcactgagcctcagtctcctatctgtaagttggaagcagctggggctattgccccctacaggctgacatgaagataaaatgaaattg

SEQ ID NO: 69726 - DNA, 601 bp, Human; identical to SEQ ID NO: 25343

SEQ ID NO: 69727 - DNA, 601 bp, Human; identical to SEQ ID NO: 25344

SEQ ID NO: 69728 - DNA, 601 bp, Human; identical to SEQ ID NO: 25345

SEQ ID NO: 69729 - DNA, 601 bp, Human; identical to SEQ ID NO: 25346

SEQ ID NO: 69730 - DNA, 601 bp, Human; identical to SEQ ID NO: 25347

SEQ ID NO: 69731 - DNA, 601 bp, Human; identical to SEQ ID NO: 25348

SEQ ID NO: 69732 - DNA, 601 bp, Human; identical to SEQ ID NO: 25349

SEQ ID NO: 69733 - DNA, 601 bp, Human; identical to SEQ ID NO: 25350

SEQ ID NO: 69734 - DNA, 601 bp, Human; identical to SEQ ID NO: 25351

SEQ ID NO: 69735 - DNA, 601 bp, Human; identical to SEQ ID NO: 25352

SEQ ID NO: 69736 - DNA, 601 bp, Human; identical to SEQ ID NO: 25353

SEQ ID NO: 69737 - DNA, 601 bp, Human; identical to SEQ ID NO: 25354

SEQ ID NO: 69738 - DNA, 601 bp, Human; identical to SEQ ID NO: 25355

SEQ ID NO: 69739 - DNA, 601 bp, Human; identical to SEQ ID NO: 25356

SEQ ID NO: 69740 - DNA, 601 bp, Human
gcctgtggacctcctacctgtgccccaaggccccacacaaatgctttctctgtgatgaggtaccacttgctgctccaggctttgccaccagaacacctgctggcaacagtatttcatctggcctgtggtggggagggtgtccctgccttcccccagactgagagctccctgaaggcagagtcggctccagcacccagcctgccgcaggaccagaccagagttctactgggtgagttaagtgtaagtgatctgatcccaccagcgtccctgagacacacacacacacacacacacacacaccttggcctctggcccagcctgagccaaggtgagcagcggccatggcaagcattccgcccacaagggaagcaaccttccaaatgtcttccccttacttccctcctgacccagtcctcatagcctcaatctaaggaagtccttctcaggcacctggcaccccaggccctttgccctcagcagagaaggaggtgcgtgacccagccaccacctcccaatccccacctctgcacacagcccctcacctcagtgcccctcaaagctgaccagccctggggcagaccaagagcaaagaataggggga

SEQ ID NO: 69741 - DNA, 601 bp, Human
tcctcctctgcctagaatcccctttcccttcttccctgcctgtggacctcctacctgtgccccaaggccccacacaaatgctttctctgtgatgaggtaccacttgctgctccaggctttgccaccagaacacctgctggcaacagtatttcatctggcctgtggtggggagggtgtccctgccttcccccagactgagagctccctgaaggcagagtcggctccagcacccagcctgccgcaggaccagaccagagttctactgggtgagttaagtgtaagtgatctgatcccaccagcrtccctgagacacacacacacacacacacacacacacattggcctctggcccagcctgagccaaggtgagcagcggccatggcaagcattccgcccacaagggaagcaaccttccaaatgtcttccccttacttccctcctgacccagtcctcatagcctcaatctaaggaagtccttctcaggcacctggcaccccaggccctttgccctcagcagagaaggaggtgcgtgacccagccaccacctcccaatccccacctctgcacacagcccctcacctcagtgcccctcaaagctgac

SEQ ID NO: 69742 - DNA, 601 bp, Human; identical to SEQ ID NO: 25357

SEQ ID NO: 69743 - DNA, 601 bp, Human; identical to SEQ ID NO: 25358

SEQ ID NO: 69744 - DNA, 601 bp, Human; identical to SEQ ID NO: 25359

SEQ ID NO: 69745 - DNA, 601 bp, Human; identical to SEQ ID NO: 25360

SEQ ID NO: 69746 - DNA, 601 bp, Human; identical to SEQ ID NO: 25361

SEQ ID NO: 69747 - DNA, 601 bp, Human; identical to SEQ ID NO: 25362

SEQ ID NO: 69748 - DNA, 601 bp, Human; identical to SEQ ID NO: 25363

SEQ ID NO: 69749 - DNA, 601 bp, Human; identical to SEQ ID NO: 25364

SEQ ID NO: 69750 - DNA, 601 bp, Human; identical to SEQ ID NO: 25365

SEQ ID NO: 69751 - DNA, 601 bp, Human; identical to SEQ ID NO: 25366

SEQ ID NO: 69752 - DNA, 601 bp, Human; identical to SEQ ID NO: 25367

SEQ ID NO: 69753 - DNA, 601 bp, Human; identical to SEQ ID NO: 25368

SEQ ID NO: 69754 - DNA, 601 bp, Human; identical to SEQ ID NO: 25369

SEQ ID NO: 69755 - DNA, 601 bp, Human; identical to SEQ ID NO: 25370

SEQ ID NO: 69756 - DNA, 601 bp, Human; identical to SEQ ID NO: 25371

SEQ ID NO: 69757 - DNA, 601 bp, Human; identical to SEQ ID NO: 25372

SEQ ID NO: 69758 - DNA, 601 bp, Human; identical to SEQ ID NO: 25373

SEQ ID NO: 69759 - DNA, 601 bp, Human; identical to SEQ ID NO: 25374

SEQ ID NO: 69760 - DNA, 601 bp, Human; identical to SEQ ID NO: 25375

SEQ ID NO: 69761 - DNA, 601 bp, Human; identical to SEQ ID NO: 25376

SEQ ID NO: 69762 - DNA, 601 bp, Human; identical to SEQ ID NO: 25377

SEQ ID NO: 69763 - DNA, 601 bp, Human; identical to SEQ ID NO: 25378

SEQ ID NO: 69764 - DNA, 601 bp, Human; identical to SEQ ID NO: 25379

SEQ ID NO: 69765 - DNA, 601 bp, Human; identical to SEQ ID NO: 25380

SEQ ID NO: 69766 - DNA, 601 bp, Human; identical to SEQ ID NO: 25381

SEQ ID NO: 69767 - DNA, 601 bp, Human; identical to SEQ ID NO: 25382

SEQ ID NO: 69768 - DNA, 601 bp, Human
gtactaccctcagttttttcaaatacctgtggctatagagaaaatgctgttttcaaaaacgaaatcatttcccagaactttttaaaaaactcgttccttaaggcatatatccaagaaacaaattttttaaattaacaaaacagaaataaataatccataagagttcctaaatcttttagctcatgttttataacatagaacgtttattgtaaattataacaaattgtcacaatatgcttattaaaagatattttgaatgctgattaaaatgacttttctttgctccagtattagggtccartactaacatatataactaactagcatacataacaaacatattaatttctatattttttcactgtgtctactttaactattttctcattctaaccttgaaactttttataacttctcttgccaagcaatacagcatatactgtataaaatctcaaatctataaatcatggaaaacatattaacaaaatgtgaaactaaatgctcagaactgtggatttgctgttgaatagcaattggcaaaattgctctggaatttttcctgttcctgttacaaaaaacgctgtcccaaacagttaacatc

SEQ ID NO: 69769 - DNA, 601 bp, Human
tgtggagtttgccaactgtgccacttttgaactcatttcttcctccctcatctagatcttgtcaaaaaataaatgtaggacacaaatctaagccataaaggagaaaataataagagatatatatgaggaggtaacacagcaggatgagttggcccggaatttttagtttgaagacttacatattaaattctgtgaccttaattgttccttatctggatacaccaaagaaaggctggatattggatatatgattgagctagaattattctttgtttgaagtagagggatattttgtggacattttttttttttccaagacagaatctggctgtcttgcccaggcttgagtacagtggcacgatctcggctcactgcaacctctatctcccaggttcaagcaattctcctggctcagcctcctgagtagctgggattacagaagtgcgacaccacgcctggctaatttttgtatttttagtagagatggggtttcatcatgttggccaggctggtctcaactcctgacctggtgatccgcccacttcggcctcccaaaatgctggatttacaggaatgagccacagcgcccgggcgacatttt

SEQ ID NO: 69770 - DNA, 601 bp, Human
gaacagcctggttaacatggtgaaaccccatctctactaaaaacataaaaattagcctggtggtggtggtggcctgaggtgggagaatcgcctgagcctggggggtggaggttgcaatgagccgagattgcaccacctcactccagtctgggcgacagagtgagaccctgtcaaaaaaaaaaagaaagaaagaaagaaagaaaacgaaagaaagaaagaaggaaagaaaaagaaagaaagaaagaaagaaagagagaaagaagaaagaaagaaaggaaagaaagaaagaaagaaagaaagagaaagaaagaaagaaagaaagaaagaaagaaagaaagaaagaaagaaagggaaagaaaggaaggaagaaagaaaaagagagagagagggagggagggagggacaatatgggcttctttgtggctgtggagtttgccaactgtgccacttttgaactcatttcttcctccctcatctagatcttgtcaaaaaataaatgtaggacacaaatctaagccataaaggagaaaataataagagatatatatgaggaggtaacacagcaggatgagttggcccggaatttttagtttgaagactt

SEQ ID NO: 69771 - DNA, 601 bp, Human
agaacagcctggttaacatggtgaaaccccatctctactaaaaacataaaaattagcctggtggtggtggtggcctgaggtgggagaatcgcctgagcctggggggtggaggttgcaatgagccgagattgcaccacctcactccagtctgggcgacagagtgagaccctgtcaaaaaaaaaaagaaagaaagaaagaaagaaaacgaaagaaagaaagaaggaaagaaaaagaaagaaagaaagaaagaaagagagaaagaagaaagaaagaaaggaaagaaagaaagaaagaaagaaagagaaagaaagaaagaaagaaagaaagaaagaaagaaagaaagaaagaaagggaaagaaaggaaggaagaaagaaaaagagagagagagggagggagggagggacaatatgggcttctttgtggctgtggagtttgccaactgtgccacttttgaactcatttcttcctccctcatctagatcttgtcaaaaaataaatgtaggacacaaatctaagccataaaggagaaaataataagagatatatatgaggaggtaacacagcaggatgagttggcccggaatttttagtttgaagact
